United States Patent 10,233,495 (METHODS AND COMPOSITIONS FOR SCREENING AND TREATING DEVELOPMENTAL DISORDERS) - sequence listing, part 38

SEQ ID NO: 422 - DNA, 149644 bp, Homo sapiens
gtgcttgcattggttgcaattctgagagtcatctctgatggatggacatagataccttggccttggacaatttgtgctgactgtggagcatctgtgggtcctgtggctggcagtggaggcggtaaggagatgactagcagtgagctaccctaaggcccccttgtctaccgcctctcgtctcaaagtcctcatcctcctgtacacatgactgcatggacagccagtaggtgctttcttcttcagtttcttgaaacttgaacagtcatctgttttgctgatagattaagtttgttaaaaccctgccttgtccaagggcagtggttcatgcctgtaatctcaacactttgggagaccaaggtgggaggatcacttgagcctaggaagtcaactctgtttttcttataattctaccatccgctctccaccatggagccagactgacctttggaaaacatcccccaaccccccaccgccaaaaaaaacaaagaaaagaaaaacatcccagatcatttcattcccctgctagtgatactcccgcatgagtgattttcctttgtactttgaataaaattccaactcctgctgatggcacccaagggctgtgtgtaactggcttccgcctgcctctccagcattgtcttagatcatctccccacactccccgtgtcgtgtacatgccggcctcctttttgttcttggtctgtcttacctcagggcttttgcacatgctcgtctcagtgtctgccaaatgtatagctcgttccttatccttcaggtctgtttccaaatgtcacttccttggaggctgtttctgaccatcctgttttaaatatgcccctagttactctatcatgttagctttatttactgttttatttgtatgtttatttgtatattgattggtgttctcctcattcacacacgcaaactctcaaatgtaaatttcataaagacagggacttccccattcttgttcactgctagcagaatatctgaaactcagaatgccctcaaatatttctttttttgttttttttttgtttgtttgtttgttttttttttgagacggagtctcgctctgtcgcccaggctggagtgcggtggcgcgatctctgctcgctgcagcctccgcctcccgggttcaagcaattctcctgcctcagcctcctgagtagctgggattacaggcacctgccaccatgcccagctaatttttgtgtttttagtagagacagggtttcaccatgttggtaagactggtctcgaacccctgacctcgttatccactcgccgcggcctcccaaagtgctgggattacaggtgtgagccactgcgcccagcctaagtttttgaatttttagtagagacggggtttcactgtgttagccaggatggtctcgatctcctgacctcgtgatccgcccgccttggcctcccagagtgctgggattacaggtgtgaggcaccatgcccagccaccctcaaatatttgctgaatgaatggctatcgttctttgtcaaatccctttctcattaatcccatgcactgagtagaatggcatgaaatatgtttggtttctctgtctagtttgagttcctgagatctagttggtgagagacatgatgttctaccggttgctgtcgattgttggaagacaaagagccagcccaggatggcagaactggtcctctgcaagaaacagcacgtcagctgccgaggcgcgttccatggccctgcccacccaggcacaggtggtcatctgtggaggtggaatcacgggcacttctgtggcctatcacctctccaaaatggggtggaaggatattgtccttttggagcagggcaggtaaggatcagactgcatttggctcatggctgtgctgcactaatcgtataagattccctctcctttcagagatactgccccaccagtagctaatctaaatgttgctaagtagcatgagaagaagcaaggtggaatctcctgaattttgtttaaggatgactaataatgctcatgttctctggtttttagagagttggcaaatttcgttttccttttttttttttttttttttttttttggtggtggtgttttggtagacaggatctcgctttcttacccaggctgagcttgaattcctggcctcaagcagtcctcccaccttggcctcccaaagtgctgggactacaggcatgacccactgtacccagcaacattttagactttgacaaaaatttgcgtttgtaaataatgtggattgcatttaagcaaagtagacaactgcttgtgtttgcttaattgctaggttcttaatattgttctcattccccaagagaaatatgctctataggcttagtttctctgtgctcgccttcttttaggtcaagtattttctgctttattggcttgtaagctaagtccctttatattaatttgtaatagttacagagattacagaatggattcttataatccatcattaattaatattataccactatacaagtaatgttagattcatacaacaatattggccgggcatggtggctcacacttgtaatcccagcactctgggaggctgaggtgggcagatcacctcaggtcaggagttctagaccagcctggccaacatggtgaaaacctgtctctgctaaacatacaaaaattagctgggcgtggtggtgtgcacctgtaatcccagctactcagcaggctgaggcaggagaatcgcttgaatccgtgaggcggaggtggcagtgagcagagatcatgccactgcacgctagcctgggtgacagagcgagactgtctcaaaaaaaaaaaaaaagaatacaggcctttgactctgataattctcaacctgtgtttagctaatgttttcttattcccttttttttttttttttaagatggggtcttgctgtgtcacccaagctggagtgcagtcacactatcacagctgactgtagccttgacctcgtggattcaagcagtccttctgccatagccttccaagtagctgggactactgacatgcaccaccacatctggctggttgttgtatttttctgtagagatgggatctccctgtgttgcctaggctgttttcttttctttcttttttttttgaaatggagtctggctctgtcacccaggctggagtgcagtggtgcaatttctgctcactgcaacctccgcctcctgggttcaagcaattctcctgcctcagcctcccgagttgctgggattacaggcacccaccaccatgcccggctaatttctgtttttttagtagagacaggatttcaccgtgttagccaggctggtcttggactcctgacctccagtgatctacccaccttggcctcccaaagtactgggattacaggcgcgagccaccacacctggcctaggctgttgtcttgtgatcagacttgggttagagacttttataaccatcactgtattgagatacaatttgcataccatgccactcatccttgttaagtgctgaaatctgtttacagagttgtgcatccatcatcataaccaggtcatacatttttggcagtaagaccacagaaattaggctggactctcagcagtgcaccacatcaggaggtgtatggctgtcctgtctcacttctggtggtgataaacctggtcactcagttacattggtgtcctccaagcatctctagcacagagaccctgttttctccccttgtaatgggccagtgccctttgaggagagatggattctgagattatgccaatatcctgttcatatgagacctccacctaccgggcttagcatccattgacaactgttgcctgagtcagccaccaccgtgatggttgacaaatggtgattttttgatcatacttctacatttattatagttggcatattactgtcaggaagagatttccttctcccccatttatttactcagttatatatctgtatacacacatacacacacacacaccagtttagactcatggatttctattttatgcagtggatagttttttttttgagacagagtcttgctttgtcacccaggctggagtgcagtgacgtgatctcggctcactgcaacctgtgcctcccggattccagtgattctcctgccccaggctcccaagtagctgggattaatagttgcatgccaccacacctggctaattcttgtatttttagtatagatggggtttcaccatgttggccaggcaggtcttgaactcctgacctcagctgatccacccgcctcagcctcccaaagtgctgggattacaggcatgagccaccgtgcccggcccgcagtggatacttttaagagcaaaagtgggttttgtttttgttaatgtttttgagacagagtctcacgctgtcactcaggctggagtgcagtggttcaatctcagctcactacaacctctgcctcctgggctcaagtgatcctcccaccacagcctcctgagtagctgggactacaggcatgcactaccatgcctggctaattttttgtttttttggtagagacgtgatttcaccttgttgtccaggctggcctcaaactcctgggctcaagtgatccgcccacctcaacctcccaaagtactggggttacaggtgtgggccgccacacttggcctcataatgcttccttgatgtcaaagtctttctcctattttttgaaatccttttaaatttaattatcaggtatttccacaaaaagtgataaactaatcgcagtgtaaatgtttctaagtgggagaccctagggaggttcatttttggtttaatttgttgcttcaagattatataataccttagaattgatataaggcagactatttaaacctcacacttaaaaataattacgccagccaggcacgatcgctcacacctgtaatcccaggactttgggaggccaaggtgagtggatcaccggagatcaggagttcgagaccagcttggccaacatggtgaaacgccgtctctactaaaaaatacagaaattaactgggagtggttattcgcgtctgttaatctcagctactcgggaggctgaggtaggaaaatcacttgaatccaggaggcggaggatgcagtgagccaagatcgcaccattgcaccccagcctgggcgacagagcaagactcagtctcaaaaaaaaaaaaaaaaattatgcctcggccaagtgcagtggctcatgcctgttatcccacgactttgggaggccaaggtgggtggatcacctgaggtcgggagttcaagaccagcctgcccaacatggggaaaccccgtctctactaaaaatgcaaaaattagctgggcgtggtggcataagcctgtaattgtagctactcaggaggctgaggcaggagaattgcttgaacctgggaggcagagattgcagtgagccaagtttgtgccactgccctccagcctgggcaacagagtgagactgtctcaaaaaataatagttattattatgccttatccgtggcttgtgaaatggttttatactgccctttatgtataattattcctcttgtccatcttcactattgttctcatagatcaatgggtcttaaatctgtctgcacattagaatcagctggggagcttttaacaattaccagtgcccagacctctccccagaacaaaccagaatctctaggggtgaggccaggcatcaatatttttaaaagcttccccggggactctaatgtacctccaagggcgagagccactgtcaaagctgctcaaggagtgctatcccagcagagacgtcaccagagctataggtgctgaccaccagccagttaatggaactcccacctggggtggagctccacacagttacaaagatgatagaaaaatctctttagggagctgacaatcttatgtggaaaatataattattagagtaaatacagtaaactcaagtgacaggcatgctgacacagatgttagtttatttactgagtgataaataatttggggaaaatgaccttagaaccccccacctgctttcttgacatatgggtcccttgcaaaactgggtctttgggccctagcattactgtagcctttatattctgttgctaccacaaattagagaacatttttttcaatgtaaagtttatgtacttttgaataggcaatgtatttatatgattcaaaattgaaaatatgtaaaagaagctgggtgcagtggcttatgccggtaatcccagcactttgggaggctgaggcgggtggatcatctaaggtcaggaattcgaaaccagcctggccaacatggcaaaaccccatctctactaaaaatacaaatttagccaggcatggtggtgcacacctgtaatcctagctacttgggaggttgaggcaagagaattgcttgaacctgggaggtggaggttgcggtgagccgagattgtgccattgcactccaatctgagtgacgagcaaaactccgtctctaaaaaaacaaacaaacaaaaaaacaaaaattagctgggcatggtgacacacacctgtaatccctgctactcgggagactgaggcaggagaatagcttgaacccaggaggcagaggttgcagtaagccgagattgtgccattgcactccagcctgggtgacaagggaaactgcgtctcaaaaaaaaaaaaaaaaaaaaaagtatatatatatatatgtaaaagagtatacaggaaaaagactccccaatgttctttccttttctttctttttttttttaagatggagtcttgctctgtcacccaggctgtagtgcagtggtgcagcctcagctcctgcaacctctgcctcctgggttcaggcgatcctcctgcctcagccttctgaatagctgggattacagacgcctgccaccatgcccggctgatttttgtatttttagtagagatggggtttcgccatgttggccaggctggtctcgaacgcctgacctcaagtgatctgcctgcctcagcctcccaaagtgctgggattatagatgtgaaccactgcacccagccctcaatcttcacttctaacaaaaagctttctctctggagggaagttaagttctagttatattctctacttctataagcaattatgtgttggtaggtttgtgtatatgtgtatggatattcatttattatattttttctcttttttatataagtgggagcataccttacacactgttcttcaccttgctttttcattatgattgttccattttggtacataaagaccttttcattcttttttatagctgcataatattccattgtatagatgaattccaaaattttattttattttagagatggggtcttgctctattgcttagtctgaagtgtagtggcacaatgctagctcactgcagccgcaaacttttgggatcaagggatcttcttgcctcagcttcccaagtagcctggctaacttttatctttattttttttacttttttttgaggcggagtctcgctctgtcacccaggctggaacgccgtggcacagtcttgactcactgcaagctccacctcccgggttcatgccattctccttcctcagcctcccgagtagctgggactacaggcgcctgccacaatgcctggctaattttttgtattttttgtagagacggggtttcactgtgttagccaagatggtttcgatctcctgaccttgtgatccgcccacctcagcctcccaaagtgctgggattacaggcgtgagccaccgcactcagcctttatttttatttgtttatttatttttatttttatctttttttggtagagacacagtctggctatgttgcccaggccagtcttgaactcctggcctccagtgaacctgctacctcagcctgtcaaagtgctgggattacaggcatgagccactgtgcctggcctaaactatccagaattttaaatctgtcccatgtcattgaacatttttctcaccctgttgcccaagctggagtgcagagatgtgatcacagctcactgcaacctctaccttttgaactcaagcgctcctctggccttagcctcccaagtagctgggactgcaggcatgtgctaccatgcctggctaattttgttgttgttgttggtagagatgggttctccctgtgttgaccaggctggtcgtaaacccctgtcctcaagcagtcctcagtcctcctaccttggcctcctaaagtgctgggattataagtgtgagccactgtgcccagcttgtttccatcttttggtgttagaaacagtattaaatgagaaaccctgacctcgtattcacagatgacgtcaatctacctaatagcattttgcatccatcctgcaggctggctgctggctctaccaggttctgtgctggcatcctgagcactgccaggcacttgaccattgagcagaagatggcagactactcaaacaaactctactatcagttagagcaagaaacagggatccaaacaggtaagcaagtgtcttccatttattgctttgcctgtccctgagattgttatattcatttctgtatttggtcctctgccaggtgtgcctgctgctttggtaattaaaacttgggttggccgggcatggtggctcacgcctgtaatcccagcactttgggaggccgaggcaggcggatcacgaggtcaggagatcgagaccatcctggctaacatggtgaaaccccgtctctactaagaaattaagaaaatatgtaaattatccttactgtacttcttttgaaaataagataccaaattgcttcaactctttcttcataagaattaagagtcattgcattttaggagaattgtcattggcccaagtgtaattatggttctatatcaggtgtgttgattacagacaacaggaattggctctggccaacttggagcttgttgggaggagcttgggcctgtggagttggcaggaggctgccagctggaggcagcctggaagccaggatgtggggactgcaccgcaggcagtccctcagcgagaacaggagcagcctggcgtggctgatgctgcccttgagatggtgacctctagtcattcacctacgtgctcaagactgactcttccaggagggtctgattggataagcttaggtcacatgcccactgtttggctatactggggaagaagaagggagaatccgacccttggtagctgatgttattgtgagtggcctttgccagggattacactcccccaagactaggaggagaaagggtgaaactgcctaaaaggtgggaagaatagggatggtcgaatccctgcccaaaactgtcttttttttttttcttttttttaaagacaaagtctcactctgttacccaggctagagtgcagtggtgcaattttgacccactgcaacctccacctcctgggttcaagcaattctcctgcctcagccttcccggtagctgggattacaggcgtgcaccaccacacctggctaatttttatatttttagtagagacagggtttcaccatgctggccaggctggtctcaaactactgacctcagatgatccgcccccctcagcctcccaaagtgctgcgattacaagcatgagccactacacctggcctagaatctcatttgatcctcacaacctcacaaaactgtgagctgagaatgtttggtcagggcatggagccttagtgcatctgaagttcttaaaattttgcatagaagctcagagaagctgatttacctgcccaaggatattgagtggcagtcccaggattcatcacaggtcttctaacctataatctagtggattttccactctcctgtcctacatttggtctgatctgtctcatttgggctcatttttcttacaggttacacaaggacaggctcaatctttctggcccaaactcaggaccgactgatctccctgaagcgcatcaacgcagggctgaagtacgtaagagtctagaagcgtgtcctgactttaccacactggcctctgccaaagagcctgtgaatgtcattgtcccttgtgttctgtggcagtgttataggtatcccttctgagatcatctcccccaagaaagtggccgagcttcaccatctcctcaacgtgcacgacctggtgggggccatgcatgttcccgaggatgcagtggtgtcttccgctgacgtggctcttgccctggcaagtgctgcctcccaaaatggtgagcaggtttttgcattttcttaagataggttagcagggaagacattacctaaggaagtgtctcacaataggaagtgacaccaactcaagtttggaaagattatcctctttggggtactcagcctccattttgaacacttataattttatttatctgttaatgagtgttttccctcagggccacatttttaaagttctaaagaactgcttttagtgctaattaatgccccttttttggagacagagcttcactcttttcgcccaggctggagtgcaatggcacaatcttggctcactgcaaccttcgcctcctgggttcatgtgatcctcctgcttcagcctcccgagtaggtgggactacaggcgtgccccactacacccggctaatttttttgtgtatttttagtagagacggggtttcgccatattggccaggctggtcttgaactcctgacctcagatgatccacctgcctcggcctccctaagtgctgggattacaggcgtgagccactgtgccctgccaattaatgccctttggacttaaggtaatattttccgccacaggacttgagaagctcaaggtgaaaacacaccttggaagtttaatccacacctgaaatcatgagcccagttgcattgaatgaggggaagacttaactagcgtccagggtatcatatccatggtatgagcaggttagcacttaaggcgcactatttacatcctctcctctctgctccatagtttatgattccaggaatttaattattgtgttccaaagtctgtttttaaactgagttgctattttcaatcttgaacaaggcccatttacatagtctcaggatgtgattctagggttttgtgttttttttaaatgaaagcattgagccgggcgtggtgtctcatgcctgtaatcccagcactttgggaggccaaggcaggcggatcacctgaggccaggagttcaagaccaggctgaccaacatggtaaaaccccatctctattaaaaatactaaaattagccgggcatggtggtgcatgcctgtaatcccagctacttgagaggctgaggcaggagaattgcttgaacccaggaggcagagagcgagccaagatcgcacgactacactccacccttggcgacaaagcaagactccatctcaaaaataaaataaaaaaataaattaaagcattgacttgactttgtcagtgtttcttctgggtggagaacctgctgcacatgccttcattctggaacatcagatgaaacaccaactctttctttaccttggaacaggtgttcagatctatgaccggacatctgttcttcatgtaatggtcaaaaaaggtcaagttactggagtggagaccgataaaggacagattgaatgccagtattttgtcaactgtgctggccaggtaggtcagcaccaacactgctgttcttatttaacgtttgtctccaagatttttttggtgtagagaagtaagattagtattgtgattggttatacagatatcagtaactacgctgtttcttgtagggtattctaaatcagaaacctacacttagtctgcaaatagaagcctgtgtgaccttgtccttcctccacactgggttgatgggtgctatcctggtcaggaaggccagcaaatggtcaggcattgacgtgaatccttggcactgggtcttgatgttacatttcattctataacctagcaaataacatattaggctattttattgtgtcaggaatgtggacactaatttccaggacactgcttcttttaaagcagattggctcttgccttccatgctatgatcccgaagtgaactaagaaatacttttgccatgtgaagttcatttagtgattgctatttggggtttgtagctgagcccaggcgttttatcaaaaggacctcctttggttcccatgagctcctttgactagctggtaaatatctcttcctttgatctcaaagtaatttttatgtcttaaaaaatgtagtattgctccccatccaaataattgaactaaagcaggctgacttcccacacctgacactgtagcaagagcacacataagccacttggaattaatctcaagaggctgaacttgctcatttttatttctgttcctcttcccacccacaaatcaacctgtccatttgtagtgggcatacgagctgggtctgtccaacgaggagccggttagtatcccgctacatgcctgcgaacacttctacctcctgactcgccccttggagacccctctgcagagcagcacaccaagtgaggacttgcacttttttaaaaaatcttgtttctttgccagtatcctgtcctctgaaaaggaaaactttctgctaaggacagcctgtgtctgaaagagtctttcatttctagagcatgttacagggaggtggacccaattctgacttttctttattaactctttatgaaaggatggccaaaatttccattaatacatttttttgtttttgtttgttttgcaagctaattttagtcctaaacagaggtcattgagaatatttggactgtcttgttgactttttaacttgaatgctatggatagtagaaatgtcataggtaaacaatagacttaggtgggttcgtggttccaagcactgtaggagagggttctcacatccttttgacggtcttcatgcctagaatgggctctgcaacccccctctctgttaaactttcgcttggcacagtgggagttacgtggtttgcttgtggggactagtcaaagcttctaggtaagggataatcagagaaacagtctccactgaaaggctaaatgggaggatcttcccccgtgacctcaaaaggtattttaaagctaatgaatgcctgtgttcattgaatgttctttcattaataaagccattaatgggtgtttttgtttggttgttctgtccatttagaaagctgacttgcctctaaacccttgttttttcttccactccccactccatgtcatttctccacctcagctattgtggatgctgatggaagaatttatattcggaactggcagggtggcatcctgtctgggggctttgagaagaacccgaaaccaattttcactgagggcaagaaccagctggagattcagaatctacaggaagactgggatcactttggtatgtgaactgcattataaccgtagtgccttatatttgtttaagatgttatatttttcaaagtattttgaagaatagttccttgtttaatgtttataacatcgccatgaggtacaacagtggttacagagggtgagtttgcctggtctgaggatggagttactaggtagcagattcaggggactaaaatcttagttaatagacatttgccttattcttttttaattttattcttagttttacttttttttttttatttcttgagacggagccttgctccgtgctcagactggagtgcagttgcacaattatagctcactgcagccccgaactcctggtctcatagctttttttttttcttctttttggtagagacatggtctcgccatgttgcccaggttgatctcgaactccaaggctcaagtgatccctttcaccttggcctcccaaagtgctaagattacagatgtgagccactgtacctagccctttgtgtgtgtttagtcatctctatcattttgtgtgtgtgtgagatggcgtcttgccctgtcacctaggctggagtgcagtggcatgatcatagctcactgtagcctcaaattcgtgagctcaagcaatcctgccacatcagcctcccaagtagctgggattacaggtgcttgccaccatgcctagctaatgtttaaattttttgttgagatggggtctcgctgtgttgcccaggctggtctcgaactcttgggctcagtcaatcctgcctcagcttcccaaagtgctgtgattacgggcatgagccatgatacccagctgctttttttttttttttttttttgagatgaagtctcgctctgttgcccaggctggagtgcagtggtgtgatctcggctcactgcaacctctgcctccccggttcaagtgattctcctgcctcagcctccagagtaggtggtaggtgggattacaagcgcctgccaccactcccgactaatttttgtgtttttagtagagacagggtttcaccatgttgatcaggctggtcttgaactcctgacctcaggtgatccgcctgcctcagcctcccaaagtgctgggattacaggcatgagccactgcgtctggcctttttttttttttgagataagagtcttgctctgtcgcccagactggagtgcagtggcacaatctcggctcactccaacctccacctcctaggttcaagtgattctcatgcctcagcctcctgagtagctgggattacaggcatgcatcaacatgtccagctagtttatgtatttttagtagagacaggattttaccacgttggccaggctggtcttgaaatcctggcctcaagtgatctgcctgccttggtctcccaaagtgctgggagtaaaggtgtgagccactgtgcccagctctgcttcttttttttgtttttttgtttttttttgagatggagtttcactcttgttgcccaggctcaagtgcaatggtgcgatctcggctcaccgcaacgtctgcctcccgggttcaagtgattctcctgcctcagcctcctgagtagctgggattacagacatgcgccaccacgcctggctaattttgtatttttagtagagacagggtttctccatgttggtcaggctggtttcgaactcctgacctcaggagatctgcccgccttggcctcccaaagtgctgggattacagacgtgagccaccatgcccggcccctgcttattctttattcacctaaaattattgctcagattttaggttttaggaggagacttctttcagtaggacttcatataaaattgaagagttctttagaaaacagaattgttttgttttgttttgtttttcagaattgttttgttagtgtagtattttattaaattttaaaataattttatttatttatgtatccattcattcattttgagatggagtcttgctctgttgcccaggctggagtgcagtggtgcgatcttagctcactgcatcctccgcctcctggattcaagcaattctcctgcctcagcctcccaggtagctggaattacaggcgcccaccacaacgcagagccagtttttgtgtttttagtagagatggggtttcactatttggccaggctggtcttgaactcctgacctcaagcgatccacccgcctcggcctcccaaagtgctgggattaccggtatgagccaccgcacctggcctttaaggcctgtaatcccagcactttgggaggccaaggcgggcagatcgcctgaggtcaggagttcaagaccagcctggccaacatggcaaaaacccgtctaaatataaaaattagctggatgtggtggcgcacacctgtaacgccagctacgtgggaggctgaggcaggagaattgctggaacccgggaggcagaggctgcagtgggctgagatcgcaccactgcactccagcctgggtgacagagcgagactccatctcaaaaaaaaaaaaaataataataataatatagttacctagttccaaatttaaaaagatgaaagagtctctaatgaagaatttccctctgacccttgatgggctttctttttttaataaattcttacggaaaatttcaaacttttaaaagtggatagaagctgggcacagtggcttacacctgtaattccatcattttgggaggccaagatgggaggatcactggagcccaggaagtgaagaccagcctgggcaacatggcgagactggagactatgtgtctactaaacaaacctggcgagagtagtatgatgagcccccatgtacccattatccagctctggtctggtttcatctttttctgctgtccactggattatgtcctgatggtagatttcctttaaagcagggtgaaagtctgtcttttgcagctattccaatgcagaacattgcctttttttttttttttcctgagatggagtttcactctattgcccaggctggagtgcagtgtcacgatctctgctcacttcaacctccgcctctcagattcaagcgatttttctgcctcagcctcccgagtagctggggttacaggcttccaccatcacgactggctaatttttgtatttttagtagagacgaggcttcgccattttggccataatgctcttgaactcctgacctcaggtgatccgcccaccttggcctcccaaagtgccggggttacaaatgcaagccaccatgcccagctcagaacatcaccttttattaaaatctctgtggccgccatttaagagcttttccactcacactggtcccttcaagattattatctgtagatacgttttacttgctgttctctgctgctttcctttctaaccaatatcttttttcctcagtctttataccaagtattttgcagctatatcctgtaattctaccaaggtttctgctttgtgataaatggcccagttggctcgtctttaaaaaaatctcttccagccggacgcagtggttcacacctataatcctagcactttgggaggccgaggcaggcagatcacttgaggtcaagagttcgaaactagtgtggccatcatggtgaaaccccatctctactaaaaatacaaaaaattagctgggcatggtggtgcacgcctgtaatccgagctaattggcaggctgaggtgagagagtagcttgaacctgggaggcagaggttgcagtgagccgagatcgtgccaccacactccagccggggcgacagagtgagactccatctcaaaaaaaaaaaaaaaaaaaatcaagaggttttctgaaaggggagagtgtaaaaaagtagaggggttgaaagtggtttaattccttaaaggtgagaactctatttggttttgttgtcattgctcagagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaagtctttctcactcaaagtcagctgtgaacataagtcaacttgctgggtctcttcccttctagaattacttgttattaacatggcgtgtggtatatttaatctagtatgttaagactaataagaagatacatgtaattttggagttgtccccttctaagtatgagaggctccccatgttccagaaatgtcatcgggcaaaatgtttttgcaactcatcttttggagttagccacagatcctgtgggatattcttttatattttttcagttataacaaatattggtcatttgagtgtgtatttgagtttggtagccaagtatgttgattgaggtaggtatttgaactaggtaatacacggtttgtttgtttttttagacagtcttgctctgtcacccaggctggaatgcagtgacatgatctcaggtcactgcaacctccacctcctgggttcaggctattctcctacctcagcctcccgagtagctgggattagaggtgtgtgccaagacatctggctaatttttctatttttagtagagacagggtttcaccatgttagccaggctggtcttgaactcctgacttcaagtgatccacccaccttggcctcccaaagtgctaggattacaggatgagccactgtgcccggccacaagtttttatttaaaaattagacactaggccgggcgcagtggctcacgcttgtaatcccagcactttgggaggccgaggtgggcggatcacaaggtcatgagatcgagaccactctggctaacacagtgaaaccccatctctactaaaaatacacaaacaaaattagccgggcgttgtggcgggtgcttgtggtcccagctactcgggaggctgagacaggagaatggcgtgaacccaggaggcagagcttgcagtgagccgagattgcgccactgcactccagcctgggcaacagagcgagactctatctcaataaaaataataataataaaataaaataagacactaatgaacattaaataagccagtcacaaaaggacaaataccgtgtggttccacttatatgaagttgctagagttgtcacatcatagagacagaaagtacaatggtggttgccagaggcgggggaggggagctattcttgaatgagcacagagttccagaaatgcaagaggaaaagagttctaggatggatggtggtgaaggttacaccgcagtgtgaatgtacccactgccactgaactgaatacttacaaatgggtaagatggtagccacgatgaaaagtttattttaaatttatgagaccagttctcttgagtgatttgtagaatggctctgaaaacagttacagaagaggagttagaaaaatgtttggagcaaaggagatgtggtcacgtaactgtataatctttaggtgacagaaaaaaacccattggatatttagagtatatttgtatgtgttttagtcttatttcttcatagatgaggcttataacttttttgaaacaagatcttactctcacccaggctggagtgcagtggcaccatcatagctcactgcagccgcaagttcctgggctcaagggatcatcccgcatcagactccagaagagctagaactaactgcaggcgtgtgccaccatacccagctcttttttttttttttttttttgaaacgaagttttgctcttgttgcccaggctggagtgcaatggcacaatctcggctcaccacaacctctgcctcccgggttcaggtgattctcctgcctcagcctcccgagtagctgggattacaggcatgtgccaccacgccggctaattttttttttttttttttttttttttttgagttggggtttcgctcttgttgcccaggctggagtgcaatggcgtgatctaggcttactgcaacctctgcctcccaggttcaagcaattctccttcctcagcctccgtagtagctgggattacaggcgtgtgccaccacactggctaattttgtatttttaatagagacagggtttctccacattggtcaggcttgtttcgaactcctgacctcaagtgatccgtctgcctcggcctcccaaagtgctgggattacaggtgtgagccacctggctcactttgaaacttttttttttctgtagagacggggtcttactatgttgcccaggctggtctcaaactcctgacttcaagcaatctcctgcctcagcctcccaaagttctgggattacaggcatcagccaatgtgtctggctggcttctatgttaaatacctcctagggaatcttatcatctggggtaaaatcctcatagtagtcttttgagagcagtacacagacccatgttcgtttcttccagaaaagttaaggaaagtgcccaaaactattcagctggtctatggcaatttaggatcttttgattctgtttgttctcgatttgtagaatattaattttctcaaatctcacacctgagccccaacacgtgccctctgtctatataggtaccttgccgaatggatggtacatggttatccctcagaaaacgtttgggaattggacctgaaacgttttggagccctccagagcagccgcacctttctgcgccaccgggtcatggaagtcatgcgtaagtgaagctttatcgcagttgctcctagttgcaggtatcttctcggtggcccgtgttgtcattcagaaggagcaaagttttcctcagttctttaacaagtgctttgagttgggcatttgatttgactgtttcaggcctgagttaaggggctttatgctcctcatgatatatacgtaacattttctttagtgcatcggaccttgtttcattctgagaacaagaaaatagaataggagttacagttggtacatagcagcttcataaatattctaagcaatgccttcttcccggtctgccttgagagaccgtatgtcgaagtgcgtgctttctgcagtctgccttgagagaccctgtgtcgaagtgaatgctttctcactcccacttagtttttgagaaaatgctttctcactccccacttagttttttctttccaagtcagagaatttgccgagttattctcagagcttcaggcttccgtgagtgactttcaccattaatccaccctacagcagcaagattgggagccacttcccatataaatacaaaacatacattcctgctctcactcccgtgttctcgccctgcttcaactttgaaggattggccacttcatcttaatttgttattctaccttgatctctgatttattttctaggaagcccttagaaagcttttgtatcaggaattgaaccaaaccacgtgggttcaagttgtaatttcattttcctgtactgaggagctgttctcagactttgccaaatggtatctaaatattttgggcatacttatgctcaggactaagtttctgtgttggctctgaccaccattcttggttgcaagtaaactgttagtttggtagttgaacaacattgttggtgaggactctggatggcctttaatgcctgagtgctcacttttggcctgggaagaggatgtacatccatggagatgaaggacctaacagcaatatgtttaactgctaaggttctttaattttagcaaatattttggttaaaatgttgaacttggctgggtgtggtggctcatgcctgtaatcccagcactttgggacgttgagggaggtaggtcacttgaggtcaggagtttgagaccagcctaggcaacgtagcgaaaccctgtctctactaaaaccaaaaccaaaaaattagccatgcctagtggcacacacctgaagtcccagctacttgggaggctgaggtaggcgaatcacctgagctggggaagttgaggctgcagtgagccatgatggtgccactgtgtactccagcctgggcagtgggactgagaccctgtctcaaaaaaataaaatacaaaatcaaagttttttgttttaaagttgaactattataagcctaaatttccctacccatagttactttggaacctgtacaaatcataattgagcttgagcttctgcttggtgatatgacacttttggtagccaattctcatgaaatagaagtggcaggcacatagaaaatggggaaggcgccaggcgcagtggctcaagcctgtaatcccagcatgttgggaggctgaggcaggcggatcacttgaggtcaggaggtctggcctgaccaacatggcgaaaccctgtctctactaaaaatacaaaaatttagccagatgtggtggtacgtgcctgtgatcccagctacttggcaggctgaggcaggacaatcacttgaacccgggagatggaggttgcagtgagccaagatctcaccactgcactctagcctgggtgatagagagggattccatctcaacaaaaaataaaaaaaaaatagaaaagaaaatgggggaggggatgatagaaccgaaagtactaggagatggagagattgtcaccatgcagagaaccccacctggcttccttctcctgtctcccaacctccccaagccttgatgtgccttttgtttgggatggtgtgagatcagggaccacagatcacactcttctggctttttttacttattgctgttgaagattagaccttaagggaaatgaattttttttttttccgagacagtcttgctctattgcccaggctggagtgccgtggcgtgatttcggctcactgcaacctctgcctcctgggttcaaacaattctcctgcctcagcctcccgagtagctgggattacaggcgcctgccaccatgcctggctaatttatgtatttttagtagagacagggtttcaccacattggtcaggctgatcttgaactcctgacctcgtgatccgcccacctcgacctctcagtgctgggtttacagacgtgagccaccacacccggcctaagagaaatgaattctgaccctagctttgttgtgtgaataatgtcattggtacaatacaatataacttctcagatttcagagccacctaatcaagctgcaatatgtaccctttcacttcagaagtgagttaattatcagggaggaaatgtctgtaacaggtctgagatcctaacacaggcacaatgaagaatcgaatgccattttttcacattttgttaccacctgtgtcccacttagtaaccttcttctctgctatgaagcttggtaaggtttaggaccctgacctttctgccatcatttctacctactaatgtggaatgctgaatgtgaatacaggccgagtcatgccgtgacacgtagctccagggagggacgatagcagcttggcaggattgtcttttccttctggagcatgcctgatacactgggtaattttgaaaattagactacattagcctggaaattgggccgggcagagtggctcacgcctgtaatcccagcacttcgggaggctggggcgggcagatcacctgaggtcaggagtttgagaccagcctgaccaacatggagaaaccctgtctctactaaaaatacaaaaattagtgtggcacggtgacacgtgcctgtaatcccagctactcgggaggctgaggcaggagaatcgcttaaacccaggaggcagaggttgcagtaagccgagattgtgccactgcactccagcctggacaacaagagcaaaactccgtcttaaaaaaaaaaaaaaactacgttagcctggaaagctcttttgaatagaaacaactccagagtctagtggacatgggctactcaggtctagaatctgtgtcttgggctttgatagactactcgtgtcttttctagctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaagggtaagaagtcacattctcatttttgcttcttttttttttttttgtcctgggaattaataaaacatattttcaaatgcataggctagaatgtgttcacagaagaaaaagaaccacgtggactacactaaactctacagggccttgtgatttttccattccgtagacctcctggcattggagcagagcaagactttctataagccagattggtttgacatcgtggagtctgaagtcaagtgctgtaaggaagctgtgtgtgtcattgacatgtcctctttcacaaagtttgagataacagtaagtatttgggaaccaaaaagtaatagattaggaaactttacatatttattgaatgccttttgtttttcatcttcaaaactgattcctgactgggtgcagtgggtcatgcctgtattcccagcactttgggaggccaagggggcgtggatcacctgaggtcagagttccagaccagcctggccaagatggtgaaaccccgtttctactaaaaatacaaaaattaaggccaggagtggtggctcatgcctgtaatcccagcagtttgggaggccgagacgggtggatcacctgagatcaggagttcaagaccagcctggccaacatggcgaaaccgtctctaccaaaaatacaaaaaattaaccaggcatggtggcgggcacttgtaatcccagctactcgggaggcaggagaatcgcgtgaactcatgaggtggaggttgcagtgagctgagattgcgccactgcactcagcctgggcaacagagtgagactccatctcaaaaaaaaaaacaaaaaacaaaaacaaaacactgatttcttaagaattctggtatattttagtgtttcatctgtattgtaacatttttctgaaattttagctccttgtttcaggtttttaatttgctagagaggcctgtttatcataagaatcaatagctagcgttccctggagcttcttgcagtggagtaggtctgcaaatgttgtcacatgggaattggctgattgaattttctcaatgaggttcattgctggtggggccatgtggcccagccaggtgctctcacgctcactctctctgtttcattccctaaccctgcagtccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcaggtgagatgagctgccgtcccgctctgctccctccaacatgttgattccttaggggtgctgtagcagaggctctcaggcgcttctccgggaaccataaatcccagagtctaagaatcattacatgaaatcaaagccagtttattagcagtcctaaacaaaagaaatcaccaggaggaaaagaaaaaaaagcccaccagattatgtaccctactgggagaagatgccttgtcttttttcttttttttttttttgagacagggtctcactttgttacccaggctggagtgcagtgatgcgatcatggatccctgcagcctggacctcctgggctcaagtgatcctcccacctcagctttccaggtagctgggaccacaggtacacgccaccacacccagccagtttttgtatattttgtagagatagggttttgccacattgcccaggctgatcttgaacacctgagctcaagcaatctgcccaccttggcctccaaagtgctgggattacaggtgtgagccactgtgcccagccgatgtcttaacgttagtaaatctgtataatttcttggcattaacaggaagccagaattttgttttgttgttaggtggtgtatcctagaatggtgctactggccttctgtgaaagctaagaaatcatttcctagtatttgcctcattgctttgaaaccaaataagatttgattgcttcctgatccttttgctgctacctggttttgattattttggggtctcacttttcagtttcttcatgatctctccaaccgaccagcaggtccactgttgggcctggcttaagaaacacatgccgaaagacagcaacctgctcctggaggacgtcacctggaagtacacaggtacgggggttcgggctctgccacgtcgaaaaggccagcagatgcagatgtgtccacgtttgccttctttacatttgactctcaaaaatgaacattagagttagcataaaagaggctctctggtcatagaaaattgatctctaggggatgcggtggctgacacctgtaatcccagcacttttggaggccgaggttggaggatcactaggtcaggagttcgagaccaacctggactatatggtgaaaccccgtctctactagaaatacaaaaattagctgggcgtggtggcacacacctgtaatcccagctacttgggaggctgaggcaggagaatcacttgaacccaggaggcagaggttgcagtgagccccagattgcaccactgcactccagcctaggcgagtgagactccatctcaaaaaaaaaaagaaaattgagggctggacacagtggcttacacctgtaatcccagcactttgggaggctgaggcgggcggatcatgaggtcaggaatttgagaccagcctggccaacatggtgaaaccccatctctactaaaaatacaaaaattagctggacatggtggtgcatgcctgtagtcccagctactcatgaggctgaagcaggagaatcgcttgaatctgggaggcagaggttgcagtgagccaagatcatgccattgcacctccacctcccgggttcaagcgattcttctgcctcagcctcccaagtagctgggattataggcgcccgccaccacgccgggctaatttctgtatttttagtagagatggggtttcaccatgttggccaggctggtcttgaactcttgacctcgtgatccacctgcttcggcctcccaaagtgctgggattacaggcatgagccaccacgcccagtcccagagagtacctaatttttaaggatgacttggttccctgattttctcactctcagcagtctcggcttaacccctcccaccttcccacctaactgatcttgccccttggccccaccagcgtttgctctcccaggctctcattctcaattccttgtagtagcaaatatgatatacgtcctgctcctggattgggatactacagaatgttactgaacaaaagtcatgttctagcctgtcttaggatggatgacatgtaattagcacaagctgatgtcacaaacactggtgtccagaataatgctttccttatctagtaagcattaggatatgtttgaagtggatttagcttctctgaatttaaagtctgtatactttttggttgggcagatctccaccgggtactgatttggggttggggcttcttccatcacatagccttgctgggaaaaggaggagaacgggaattgtgtggggtggttatggccagccctgctgcgttcagcaggccctgttggcagaggtgtattcgccagaatcggggtgcttagcatccatccttggagtgtctaagcaaagggacatattcctggtctctgcacccaggcctggctatagctgagcaagtctacagtagacctttcccattggctcagctgttcagaaggagagctggacatctcttgttcttttccatttagccctcaatctgattggccctcgagctgtggatgtgctgtctgagttgtcctatgcccctatgactccagaccacttcccaagcctcttttgcaaggtaagtgctgataaagttctgtttcttaaatgggcagagaatgtgtctttcatagcggtggcaggtacatattcttactatggtgttagcacccacaaagagtgtcttggctgggtgaggtggcacatgcctgtaatcctagcactttgggaggccgaggcaggtggatcacccaaagtcaggagtttgagaccagcctggccaacatggtgagaccctgtctctgttaaaaatacaaaaattagctgggtatggtctcacgcacctataatcccagctacttgggaggctgaggcacaggaatcgcttgaactctggaggcagaggtcgcagtgagccgagaacacgccactgcactccacctgggtgacagagtgagactctgtctcaaataaaagagtgtgctggccaggtgcagtggctcacgcctataatcccagcactttgggattacatcttatatttataaataaatataaaaatacaaaaattagccgggtgtggtggcgcatgcctgtggtcccagctactcgggaggctgaggcaggagaatgacttgaacctgggaggcagatgttgcagtgagccgagattgcgccattgcactccaggctggcaacagagcaagactgtctcaaaaaaaaaaaaaaaaatgtgctgcccttcattagcaaagaagtgactaagtatatttatttatttatttatttatttatttattttgagacagagtttcactcttgttgcacaggctggcgtgcaatggtgcgatctcggctcactgcaacctccacttcccgggttcaggcgattctcctgtttcagcctcccgagtagctgggattacaagcgcccgccaccatgcccagctaactttttgtatttttagtagagacagggtttcaccatgtttgccaggctggtcttgaactcctgacctcaggtgaaccacccacctcagcctcccaaagtgctgggattacaggtgtgagccactgcgcccggccttatttgtttattttttacactccaagcttgctttatttaataagcattaggatatctttgaagtggatttagcttctctaaatgtaaagtctttatgctttttggtttctgtagcactggattaaaatttgaagttacaggattatgacacacacaaaaatgcctttcgaagttaggtcccttctctccatgcagtgtggcctcttttctgtacacagagtaacttctgtgtctgtggcatcttcagggaagaaatggcgtaggtgaatctctgaacttcctacataattttctttcctataagtggcaaccacagctgagtgaaacaaactgtaaccgaatgaaagcaatgacaacggaatcctccccaggaagctgctgattagagagggccaaacggacagacatcttggccacctgtaacgagcaacttccaggtggttactgatggagactctttgaagttcacccaaagtgggatccacctacaaattgtttcacagttttccttcttctccgaggcaaagtgaaagcaacagaaaactctccactgttagctatcagtggacccctcccagcgtttgctctgctgcttggaggagtgacccatacgctcaacacctggcgagtgctgcatcctgtcagcctcctgtggaagcggttcacttcggtgctgtccaggactttccactttcctttataggaacggtgattgcgtcagtggccgctgttagggaactgagctgctatgtaacgtgttctgagaatcagaagcccatctttgaccccaggatagcagattaattatgtctgtgggcatcgggcatcatcttttgtatggcaggcggccagggtttgtctgctgattcccccagagaagacactcgccttgtcctcattgtgcctgctaccctcgactaacacaaggacctggcaaagaggaatattttgtgcttgtcaaggactttcctccactctctaccatcagcttggctaaaactcctgagatggtaacagtagcaagcagagatgtcacataggcagtgctccattctctgtgcctcaggacctggaagttaaccactttcgggatgaaattcttgccttgacgtctgtctccctcaacagtaaacagagggtgcagcactaatgaaaggtttccccaggcgtccctcccttgacaagtaatgtgagtgcccaggctgactgctgcctttgtccctgcaggagatgagtgtgggctatgcaaatgggatccgggtgatgagcatgacgcacacaggagagccaggattcatgctctacatccccatagaggtgagagggcacccttcccttcccttcccttcacttcccttcccttcccttcccttcccttcccacaaccactgtggggtgccagtgctcccagcagcgcgttcaccagcactggcaggtttggagagctgtatctgattgggccttgggagctgaggtaggctgcattgaagagatttgaccatttttaactaagttatataagtttttttgaataggtgatacatttaaaaagtatttggcgccgtctgatctgttctcaccaactgtcaccaataatattagtattacttttatatgtcatttcagatttgtatgcatattgcaagcaaattcataattaatttttttttttttttgagacagggtctcactcttttgcccagggtggagtgcaatggcatgaccgtggctcactgcagcctcgacctcttgggctcaagccaccctcccacctccgcctcccgagtagctgggactgtaggcatgtgccaccatgcctggctaatttttgtatttttttgtagagacaggttttgccatgtcgctcaagctggtctcaaactcctgacctcaggtgatacacccaccttgtcctcccaaagtgctgggattataggtgtgagccaccatacccagccaagccccctttttaaaaacagaaatggaagcatactgctattcttcatcctgtttttttttttttcacttcacaattttttttttaattgaggcagagtctcactctgtcacctagggtggaatgtagtggcataatctcagttcactgcaaccttcgcctcccaggttcaagtgattgtcctgcttcagcctcccgagtagctgggattacaggtgcacgccaccacgcctggctaatttttgtatttttagtacagacggggcttcaccatgttgcccaggcttgtttccaactcctgacctcaagtggtccacacacctcagcctcccaaagtgctgggattacaggcatgagctaccatgcccggcctcacttcacaatttctcttagagctctttctttgttggtacctaaagcaaaagagcttccttgttctttttttctttattttttaacagtggcgtagcattccattgtggtacatcattccgatactaatagacatttatgttatttctagtcttttgctgttataaaaaggtctgcaggctgagttcagtctaatcatatgcaaatagtaatagtttcttccttctccagaaccttttttttgagacggagtctcactctgtcgcccaggctggagtgcagtggcgcaatctcggctcactgcaagctccgcctcccgggttcacgccattctcctgcctcagcctcctgagtagctgggactacaggcgcctgccaccacgcccggctaattttttgtatttttcatagagacggggtttcaccgggttaaccagaatggtctcgatctcctacctcgtgatctgccagccttggcctcccaaagtgctgggattagaagcgtgagccaccgcacccggccggcttttttttttttttttcttttttttttttgagatgaagtctcacacttgtcccccaggctggagtgcgatgacatgatctaggctcaccgcaacctctgcctcccgggttcaagtgattctcctgcctcagcctcccgagtagctgggattacaggcgcctgccaccacacccgactaatttttgtatttttagtagagacaggatttcaccatgttggccagcttggtctcgaactcctgaccttaggtgatccacccacctcggcctcccaaagtgctggaattacaggcgtgagccaccgcacccgggcccatagtctttcttcctataatttccttcctttgttctattgtgacaggtagcaatcaatgattgtaggcatgcttgttttcttcttgatgttagtcatactacttgtagtgataggttttctcttaattttttttttttttgtgagacagggcattgctctgtcacccaggctggcttactgcagcttgacctccgaggctgaagtgatccccctgcctcagcctcctgaatagctgggactacaagcatgtgccaacatccccagctaattttttaattttatttttgtagaggcagggtcttgctatgttgcctaggctggtctcagactcctggactctagtgatcctctcacgtcagcctcccaaagtattgggattacatgtgtgagccactaccccgaccttatttattactattttttagtgcagtgggatgatcatagctcactgtagccttgaacttctgggcttaagcagtcatcccacttcagcttcctgagtagataggaccacagatgcccagctatcttttatttttttgtttttagacggagcctcccactgtcgcccaggctggagtgtagtggcatgatctcggctcactgcaagccccacctcctgggttcaagcgattctcctgcctcagcctcctgagtagctgggactacaggcacacgccaccacactcggctaattttttgtatttttcatagagacagggtttcaccgtgttggccaggatggtctcaatcgcctgacctcgtgagccgcctgcctcagcctcccaaagtgctgggattacaggcatgagccaccgcacccggcctatttttttattttttgtagctttgagagtctcaatatgttgcccaggctggactctaactccagcctcaaatgatcctctcatctcagcctcccaaagtgttgggattaccggcgtgagccactgtgtctggccctgttttaactatttgagccactgtgcccaaccctttttaaatgattaaagcacagataatatcagcgcatgaaatttcatctgcttttccacactcagaagtattacaacaatatgaagatgaagagattgttcaagacttgggaagaatttaaacagatgcagctgccatggttggcctgtgcaggcaggttgattctgaagtgccacccagtggttcaggtgttgtcacctgggtgcttgtggtcaaacctcatcaggaaggggaggctctgtggctctagcagcttcatccttgcttggaggccttggtttcagctttctgatttccctgggctgttcccattcttatgatttttcaagagtctaagagattatttgtgccacgcttgggttctttataagctggcttttgtccaggaagcttatgtttgtctctctgagaagaggtcttccaaaacatgggggcagatggcagattctcgttttgttcacactaaatctctggtattttgtgagaaaaacgagtaaatggtggggaactactctttgagtaaatggtggggacccactcttctctttgattttcccagcattagtcacgtagttggatctggcccaacactagtcacctggttacatcgttcttccttggtcatcctcttacctaaaggaccgggcattgagcttgaggtgggagagtaccacattccctggagatgccagctgtgtattctcctcgtcctgccgcattctgtgggtctcctgcacccaccttggctgattcaggtgtttcccttacacacataccacaggcgagtgttgcatgcaatagcttggattccttttttccacatttaaagttgtcttcccggcacggtggctcatgtctgtaatcccagcaatttgggaggccaaggtgagtgaatcatctgaggtcaggagttcgagagcagcctggtcaacatggcgaaacctcgtctctactaaaaatacaaaaattagctgggtgtggcggcagccacctatagtaccagctactcgggaggctgaggcaggagattcacttgaacccgggagtggagatggcagtgagccgagatcgcgccacttcactctagcctgggcaaaagagcaaaactctgtctcaaaaataaataagtaaataaagttgtcttgatcatagtggtctgtttggtagatgcctgttcagctacagtggtgcagttcatagaaacatactgtgctaggataaagaactgcagtaccactgaagctggttctttgctacgtcttgctttggatttcattttacagttttaaaagcaaacagtgtagtctcatttttgttggactttaaacttaacagcgtatgttcagacagggattgaatatttgctttcagtttggaaaaccttctgttcactgatctgataacgtacatgtttctgaaaccaagaaaagagcagcttgagagcctgaatgctgtgggacatgagcaggcgagccctgccttcctggctcccccgccgtcatccgatgtgtgcacacgtctcgagtaacgtgtgagagctgggcctcacagcttgggccagtacgtgagggagtaacagtggttgggaaattggagcaaaagaacaaagccagaatcagatgaagaccatggagggttggtgggctgttttagaaatgatgatgagattggccatttaccaaatggtgagagagcttctataaattattatttaagaattgctgtaagctagaatcaccacacaagacattttagagaggtgaaaagacatggatcctgttgtcatggagcttaagtccaggctggggtgaccccagctcatcactcctgggctgtgccctgagcgtgtcaaggatgagacatcctgggagttttatacgcctcctctcttgtccatgttaatagtgtgagccatcagcgcttccagacatgctccatgcttaattctgaaggtctgctgcttatgaactttctgtctcttcctatagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaaggtactgtgtttacccagactccactttcactcagcatcccgagtagtgaatctgcactagactaggaagaagaactgatgtgacaggaaaagggggaaaagattgaggccttgatgttagcatcaggtaaatgaggacaagagtgccctgagaatgaaaactttataggataaaatatcttcaaatgaaaacataataatggtggctcacgcctgaatcccagcactttgggaggctgaggcgggtggatcacctgaggtcaggagttcgagaccagcctggccaacatggcaaaacccgtctctactaaaaatacaaaaagtaggccgggcacggtggctcacacctgtaatcccaacactttgggaggccaaggcgggcggatcacaagttcaggagatcgagatcatcctagctaacacagtgaaaccccgtctctactaaaaatacaaaaaattagccgggtgtggttgcgggcgcctatagtcaggagaatggcgtgaacccaggaggcagaggttgcagtgagccgagatcacgccactgcactccagcctgggcgacagagcgagactccgtctcaaaaaaaaaaaaatttacaaaaagtagctgggcgtggtggccagcacctgtagttccagctactcgggaggctgaggcaggagaatcacttgaacctaacaggcagaggttgcagtgagccaaaatcgcaccactgcactccagcctgtgtgacagggcaagactccgtctcagaaaaaagaaaacatagtaaatagatgacacttggtcaggtgcggtggctcacaactgtaatcctagcactttgggaggccaaggcaggaggatcacttgagctcagcctgggcaatacagcaagaccttgtctctgaattacaattgaaaaacaaacaaaaaaacccacttatttctagtgttctgctgtctaaaagactgagtgctttctgggaagctattctgagttaattatggtgatgcattaacatgccacgaatatttgtacaaactagtcgtcctatagtcagctgcctaatttttgtggtttttttcttttgtttttgattttgaggtggggtctcattctgtcacccaggttggagtgcagtggcgcgatgttggctcactgcaatgccctctcatgctcaagtgatcctcccacttcagcctcccaagtggctgggaccacagatgcacaaccatgcccagctaatttttttgtattttggtaaagacagagtttcaccacattggccagggtggtctcgaactcctgagctcaggtgatccgccctcctcggcctcccagagtgctgggattacaggcgtgagacagcacacccggcctaatttttttggtttttttgttttgggcggatcacctgagttcacaagttcgagaccagcccggccaacatggtgaaaccccgtatctgctaaaaatataaaaattagctgggcatggtggcaggcacctgtaatcccagctactcggtaggctgaggcaggagaattgcctgaacctgggaggcagaggttgcagtgagccgagatcataccattgtactcccacctgggtgacagagcaaggctccatctccaaaaaaaaaaaaggtaataacccattttggaaaatataaagaaggaaattaaaatcacccatattttgtctatttaatggtagtaactattttttttttctttcttgagacggagtttcgttcttgttgtccaggctggagtgcagtggcgcgatctcagctcactgcaatctctgcctcctggcttcaagcgattctcctgcctcagtctcccgagtagctgtaagccatccagctaattttgtattttttgtctttaccaaaatacaaaaaattaggtgggtgtggtggcgcatctgtgggcccagctacttgggaggctgaagtgggagaatcacttgagcatgagaaggcatttttgtattttttctttttttagtagagatggggtttctccaggttggtcaggctggtctcgaactcctgacctcaggagatccccccgccttagcctcccaaagtgctgggattacaggcgtgagccaccgtgcctggccataatcaccgttaatagtttattctagtcttatttgttgtacatatgtgtatatatgtgtgtatgcattgaatatagatgtgcatggtcttgttgggattatataaaaaagtctttttttttttttttttgagacagagttttgctgtgtcaaccgaggctggactgcagtggtgcaatcttggctcactgcagcctctgccacccaggttcaaacgattttcctgtctcagtctccctagaattataggcacactccaccagaatcttggctcactgcagcctctgcctcccaggttcaagtgattttcctgtctcagcctcccaagtagctagaactataggcacactccaccacacccagcttatttttgtatttttagtagagatgaggtttgcctcatctctgttcaaggcgtgagccaccacgactggccaatataaaaacatttttctaaagtactggactgataaggtattttattaagtgagtgagttttcttcctaaacgtttttgttctatctggtcttgtgactttatgtttataaaataggaaacaaaatgcgtacctctgttgttacaaaaattaccgcggcgtcttttatatttcacatgcagtttttcacatggtagaaatcgcacagtttcccaaaagctggcagggttgtgggaggaggcggctgtgccccattgcagtgacaccaggggacccttcccacggtgctgctctctgtgccgagggtctgagtgtcgctggatgactcggcgtttcctttctttcttagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcctaaacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggcactagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctcaaaaaaaaaaaaaaaaaaatctaagatagaggtttggtcaacagtgcttaataataaataagaacctcctgccattctaattttcctgctgcaccccatcccccacacacccctcacgaacattgatataagcagtattaacacagtataaagaatgttcaccttgcatatgtcatttcaggcacatggattcaggagaagcacagttgagtggaagaaatggtagacttgtgaggcttgccccaggccttgtgtacacgcaataagtggtgagccatgggtctctccgtcagcgcctccctccccgccaccacttcaggccaacaatttaaggtgctgagttgtaaggctcctccattgtcagtacagggctcgcctttgtagccctgatcactaccagtacacttttcaagacaactgagtatttttgtatgcctttgccttccctttgtccatgaaacatgaagagttgtttatggttcttgacttctctgagcagagtgtctgcatctcttggagagttacacatttcttcatgagccatttttctcattcttagatgcacctgtttttatcctttgcagaccatcttctgccttcttattttcctgtctgtcaaagacagaaattacaggagatagggagggttttttagcatctctttcaaaagatgtatgtcagaatttcctttgcacaccaagaactggagcttagagccccactattctctaagccaggttctagtgccttacactccagaatgtcagatggtgggtgcagattggaagaaagagaaaagttcatctcggtgtgtgggttcccatccgccccacatagcctctccttcttcggaacaatgggcgtggggtagaaagctctttcagtgaagggtgttctagcagctcagttaacactttactctccagtcaacacttgggacatataaaaatgccattgtaactactgtagagtcctgtgactcatcgtttgtgtttgtcaatttgcagttcagcttagcccttccctgttcctgtgtagttacaatctggccctgaagacatccgaggcacttcagtaagtgggatcttttctagagatcctgggtgactttgggtgcacagggtgaccgagcatttctgcccctgtgaatgtggcactaacactgtgcactgtctccaccaagcaaggtttccactgagtttcttctcatgttactgggtttgtaaatgaataaacacattttaactactcttgcacggctgcttgtgaaatgttcttcatctgtagtgacttaaatgtgtttgccaccacaaagcataaacagcgtgcagaggagagtgtgtacctccctgtgtgtaccagtgtgagggaggatttggggacgggggtagagaagatgtaggtgtttatcttaccctccctgcagcgctggagtggctgggggtaaaagcttcccgcctcctgaaattccgaccggccttctgcctacagctgacctcaggaggaacctgccacctgatgttccacacgggcacgtgtgcactcaggtttgtgtggaaagcaaggggggtcgtgttctcaccctgtggaaacaaccctgagagaaacaaccagtgctctttttctacaccagcttccatccacaagttggtccctggacttgacctgttcactaatttttttttttgaggcagagtcttgctcttttgcccaggctggagtacagtggtgtgatcttggcttactgcaacctccactcccaggttcaagtgatttcctgccttagcctccagagtagctgggattacaggcacgcgccaccatgcccagctaatttttgtattttcgtagagacggggtttcgccaggttggccaggctggtctcaaacccccaacctcaagtgatccacccaccttggcctcccaaagtgctgggattacaggcgtgagccactgtgcctggcccaaagtaatttttgagtagtttttttttttttaagtatttgtacttttgagaatctcataggttaacatgtttacaacaatctcttcatcttgtcttctaaatcagccccttctattccagttccaggaatagtcaaccacgccagaaacctgggactcacctggtctccccactcgcctctccctacacctcccgctcattacccagcctcacagggctgtctcctcagtgcctctcctctgttcggacctcactgtccccaccactgctgctgtggcagagagggttgtcagccctgacttcgagaacaatctcttactgattttcctgcttctcatgtcatcccccctccctctgcagggttgtctttgtaaaacaggggaggtcaatttactcactgccttgaaaccctcaagggactcccctttgtcgtgagacaaagctctcagtccttagcctggccagccagggtctccagggtgtggcaggccacgctgccccagggctccggcctgcgctgcgtgtgatgtgggtcctgcagccgagtgcgtgctcgccatccacagctggatctcacctcgaatcctgctttccagtcacactgagaggtctcccactcccatatttgctcactaaaatgcctcctggcagccctcccctgtgcttgtggaaagtcgcaaattgaggatcacatggacccccactcccccaagttgtcctgacagagacctcctgtctttcatttgattgattgattgagacggagttttgttcttcttgcttaggctgctggagtgcagtggcgagatctcggctcaccacaacctccgcctcccaggttcaagcaattctgcctcagcctcctgagtagctgggataacaggcatgcgccaccatgcctggctaattttgtatttttagtagagacgaggtttcactatggtggtcattggtcaggctggtctcgaactcctgacctcaggtgatcaacccacctcagcctcccaaagtgctgggattacaggtgtgagccacagtgcctggcccctcctgtctttcaaaagctctgcccaagaccaccatcatcccacagtggagcctttccttccccaagagaatggcccctttggggtcctcacacacccgtttctgatgtgtctttatttggttatctgccctgctccttctgtaagtccctcggagaaagactcgaattctcccaaactccaacacctcacatggtgtttggtgtttaacagatgattaaatgaatgggcaaaaagtggagggcaaaatctttaaaatgtcttttaagatttaaggattttaggccaggtgcggtggctcacacctgtaatcccagcactttggaatgccgaggcgggcggatcacctgaggttgggaattcgagaccagcctgaccaacatggagaaaccttgtctctactaaaaatacaaaattaggcgtggtagcgcatgcctataatcccagcttcgcgggaggctgaggcaggacaatcgcttgaactcaggaggtggaggttgcagtgagccgagatcacgccattgcactccagcctgggcaacaagagcgaaactctgtctcaaaaagaaaaaaagatttaaggattttaaatgtttgatttttttttcttgttgagatagagtcttgctttgtcgccaggctggagtgtagtggcgtgatctcggctcactgcaacctctgactccctggttcaagggattctcccacctcagcctcccgagtagctgggattacaggcacacgccaccacgcccagctaattttttgtatttttagtagataccgggtttcaccatgttgaccagcatggtctcgatctcctgaccttatgatctgcccacctcagcctcccaaagtgctgggattacaggcgtgagccaccgcgcccggcctgaaaatttttaaatgattgtttgccgactttacaacaggacgatgttgttgttcgcaggccagtaggtggcgctgtggcacgtgatctgagcctcctggattcacacaactgttcatgtggagaacccagtgccgggacccattagcaccccagtcaggctatgcgtctccctcccaagggtgctcacctggtgtggccttcatggcacagggggagtgagatgaggctcctttagtacaccctcccctgagaagagcgacgtgtgcttaccctccagtggcttgttctcatgaaaggctccacagttagggaccttcagatgcttagatctggggtgtcacctgactcaagcagctcagaatcccagattgttgtggtgggtcaagggcatggggctttgggtttactggcctgggtctgaatgccagcattgcctcttccttggtgtataggaccttgggtggttacttttcctaggcctctgtttacttgttttaaaatggacagtgatgcctactttatagggttgttatgaaactcaactaatgaatataaaatactcgacccagactggcatggtggttcacgcctgtaatcccaacactgggaggccaaggtgggaggatctcttgagcccaggagttcaagaccagcctgggcaacttagggagaccccgtctctaccaaaaataaaaaaattagccaggtatagtggtgtgtgcctgtagtactagctacccgggaggcagaggtgaaaggatcgcttcagcccagaagttcaagactgcaatgagccgtgatcatgccaccgcactccagcctgggtgacagatcaaggccctgtctcaaaaaataaattaacaggtcgggcgcagtggctcacgcctgtaatcccagcactttgggaggctgaggcaggaggatcgcttgagcccaggagttcaagacaagcctgggcaacttagggagaccccgtctctaccaaaaataaaaaaattagccaggtagagtggtacgtgcctatagttccagttacccgggaggctgaggtgaaaggatcgcttcagcccagaagttcaagactgcaatgagccctgatcgcgccactgcactccagcctgggtgacagatcaaggccctgtctcaaaaaataattaattaaatacttgacccattgcacgatctttccatgcacgacagctgctcttctattattcttccaggatgagctgcacagcctgcccccttgggtttccaggttgtgggagatgagcaaaactgaatgacctcagtaggccaagagcaaaggatgtgggtccggacctggtggccagttgcttgtgacaggagctgggctggagtccccaagtgccactagtgctgacatcttttaactgtgttcattgtgacttgtttatttctaaaagtaaccactggcgccttggtgcagatggaactccaggtgcatgcggtgagttaaccatggtctggggagctttgtttccacgcctaggacatgcatctgtgtgcatgatatgtgagctgatatagccatgcctctggtgatttgaacgcctgcgcttcccagctgcttcagggccctgaacatcgctggatgtttgtacttcattccctcctcagcccagctggtcccactccgcagctgtgctctaggcatttcatctcaactgggtgatatatttgaatacagcaattataagaacagcaacctcagaagaacatctggcatccagacctccccagcctagttccacaaggtaccaacttccgtaagccttgaagagctaagtaagacatccgggccgggtgcggtggctaatgcctgtaatcccagcactttggaaggccaaggcgggcagatcacttgaggtcaggagttcaaaaccagtctggccaacatggtgaaacgccatctctactaaaaatacaaaaattagccgggtgtggtagtgcatatctataatcccagctacttgagaggctgaaggaggagaatctcttgaacccgggaggcagaggttgcagtgagccaaggccacaccactgcactccagcctgggcaacagatcccttggtatagatacggggagcttgggtggtctcatcacagcagaacctcagctcttggcatgttctttcctttgctaccagcttttgaaactgaagtgtagcagagtcatgaaccagactttgaaacatgaaccagacagagaaacattttaagaagtagcggctgaccaggagttggagattgcagtgcactatgattgcacctatgaatagccactgcactccagcctgggcaacatagtgagacccctatctaaaaaaaaagaaaaagaagggccaggcacggtggctcatgattgtaatcccagcactttgggaggccaaggcaggtggatcacaaggtcagatcaagaccatcctggctcacacagtgaaaccccttctctactaaagatacaaaaaattagcctggtgtggtggtgggcgcctgtagtcccggctactcgggaagctgaggcaggagaatggtgtaaacccgggaggcggagccgggcgcggtggctcacaactgtaatgccagcgctttgggaggccaaggcaggaggatcgcttgagcccaggagttttagaccagcctagacaacatggcaagaccccgtctctaccaaaaatacaaaaaattagccgggcatggtggtgcatgcccatagtcccaactacctgggacgctgaggtgggaggatcacctgaaccccggagccgtgagcacaccactgtactccagcctgggtgacagagtgagaccctgtctggaaaaaaaaaaaaagtagctgggtatggtggcacgtgcctatcgtcctacctgctcaggaggctgaggcatgaggatggcttgagcccaggaattcgaggctactcagcaattatggtaccactgcactccagcctgggtgacaaagtgagaccctcaaataaaacaaaataaattggccataaatgtaagagttttttcctgtattgttcattctgttccttgatctatatgtcttgtcctttttccatatcttatagatgtgattactagaagtttcatagcaagttttgaaatcaggtagtatacattctccagttttattctttttcaaatgtgttttggttattctaattcctttgcgtttccatgcaaattttaagatccagttttcaaattttttttgagatggatcttgctatattgcccaggctggtctcaaactccagggctcaagggatcctcttgcctcagtctcccaaatagctgggattacaggcacatgccaccaaacctggcctctcaattgctttaaaatacaacaacaacaaaaatcttttggaagtttgatgggcattgcattgaattaatagacaaatttggggagaattaccatctatcttaacaatattgagtcttcccctggccaacatggtgaaatctgtctctactaaaaatacaaaaactggccaggtgcagtggctcatgcctgtaatttcagcactttgggaggccaaggtgggtggctcacttgaggtcaggagttcaagacctgcctggccaacatggtgaaaccatgtctctactaaaaatacaaaaattagccgggtgtggtggcgggcgcctgtgatccaagctacttgggaggctgaggcaggagaatcacttaaaccgaaggggtggaagttgcagtgagcccagatcgcgccactgaactccagcctcagtgacagagtgagactctgtctcaaaaaaaaaaaaaaaaaaagaaaagaaaaaaaaagaaattagctggacatggtggcaggtgcttgtaatctcagctacatgggaggctgaggcaggagaatcacttgaacccaggaggcggaggttgcagtaggaagagatcacgccactgcactccagcctggacgacagagcaagactcagtctcaaaaaacaaacaataaaacaatattgagtcttctattccatgaaggtgaaatgtctatgcatttttttagatctttagtttctctcagcaatgttgttttacagttttatgtgtatggattttcttttttttttttttttttttgagaatgagtcactctgtcgcctagtctggagtgcagtggctcaatctcggctcactgtaacctccgcctcccgggttcaagcaattctcctgcctcagcctcctgagtagagtagctgggattacagttgcccaccaccacgcctggctaattttttgtatttttagtagagatgaggtttcaccatgttggccaggctggtcttgaactcctgacctcaagcaatccatctgcctcggtctcggaaagtgctgggattacagatgtcagccactgtgcctggccatgtgtggaactgtttcctcaatttcattttcagattgtttattgccaatgtgtagaaatgcagtggattttggtatgttaattttgtattctgagacctttattctagtagggtttttttttttttatacattcctttggattttctacagtagaattatgtcatctgcaaatgaagatagttttacttctttcttttcagtgtggatgcctttaatgtctttttcttaacttattgcacaaattgcgcattcaatagtacaatgtttagtgggaccggtgagaaaagacatccttgccttgttttgatcttagggaggaaagtctttggtctcactgttaagtgtgatattagctgtacgttttgcgtaagggctgtattcgtttgctaggactgccatacaaggtaccacacactgggtggcttaaaaaacagaatgtattttctcagagttctggaggcataaaggccaggatcaaggtgccggggggttggttccctctgaggacctctctccttggcttgtctacagccgccttctccctatgtcttcacaggatcttccctctgtgtgtctcttcttataatgaggccagtcagactggatcaggacccaccccagtgacctcatttaactttaattacctctttaaagaccctatctctaaatacagtgacacggaggtaatggaggtaggacttcaacatactaatttggggctggttgtggtggctcacgcctataatcccagcagatgacttgagctttgagaccagcctgggcaacatggggaaggcccatctctactaaaaatacaaaaattacctggcatggtggcgcacacccacagtccagctactcaggagcttgaggtaggaggatggcttgagcctgggatgtggaggtcaaagccccaggagcagaggtcacagtgaaccaaaattgtgccactgcattccagctgggcaacagagccagacttcgtctcaagaaaaatttaaaaatcaaatagacatgatttttttttagacagagtctcattctgttgcccagcctggagtgcagtggtgtgatctcagctcactgcaacctctgtctcctgggctcaagtgattctcatgcctcagcctcccaagtagctgggattacaggtgtgtgccaccatacccagctaatttttgtatttttagtagagacgggattttgccatgttggccaggctggtctcaaactcctgacctcaggtgatccgcccacctcagcctcccaaagtgctggtactacaggcatgagccactgcacctggcctaatttttttttttttcttgagacagaatcttggtctgttacccaggctggtgtgtagtggcacgattacagctcactgcagccttgacctccctggctcaggctatcctcccacctcagcctcccaggtaggtgggactatggacacgtgctaccacgcccagctaattttttgtattttttttagagacggggtttcaccatgctgcccaggcaggtctcaaactcctgagatcaagcagtccacccagcttggcctcccaaagtgctgggattataggtgtgagtgagctactacgcctggcctggacatgtaatttttaaaagaaaatgtggccacaactctcctagagttaaatgttttttttgtttgtttgtttgtttgttttttgagaccatcaacaagatttcaaggctttaaagaaaggagctgcttcaggaagagataaaatgactcaaacgctataaccttcaaatgtagactgggagaagaggtatcagctatgcatgagctggagaggggtgggatagatagagacacaggtgataaagaaaatatagcaaaatgtgaatcctacaatctgggtggtggatgtaaaccctgtagtagcctcacctggggaaagctgccttgcaacaatgaggctgcccattctccaaacccaccccagccaccgagcaggctccactaaaaagtctgaacccaggagggagtaccatggaaaccaagttgcaatgccctggttaggggcccagcagaggggtcatcccagctctacgccattggatactgagtttcaggagtgggagtgccatcctcagggtcacacagcgtgtcggttccagcctaggtcttccagtgtctcattaatcttttatccactcagcttctcttctggcccatgaaccttgctctcctgggactcttttttttttttttgaggggtcgggggtgggacagagtctcgctctgttgcccaggatggagtgcagtggtgccatcttgcttcactgcaacctccgcctcccagattcaagcaattctcctgcctcagcctaccgagtagctgggactacaggcacccaccaccctgcccagataatttttgtatttttagtagagacaggatttcaccatgttggccaggctggtctcgagctcctgacctcaagtgatccgcctgccttggcctcccaaagttctgggattacaggcgtgagccatcacacccggcctgggactcttcttgcagtgagccagggccatgggacccttcaaaagttgctccaccctaatccccaaaatatctttttctcccgcctgtcccaagtgcctggcatcatactatatgggtcaactggccatgtttgccatggaagcccaattgtaggaagtgggtcttttatcacccggcatagcagagctgtggaaactgcactgggaaagatcaggatgtgaattaaagcgttgggaatgggaaggcagagaccttggattagctgggatgctccatgcactcgctgagtgaccttggacaagccccttagacacactaagcccgtttcctcatctacacgacgggcatcccatctgctactgcaccaggttcttgtggcaataacttgaactcacacatgcaaacaggctttgtgagctccataaacacaggtggctcggccaggtgtggtggctcatgcctgcaaccccagcactttgggaggccaaggtgggaagatcccttgagcccaggagttggagaccagcctgggcaagacgatgaaatcctgtctctaccaaaaaaaataataataattagccaggcatggtggcacacacctggtcccagctccttgggaggctgaggtgggaggatcacttgggcccaagaggtcaaggctgcagtgagctgagattataacactccaacctgagtggcagagtgaaactgtctaaaaaataaaaataaaaatacatcaaaaaacaggtagctattaagcattgctaggacccacacgcagtgaccctgagggtgctgggtttctgtttgagggagaagaaactcctgagcccctaggtattgtgggggacatgcagttccagaccgccttcatggcctgtatgcctggcctcatccccatccctggcacccatgacgatagccacattccactggtgtttccccaggaaagccaaccctacctgcatctcagcagagcttccacggagttggaaccccgctccgagagggtgtgggctcaggggccaggggtcacacaaactccagaaggaggacgtagttggtttgcaaggctgtcctttgccctggttgaataacctttggtcttccccgagaggaacgtgggcattaggctgcagcccacaggaagctatgtattttctgagaaacttggcccatggtgcagatctgctccagctcactctggtgggatcacgccagccacggccgggccacggcacatcatggcaacgtgctgcccacctgctacgccacctgtttttctagaggcggacgtgatcccagcaggactggagtcagcccagggcatcacgtgctctggtccccgcctgctttgactcctcctgcctcactccccccctggcctgtagtcacgttggtgagggtggtgggcaccggggctgggcccagcccccgaccctgcccagacagactttcctaaggcacccttttcctcgtgcaggtgcggcctcagcccacccccctttgagcccacagattgcacccctctggtgtgcggttacctcttgcctatgtttaattcatggctggggggttgggacgagcttcccaagaaaggaaagaactcccctggggtcttgcccagtttctgctcaccagaaggaccatagccgaggtcctcctcccagggcccggggctggggagcggaagccatcagtgggctcggaggacactgtcccagccaggacacggccatcggtcactaatctgcagcactggaatgtccgcaggccaatcagcggggtctctgggggctccccaagggtgctaataatcccacaatgattagcaggggccgcgggtcagtgcacgccactctgcctgctgtcgggggcgggctggccaggccgaggccggagcaggcaggcatcccccggagttgtctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggaggtaagggacacctggtgaggaggtaggtggaggcaccattatgagctctgaggagtgggtgctaggagacttctggaagcccggtcccaggcctgagccccaggccgtgcgggtggtttaatgaggaagccctgggacagcccgggggcggtgaggggtggatgctggactggggaggaaggaggaggaaggaggaccagggctggggtcaaggaggaacgccgaggagcgctgtggctggggcctggagaaatccgtggcccggaggagccccagacaggggcctgcgggagccagggctggcccctacacccagcccgcaccgctgttccctcccgccaccccaaccccagcactcagcccacgcctgctgtacctggtctctctctcagcctcgctccattgctatgccccacgtcccctgcacccaccacactcctctcccatcttgttttccaagggcagggacacatgcttattctgccgtgtgttgggttcaggtccccccatcctcgggctgcctgaccttctctctccaccccagccctgaacaggaaggagagtttcttgctcctctccctgcacaaccgcctgcgcagctgggtccagccccctgcggctgacatgcggaggctggtgagtacccgacccagctgggctctgccaggggggtggccggaggcgcggaccccagagggcggctcaggaggccacgcctgtccaggtgcccttccacttgaccagggtgggcaggcacagccagccaccttgcccctgagggacggaggccctggttgctgggggtctctgcagtttcttaaccccccaccctcagttcaggaggtcgggccccttggctcccactcgcctgaagggcaggaccttgggccttccctggcatcttgttgccacagagaccaggagccacaggaggagccggatcccctcctccagggaaggggagcttcacgaggagccctgcaggatgggcggccgggccagggagggagaaggtcgtgctgggctggggaggggcttctgtgcggcaaggacccagcgcctcctcctgagcttatctgagccacgaggacgggccttgcccatgttctctgctcactcactcgtccacattttccacattttcagcaggggccgggggtcgggggtatagagttccccaccagcccggctggggctgcggggttgggactgtcatctggaggctcagaaacgctgccctccattgtctgggaccccagcagccccagcccatgttagcaggccagggagccagggcagggtggtgggggcgggagggttccccatggctgcttcccatgaactcctccaaggcaggtggccacagtggcgaccttgagcactctagggtcagtttcccaggaggtgggggtggggtggctaaatgcggggggtcgcttctcccccattcccagccctgagtggctctgcctctcctcaggctcagaccctgggcaaccaggggtgctcccagctgtgacctccgtggttgggtactcctgcctgggaccccaggaggggctgcggtggtcgttggctggcagctggcaccctttccagggcccttttgtcaaagtcttagaaaacttcatttccataaaggtgcaaatggagctccatggctcagcctccctcgtggcccggccccgagcaccctccgggcctctagggctccagggcaccccttctttggacacagtggagactgaaggtcttgtgggggtggagggctgctgagggaccccggggagcccccagctcctggccccagccttcatcagaggtaaaaccccgatggacattagtgcaggatgaagttggcttggggtgcagccccgaggggcccccctccctgcatccactcagtgcttgtgagtcctatcctgcaggcacctccctgctccgtttacagatgagctcagggagtctcgggagatcaggggactgcaccaagtcacccaggggtggtgattgccaggcccacttgtttaagaagagggagggggctgggcacggtggctcacacctgtaatcccagcactctgggaggctgacacaagcagatcacctaaggtcagcagtttgagaccagcaatggccaacatggtgaaaccccgtctctactaaaaatacaaaaattagccaggtgtggtgtcacatggctgtaatcccagctgcttgggaggctgaggcaggagaattgcttgaacctgggaggcggaggttgcagtaagccgggatttctccactgcactccagcctgggcgacagggtgagactctgtctcaaaaaaaaaaagaagagggagggggcggggtcagctgtgcgtggtggggagcatatgaggccaggctcctgggggcaggagactagggcagagaggcgtggctgtagggctttttgcatcacaggagggcagcatggccgggtgggagcagtggagcctttctgacaatggccagggcccaaacacagaaccagtctgcaacgcgtgggcactgctcacatgaccagatgggagaaagacagcaggagcgggtcccactgcctgggcagggccgaaggatgcccacgacaggatttggagatggaggctcagtcgtgagaggagctgggctcctcctggagggacatcagacaacaccagtgcttcctccagcaggactcctcatccagtgctctctttgccacctgacctggcacccggtggatgctcagagatggcaggggagttgaatctttgaggcctggcccagcagtcaaaggcctcccacagatgtctgtttgtgctgcccccaggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcaggtgagtgtgctgcaggtgaggccagcgtgccagctcccagatacagacttccactggtccatctcagaagaggctacagtttgtcctaaatgttgggattccttttcctccaattggtttagttttactttttttttttttgatacggagtcttgctgtgttgcgcaggctagagtgcagtggcgtgatctcggctcactgcaacctccgcctcctggactcaagtgattcttgtacttcagcctcctgactagctgggactacaggcatgtgccaccaggcctggctaatggctttatacttttagtagagatagggttttaccatgttggccaggttggtcttgaactcctggcctcaagtgatccacccacctcagcctcccaaagtgctgggattacaggcgtgagccactgtgccccgccacattttttctttttttggagacatggtctcagtctgtcaccccaggctggagtgcagtggcgtgatctcagcttactgcaacctccgtctcctagattcaagcgattcttgtgcctcagcctcacaagtagctgggattacaggtgtgcgcctctacacccagctcatttttttgtatttttagtagagacagggtttcaccatgttggccaggctggtctcgaactcctgacctcaaatgatctgcctgcctcagcctcccaaagtgctggggttacaggcgtgagccaccatgcctggcctaagccactttttttcaatctgaaatataaataatttcaaacataaacgtatttatttatttatttgagacgaagtcttgttctgtcacccaggatggagtgcaatggcttgatctcggttcactagaacctctgcctcccagattcaggtgactgtcctgcctcagcctcccaagtagctaggactacaggcacgagccaccacaccccactaatttttgtatttttagtagagatagggtttcaccatgttggccaggctgggtctcaaactcctgacctcaagtgatccacctgcgtgggcctcccaaagtgctgggattacacgtgtgagacaccgcacccagcctcaaacgtaaatttaaaacggccccactcttacccactacctaggtttagaagatgctactaaactaaagccctgctcctccccttttcccgctgtccctccctggagggaatcttcccaaagttcaggagcatcactgccaagcaagtttccattttttctcttcattcaacaaatatttgttgagggtcttctacacacacctggtgctcttcagatgcactgaaaaacacaagcaaaatcccaggaaatatttaatacctccactacctgtgcaagtgggttgtgcatgtttaaatattacacaaggctgggtgcggtggctcacgcccgtaatcccagcactttgggaggccaaggtggcaggattgcctgagcccgggagttcgagaccagcctgggccacatggaaaaaacctgcctctacaaaaaaatacataaattacccaggtgtgatggtgtgcgcctgtagttccagctacttgggaggctgaggtaggagaattgctggagcctgggaggtgaagattgcagtgagctgagactgcgccattgcactccagcctgggcagcaggagtaaaaccctggcttagtaaaaagaagaacatgtgcccctacaactaggtgctgccaaagtgcttacgccaactgtgcagaccagcaaaccagttcccacttcccgaagatcttctggctccttaatttttttttttttttttgagacggagtcttgctctgtcgcgcaggctactgtgcagtggcgcgatctcggctcactgcaagctccgcctcctgggttcacaccattctcctgcctcagcctccctagtagctgggactgcaggcacacgccaccacacccggttatttttttgtattttgtttagtagagacagggtttcaccgtattagccagggtggtcttgatctcctgacctcatgatccgcctgcctcggcctcccagagtgctgggattacaggtgtgagccactgtgcccagccttggctccttaagttttgtcagactcaaaggtgtgaaaaacctaactctgttttgttgttggtggttgttttttgtttgttttgtttttgtttttgttttttcgattcagagtcttgctctgttgcccaggccagagtgcagtggtgcgatcacagctcactacaacctccgcctccccagttcaagagattctcctgcgtcagcctcctgagtagctgggattacaggcgcctgccaccacacctggctaatttttgtatttttagtactcctgacgtcaggtaatccacctgcctcggcctcccaaactgttgggattacaggcttgagccaccacgcccagcctctattattgtttctaattttcttgatgtgaatgtttagatcattaattttaaatcattttttgtttctactatatacatttaaagctataaatttccctttaaacgatttcagctgcatccaataagttttgatgttttttctatttccaatcatgatgttgtttttgtttgttttgagacatggtctggctctgtcgcccaggctggagtgcagtggtgcaatctcagctcactgcagcctcaatttcctgggctcaggtgatcttctcacctcaggtccggagtagctgggactacaggtgtgtgccaccatgcctggctaattttttgtatttgtaatagagatggggttttgccatgttggccaggctgatcttgaacttctgaactcacatgatccacccaactcagcctcccaaagtgctgggattacagatgtgaaccaccacacctggccatgatgttgttttagattttgaagtgtatctttaagtttctaaactatgttatcttctctatttacttgtaaattatttactttaaatttcattgcattgaattcatagaatgtgggctgtaggatgtgctgattctttgctatttgttgaaacttgcttagtggtctaatgtatggtcctcctttctggtttgcaaaagtcccatgcattcctaaaaacgatacatattctttaagtgttggatacatgtatatgatcacatgttcacatctgcctgctacaagccagtcttgtacatgtcatttttagtctctactggagagtttgtttcactcttcttatatattgcccatttgtgctatttccaagctgttgctgattctaagactttaaactggtttgcagacctgtatccattaggttttattgcatgacatactaccccaaaatttagcagcttacgattctgcaggtcagccacttgggttgggctcagcagggaggttttctggtcttggctgggcccactcatacacctgcaatcaactagggggccggctgggagctggctgtgcaaaaaggcctctaatggttcatctctgttccatgaggccttccaaactcctatactgagtttgttcatgtggtgactgagcatggttctatgagaatgagtggaaatggcaaggtctcttaaggcctaggttcaaaatcggctcagtatcacttctgtggcattctggtggccaaaccagttacagagccagccagattcaaggagcaaggaaagagacacctctctttgctgcaaaaagctgcagagtcacatttaaaggagtggcctggtgcaagaaatgaatggttgtggtcaccatgcagtcacaaggcccttgatgttccagtctttttttggctactcccctccacccatcaacaatctcccctcatttcaggtacctcccctctccatccccctctcaactaagaaagccttcctaggccgggcacggtggctcacacctataatcccagcactttgggaggccgaggcaagcagttcacctgaggttgggagttcaagaccagcctgaccaacatggagaagccctgtcgctactaaaaatacaaaaaaattaaccgggcctgtaatcctagctactcgggaggctgaggcaggagaatcacatgaacccaggaggtagaggttgtggtgagccaagatcaggccattgcactccagcctgggcaacaagagcaaaactccatctcaaaaataaataaataaataaataaataaataaataaataagccttcctgaactattcccacccatgcttctacccctgcccaggacagctgctgctcctgagccctcgaggaggtaagggagccctctgttcacctggatgatagcgaaagctgtgtccccctccccaggggtggttcacaatagggtttctgatcccctgtgtctcctgtagctcgtgtgggccacctcaagccagctgggctgtgggcggcacctgtgctctgcaggccaggcagcgatagaagcctttgtctgtgcctactcccccaggtaagccctgctacaccctctgctgggatgtctgggagacagggaggggtgctttcaccgagggtgagattcccacacatccacccgaaagtagagtccctgatgccttgctctgcacccttggtgggagaggggaggagaggaaaggcagagggtgctaaagattctggccacgcagaaggtgctgctctgcggatgtcccttcctggatactggtcctggtatcagggagtttgtccaggattggtttggaggccatctcttctctcccagggaatctccctatctcacccagctccctgactccctggcctggccgcaggagctgaaggggccaggggggcaggcagcagggccctgcctctgccttgcccaaggccaggccctcccacaccctgtggtgcctgctcgtcctcacagaggcaactgggaggtcaacgggaagacaatcgtcccctataagaagggtgcctggtgttcgctctgcacagccagtgtctcaggctgcttcaaagcctgggaccatgcaggggggctctgtggtgagtgcatgagggctcagtctggtgaccctggggtgggggtggtagcatcctactgggctgtcccagaagccctggcccttagcacccagggaggctcctgcccggcctgctgggaggagacccttttctcagagtcccctcctcctctgaccagaggtccccaggaatccttgtcgcatgagctgccagaaccatggacgtctcaacatcagcacctgccactgccactgtccccctggctacacgggcagatactgccaaggtgagggcactggagcctgggtgtgcccagccctgctctcgtggcaggtcctagggctgctacacttcctgagagtctcaagggtgtcagaggtgctgactgtgtactccctgagtctgcccactgcatacattctttcaacaagcattcactgagcactagctgtttgccagaccctgagctgtgcaggagattcaaagtgaaatcaggttcagccccttaggctctgggaggaggacagaattaggacccagaagtggattcttgccctactgcccctctaccctaacccactctgtgaccatgggcaggtcacctcccaaactccaatatgcctcactctgcaatggggaccaaaccaaagacaccaggcgtgccagcaatcggaagccttggtgggttctgtctatgggaggggtattcttgctgtggttggcattccctggatgttcgaggcctctggggggcagcgtggggtccagaaggctgggggctgagcctctgccccactgccctgccctggcagtgaggtgcagcctgcagtgtgtgcacggccggttccgggaggaggagtgctcgtgcgtctgtgacatcggctacgggggagcccagtgtgccagtgagtcctgccccagggcccccaaagagccagctcctctcaagaccccccttcaatggggcatcagctcccaggagcccgctgtgtgcctctctttccaactcattcagtgacaacacgttgagatcttgaaactggccacagcatggatatttacaccaaagaaattggcaaatgctataaaccatggatttttttttttcttttgagagagagcaagctcaatattccaacttaccagctcgctcctgaccctcaccacccactcttttggagcaggtggccagaggaaggggcaccctgagcttagctccccggcagggcaggaaagggcagggattctgaagtccacacacaaactcaggctcccctaccccagccaaggtgcattttcccttccacacctgtgacctgaggatcgacggagactgcttcatggtgtcttcagaggcagacacctattacagagccaggatgaaatgtcaggtgacagtcacccctagcttcctaggaaccccctagggcctcaagtgagggtcttaatgcagggaccctggagtgagaggtggttccttccacgtctctgacctcaccctattcatcagcataaagcaggggtcgtggactccaaggctcatagaagccaggaggtcacttattgacctgaggggccaaggtcaagaccaacctccatctaagggagttccagccactggttgccttgcaggaatgcaaggtcagggtggccagagctcggggttgttcaagaaaaccagcaacccagacttccactggcaactctcgaaaccacaattaattactggggttggcaatcaacttggatatatttaagacactgtgcaggtgaaacagaacctcctcaggggccagaccttgcctgggcttgtgggctgctggtcgcgcccccgtgcacagggagaagagaagcagacgggagcagaagggacccctgctcttggaagggaggctgtgcgggctgggggtgatgatagcccggccagcacacacacgtggcatcttaggccatgggcaggggtggcaggaaggggcagcctgggctctgggagccttgcctgtgtgacccagggtggggttacagaggaaaggcggggtgctggcccagatcaagagccagaaagtgcaggacatcctcgccttctatctgggccgcctggagaccaccaacgaggtgattgacagtgacttcgagaccaggaacttctggatcggtgagtgcccagctgattgggggtatggcgagtaaggggttgtgatgccccaccctgctgcaggaaccctgggccatggcggctgccagcagatggcaagggtgtgttgagggcctggagcccagagcggggccagctgctcaccccctttcccgggaagggcccaggtagggagcacatgggggctgccagcgctgggaagaggggccagaaaggcagctggcagcagactccagggtctgagtgggccaaccttgactaccccggcccagggctcacctacaagaccgccaaggactccttccgctgggccacaggggagcaccaggccttcaccagttttgcctttgggcagcctgacaaccacgggtaagtgtggggtgcctccctcccctgggcctccttctcacttgggcctgcctggtggagccccccatcccgctgcctggctgggccctttgagggtctgatccttccctggtgcctgcccaggtgccagagagttgtgggcacagctggtgtgggccggtggtggggtgagggagatgcaagccggaaggcacgtcacgtgggggagagagggacccaggaagcctccatccatctgtccatccccagtgtcccctggtgtgactccatccctccaattctcatccactcacccctccgtctgcatgccctctgcctgcatcagttacactgatgccagcattccttagctgtcacccacctgcactcattcacaatacaaccctgcacctgcagacccaccagccatcctgtagcaagaaccctctggtcacgtggccccaccctgctcttcaaagcccagcaatgcccagggccagggtggaggtggtccggctgcgaggccaccaagggctccagcgatttcagccagccctccttgccaacagccggcctgtgcccctggcctcttgcctggaggaagtctgggccttgttgggttcccaggtgtacctctcaagtgggctgtctattccagtccccaccatccccacaggctggtgtggctgagtgctgccatggggtaggcagagctgttaccccaggaaggggcttccctgagaagtggagcagggctgggggcttggggacgggcctggctcccggcagccccgtcggcaggtgggggcactggagcccctgagatgcagggtcctgatgggtggagggcttaggcctctcccggatccctgacttcactcttgcctcctgaccaccacaccatggcctgcaggtttggcaactgcgtggagctgcaggcttcagctgccttcaactggaacaaccagcgctgcaaaacccgaaaccgttacatctgccagtttggtgagggacttcctgaggctccccttctctgatctctgaccctgggggtgctgctgacccggtccagcctgcaagggtatctaggtggcaggttcagagtgggtctgggcacacggggccatagaggatgccctgttgatggccttgtacctgtgggctcctgagcccagaggggcaacgacgggcccagcttcatacagcaaggccacgcaggaaggactagagctacagctctgcaggggatttctccaaggaccctctcctgtcatgaaagctgctgcctgggaacctgttgggttccttggtgttcccgggagccccatgaactgtggtggaggcggaggtgaaacctagcatggcaccagctcccagcagcctctgctaggaaggcctggagcgccacagggaccacggccatgggcacttccagaccgagtgcaacagggctgccatcttgggactgcctgggctgccatcgagccctgctctcttctgcttccttccagcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggggcagttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcagacatcacccacaaggggttatcactgtcccagtttacagcggaagaaatgaaggcagagagattgagtaacttgcataagatcatacagctgggagtcaaacccagtgagtctggctgtcatttatttattttttttcttttcttttcttttttttttttttttttttttttttgagacggagtctcgctctgtcgcccaggctggagtgcagtggcacgatctccgctcactgcaaactccgcctcccaggttcacgccattgtcctgcctcagcctcccgagtagctgggactacagacgcccgccaccacgcccggctaatttgttttttgtatttttagtagagacggggtttcaccgtgttacccaggatggtatcgatctcccgacctcgtgatccacccgcctcggcctcccaaagtgctgggatgacaggcgtgagccaccgctcccggccctatttttttcttttttgagacagagtctcgctttgtcgtacaggctggagtgcaggggtgcaattggggttcactgcagcctcgaactcccaggctcaagcgatcctcctgcctcagccacccaagtagctggaaccacaggtccgcaccaccacgccccgctattttttgtgttttttgtagggacggggttgcaccatgttgctcaggctggtctcgaactcccgtgctcaagcgatccgccatcctgggcctcccaaagtgctggggttacaggcatgcggcccggcgccggcccagtctttccctctcccactgcttcccagggcttcgcctgtctaaccgggcgcgggcagttgtcctgtgtcctggctcagcgcggacctacgcggggtggtcacacagatgcccccagctctctctacctcccgcgaaggcgctgagccccctgatccctgcccgggcactggcgcaaggtcgcctgcgagcgccaggccttcctgcccggtgggagacgggagggcccgctctccggctcggtctggttcccgggtcagccagcagccgcgcctcttcctcccagacccgggacccgccccttggccggggccgcggccgcagcgcccggaggggccgccctgcgcatgcccgcgggaggtgggtgacccgggagcgcgctgcccgaggccggggggcggtggggacagcacaggcggggcggccgaaccgagaccttcccaccccgccccacgcctggttggggacctgacgcgccgtcgtgagtggggcgggtgcaggtgtccctgggggccgggggcagacactggtgcgggacgacctgctcccgagggggtccgcaggccacacccagagaaactggggcgcctccagtcaccgccgcggtccgccccgccggaggctttgaccccctgaatcagcgtcggggcagggatccgcgtggggtggaagaggctgggaaacttgggagtcccgggcctcctctggagccgcccgcccttggctggctggtccttctcttcctcggctcccgccgggctgggccctgggccgccctcactccctcccctctgcagcctcccttgcgtttgtcattcactctgccaggctctccttctgcctccgcatgcccaacgatccggagaaaaacacggaccatgacatcaaaaggccttggccaaggaatcgtgattattgtgatacaagattctgcacctcaaaggggatccctgtagtgagttttggaaaacgtacaaagcctgacttacaatatgcctgttatctgtggcgtttcatctggggaacttacttttccttgatagggtaaactattctcatccagagtatgtccctcagtctgtaaaagtccatggtgccctacatctattaggggagtgaggaagggcagtgggcattggatctgcttctttgaaagcccccacctgtgtttagcttctgttagaggcctttgaaccagagcaactccatcttgagtaggcgctgggtaaaatgaggctgagacctactgggctgtgttcccaggtggtggaggcattctaagtcacaggatgagatgagaggccggcacaagcagtaaagaagccgcggccaaaacccaccaaaaccaagatggtgatgcgaatgacctctggtcgtcctcactgctacactcccaccagcgccaagacagcttacaaatgccatggcaacgccagaatgttaccctatatggtctaaaaaggggaggcatgaataatccaccccttctttagcatataatcaataaataaccataaaaatgagcaaccagcagccctcggggctgctctatggagtagccattgttttatttctttactttttttttttttttgagagggagtcttgctcttgctcaggctggagtgcagtggcgtgatctcggctcactgcaatctccgtctcctgggttcaagcgattctcctgcctcagctttcgagtggctgggactacaggtgcccaccaccatgccggctttttttttttttgtacttttaatagagacggggtttcaccacgatggccagggtggtctcgaactcctgtcctcagatgatctgcctgccttggcctcccaaagtgctgggattatatgcgtgagccaccgcgcccagccctattcctttactttttttttttgaggtggagtctcacacctggcctccaatatgtttattcatattgctgaggcaggggattgcttgagcccaagagtttgaggttgcagtgaaccatgatcataagctgtatttcagcgtgagtgagagattgagaccttgtctcacaaaataaaagttaaaaagcccttatctggaggtgagaaagccaaatacaaaggtcttctcagttggttcccagtcttcccagtccagcagcctcagcatcaccagggagctggttaggcaaattctcggcggccccaacctactgaattggagaccctgaagatggggctatctgaattttaacaaggcctccaggtttgcatgctcaagattgagaaccactggcaaaagcaaacaatttgaatctgaagtcagcccacctgcatttgaatacaggccctgccacttaataactgtgatttagagcaagttagttacttaacagctaggttgaccaattgtccgagtttgcctggcactatcctgatttcagcactgaaagtactacattatcgctgtggctcacgcctataatcccagcttctcaagctgtccctgtggaatcctcaatatcggtacattcatccctatctagcatccccttcctccctcacccatcctgcaccctcagaattcattctcagatcagcttcccagatttttgccaatatcaattaaaaaaattttttagccaaccatgtactgtgagtaagccaatatcaattagcaaaatctttaagtttcttttggtgattcagtatcttccccctggagttttttgatgattcagtaccctcctagatttggcccctggggcctgcggggatgtgacttgtcatttaattctggagaaaatgaggggtagggcttataaggagactccttcggggcagggtcattacagggtgtgttacatagggaaatgctagctgctggctagctctcgctcttgaaaggctcttcctccctcaactgaaatggggaagggggaaccccggccgactgaggtcctgacatctttagcacatggcttcttaggtcacccagggcatccaggttaccagcttgggaaacaggagatgtaggttggaggaagaggctacagcccaccctggaaataactgccatccgtcccacccatatggttaggctttgtgtccccacccagatctcatctcgaattacaatccccacgggttgagggatggaccaggtggaggtacttgcatcctgggggcagtttcccccatgctgtgctcgtgacagtgagtgagttctcacgagatctgatggttttaaagcgtggcagttcctctttctcgtgcttacatcctcgtaactatcctgtggagaaggtgtctgctttcccctacctccatggttgtaagtttcctgaagcctccccagccgtgtggaactgtgagtcaattaaacttctttataagttacccagtctcggtgtttgcttttttgagatggagatttgctcttgttgcccaggttggagtgcaatggcgtgatctcggctctttgcaacctctgcctctcgggttgaagctattctcctgcctcagcctcccaagtagctgggattacaggcgtgaaccaccacacccagctagttttgtatttttagtagagagggggtttcattatgttggtcaggctggtctcgtgctccaagcctcaggtgatccgcccacctcggcctcccaaagtgctgggattacaggcatgagccaccgcacccaaccttggatgtttctttatagcagtgtagaaacagactcagccgtcgctgcaggccatacctcagctacatagaacacctaactgcccgcaagggagttcctgctactaggatcttcagagtgacaaagaggaagctttggctggcaagggtggtggggaggggaggggctaggtacctaaggcttccctatctttccacacagcctaattttcatagcctctggtctccacatttcactctttcccaaataaagaccttttaaggtgtgggtccccttggtcattctgtaaccattggatcaagttttcagttttttctgctctctcagctgcaaaataacacattcgagttttggtttttttttttttggagacaaagtctcactctgtcgcccaggctggagtgcagtggtgtgatctcagctcactgtaacctctgcctcctggatataagcgattctcctgcctcagcctcccaagtacctgggattacaggcacccgccaccacacctggctaatttctgtatttttagtagagacggggttttgccattttggccaggcacactcgggttttctaaccataccttgagccaagaatttggattctgagcttgtcttttcatttaagctatgtggcgctgttagcatgaccgccctgcccagcagatcttgacttcagtgtaatctttattctcttctatggcaggagccattaggtcccccaaagccttgcctttgatgggtactttgttcccggggacaatgggattagctgtcttgccagggcgtgccatggggctgctggtgtcctgtcccttaataccagctggattttcactgtcctctgaccactttccagccttcaattgctcctgtttcctttggggcttcttgctctgtccagtcctggtcctatttttgtgagaatcaaggttcttagttttaaccaacagaaactaattctggcaactctaaacagaaagggacttggtcagaggtcctggctagttcccaggagctcaaaagggtcagaaaatcaaatcaggaagaggacattgggcaaagctggccaggtgaagaccccacagcctctgctggcacagaagctacaattggcaccaccgaagtgggacagaagctgccacctgtgcaagctagatgtagtcgctgccgctgtcaccatcaatttttgagatgatgcttcttcctgcctgccactttaattcaaagcgaaggccaggtgcagtggctcatgcctgtaatgccagcactttgggaggccaaggcaagaggatcgcttgaggacgggagtttgagatcagcctgggcaacagggtgagaccccgtctagccaaaaaatacaaaaaaaaagagctgggcagaaagaaaatggctcatgcctgtaatcccagcacttcaggaggccgaggcgggtggatcacctgaggtcagaagtttgagattagcctggccaacacggtgaaacactgtctctactaaaaatacaaaaaattagtcaggttgggtggcgcacgcctgtaatcccagctactcaggagactgaggtaggagaatcgcttgaacccgggaggtggaggttgtagtgagctgagatctcaccattgcactccccgctgggtgacagagcaagactagtctcaaaaaaaaaaaaggggccacgtcgatggaaggacaagaataaagaaactgaggccgggtatggtggctcacgcctgtaattccagcactttgggagtccgaggtgggcggatcacctgaggtcgggagttcgagaccagcctgaccaacatggagaaaccctgtctctactaaagatacaaaaattagccaggcatggttgcgcatgcctgtaatcccagctattggcgaggctgaggcatgagaatcacttaaacctgggaggcggaggttgtggtgagccgagatcgtgccattgcactctagcctgggcaacaagagcggaactgtggctcaaaaaataaataaataaaaaatagagacattgggccaggcacagtggctcgtgcctgtaatcccagctctttggaagaatgaggtaggaggattgcttgagcccaggagttcgagggtgcagtgatcacgtcattaaactcccacttgggtgacagagtgaggagctgtctccccacccccatcccccaaaaaaagaaggtaactgggcaaagaagttatttttagtagagactggctttcatcatattggccaggctggtcttgaattcctgacctcaggtgatccacccacctcggccccccaaagcgctgggattacaggtgtgagccacggtgcccaacctcctcttctcatttaatcctcaaaatcatctcacaaagcaggtgctattaatacccgcgtcttacagaacggttaacagatgtgtccagggccgcatggagaacaccttgagagagcaatgagatctcgctctcctgcctcatgaccgatacacggtttcaagaagttagatgacatcacagatactcagggcacccagctccaggccttactgccttcgcacaaggccgctctctactagcttcaccccgcatggaatgcaatggtcaatgaggccctggtcagaacatgggactgacaaagccagcacttgtaggctgagtctcagatcacgtggcttgtttgttttgtttgtttgtttttgggagatggagtttcactcgtgttgcccaggctggagtgcaatagcaccgtctcagctcactgcaacctccgcctccttgttcaagtgattctcctgtctcagcctcccgggtagctgggactacaggtgcatgccaccatgcctggctagtttttgtatttttagtagagatggggtttcatcacattggtcgggctggtttcgacctcctgacctcaggtgatccacccaccttggcctcccaaagtgctgggattacaggcgtgagccactgtgcccggctggcttttttttttttttgaggagtcgcactctgaaatccaagctggagtgcaatgatgtgatctcccaccatgctagttgtgtttgttgttgttgttttttctttagtagagatggagtttctccatgttggtgaggctggtcttgaactcctgacctcaggtgatccaccccccacctcggcctcccaaagtgctaggattacaggcgtgagtcaccatgcctggcctcaatttcttgaaagacaaagaaaaaagacagaaagagagaaagaaagaaaaagaaaaaaaagagaaagagaaagagaacaagaaaaagagaaggaaagctccatgggtttaaatgcaagagtcagcttcaaggagggctgggaagtcaggtgacgccacccttgtgcttcccgcagccagatcacctggtggaggtaccgttggttttgggcccctctctcagcacttgctaccagagaggacagctctacaccagagagtgagggtgggaacctgctcactgctgtctgctcagggctgggcatgaggcaggtgctcagtaggggtctggagaataaatgaatgaaccatcacggggccaagcacctggaagcgggctggagatgcttgctctggactcctggctcaggagtggactccccaggtggacttcctcctgcatcaccacagctgagtgcatggagcacaggtagggcagctaatgagcagggtcatcatgaatgacagcagatgacaccaggacaggggaggtcagtagccagatgggaagaaagcagaatgaaacaggtcacccgggtgcagtggctcatgcctgtaatcccagcatttcgggaggccgaggtaggcagatcatgaggtcaggagatcgagaccatcctggctaacacggtgaaaccctgtctctgctaaaaatacaaaaaattagccggacgtggaggcgggtgcctgtagtcccagctactcgggaggctgaggcaggagaatggcgtgaatctgggaggtggagctagcagtgagccgagatcgcaccactacactccagcctgggcgacagagcgagacagtctcaaaaaaaaaaaaaaaaaagttctggcggagagtgtgggtgagcactagggtactggaaagattccatgcctgggaatcgtgcgtggattgattacatccccacttctggcaaaatgcttcatggccttgtgcaagttaactttgtctccctgggcctctgtttactcatctgagaaacggggtaaagacatttgctcttcttaggtcacagggctcctgtacacgatgtgaaaggactttggaaagtatcctccggtgtgcaaatttctctgagaagtgctgtggctgtttatccttagactggaatgagaagggggagatgtgacttttgtgactttcagggtgggccaggtgttgtaggtgacaggacaatctcaggctggtagcagtggctcatgcctgtaatcccagcactttgggaggctgaggtgggtggatcacttgaggtcaggagtttgagaccagcctggataacatggttaaactccatctctactaaaaatacaaaaattagccaggttggggtggtgtgtgcccggagtcccagctactcaggaaggtgaggcaggagaatccttgaacccgggaggcggaggctgcagtgagccaagattgctccgctgcactccagcctcagcaacagagtgaaactccatctcaaaaaaacaaagacaatctcagatgtgcagttcacaccctggggctctccgtgggatcaggctgagggtcgcatttaactgaaatcttcaggagttcagcgtcggggtagatattccctgagaagcagctgagaggtaaagcttcctccgggaagtactcacttgctccttgttgatttcatggggtctcaggtttcaggaggaaagtaaagatgaaaagcccttgctctggcatcttggaggacttctgggtgagagccaggaaggggaaggcgtttggactcattgccctcccaggcctggagtctgattttcctgctctgtctggttttggaggtggaggctgcgaagccgaagcagtgctggtcctgccagctcctcccagctcctcccctgccctctgcttccctggccttgcacagggacaaggagctccaaagagcggctctgtcctgtctcagcctgggagggaagagggaggtggcatagatggttccacaaacagttcagtacgtgccaaaggagggcctgggaagccccaggtcaggagagggtgcctgcccttcccgtgaaggccagggctgagctgcttcctgccagcatccagttttgctcagagcacccagaacgccgtcttggaggaacgggggcaggcgctgccgcagaaccctggagctgtgtctcctgcctccagggctggccgtagctgcaaagaccagctggcaggtggaggactcaggaagactctccctgtgttggccctgcagccccatgtccccttctctgcttcttgggaacaggaggcctgtgtctgcctgtcctgagcatctcaaaaggaaaagctattctagggatgatgagagggaatcagggcctgaggcacttggaggaacatttgctgagctccctgtgcaacagcccattccaaggccaaggttgcaaaggtggcttagatgctgtccctaaatggccatcgaggttccaagcctggcaggaagggctcgagtggtggggccacagcggagacaaggccaagcagcctgattcttgggagtggaggttaatgagcagcgtttgcacttggctttctatagggtcaggctgtagtgcaacatcctgaggtgcgtggctgcccacaggtgctcagccagcccagcctctgccaaggcagacagagcctgggctgggaagcgggggatcccactgcttggggagtccccttttcttctgcatagtggggatgccaggagcagtgaacaagctcagcaaagagttctccagcccgacccgaggtttccttcctcctgactttgtcacctcactgggagaatatacagctctgtctgaaacaagtttcctgcggggcaccctgtgcaggggaagctcgggcagcccaacctaccagatggaagggaaagatagaggctgtgaggttcttctgggcctgtctacagcctcttctacctggctgccctttgttcagagtaaaggatgcagttcccaagacataagcaccgcgggcttcagagtatgaaggatccttccaggtcagccactttgggcaactggtgagcaaggcgggtgtgcagggccggctacatcatttgtggggcctggtacagaatgaaaatgtggggcccttattcagaagttactaagaatttttttttttttagatggaatctcactctgttaccccggcgggagtgcagtggcacgatcttggctcactgcaacctctgcctcccgggttcaagtgattctcctgcctcagcctcccgagtaggtgggattccaggtgcccgccaccacgtctgggtaatttttgtatttttagtagagacagggtttctccacctggctggtctcgaactcctgacctcaggcgatctacctgccttggcctcccaaagtggtaggattacaggcatgtgctaaaaatttcaagatgaggacagcagagcataagtgaagcgcaggacccttgcaagtgggtccgtctgggtgtgactgcatttggggagaaggggatggggtcctgcctgtccctgcagtcacagcataccacgagtcctggggcagaggagcctggattcaggcccttggtgctcagcggtcctggctcacggacacccctcgttcagcagccagggggttcctcactgtgtcccagatgtcactctaaagattgcttcagaggctccctccccgaatcgttggagggactctgccagttccaatgaccagccagctgccttcaggtcacaaaagaatctggggctggtctgagaccaggtgtacccccagaccccatctctgtccagatcatgagagggggtccagggtcccccgcctcccacagttgggcttcactgcacagctggaactcagccaggcctgttccgggaagcagggctgtgagtgtgagcagtccaggaccttggcattttgaacaaagaattgaacaaaacccacaaagtaacatagcaatgaaacatgggaaggaagcagtgaaagcaggaatttatgaaacagataaagcactctgcagggctggagtgggcctaagcaagcggctcaagagcctggttacaaagtttcctaggtgttttgttagtttgtttttgtattttattttttttattattattatttttgagaagtctcttacccaggctggagcgcagtggcatgatcttggctcactgcaatctccgcctcctgagttcaagtgattctctggcctcagcctcccaagtagctgggattacaggtaagtacccaccacgcccggctaattttcatattttttgtagagatggggtttcaccatgttggacaggctggtcttgaactcctgacctcgttaatcggcccacctcggcctcccaaagtgctgggattacaggcacgagccatggcacccagcctcctgggttttaagtactgcttttgaggttctattggctaccccttatctggatgaaggatttggtctgtggctcataaaaggctaatgtgaactggcgccctgtgcagatgaagggatgacccatgcttcgcctgcggctaatccaggacactctcccttcccatctaagatgtggtggagacaggagggtgatagggtgtctctatattaaaaacacacacacacacacacacacacacacacacacacacacacacacacacacacaaaggcagccagactatgcactaggaactgccctgggaatcccgttgcgttctcacaacaatcccacttcacagataaagaaaccaaggcacagaaatattcagtaacgtgtccagatgcggtggctcatgcctgtaattccagtattttgggaggctgaggcaggcagatcacgaggtcaggagttcgagaccatcctggccaacatggtgaaaccccgtctctactaaaaatacaaaaattagctgggtgtggtggcaggtgcctgtaattctagctactcaggaagctgaggcaggagaactgcttgaacccgggaggcggaggttgcagtgagccgagatcacactactgcactccagcctgggtgacagagcaaaactctgtctggaaaaaaaaaaaagaaaaaagaaatactaagtaacttgtctgaggccacttagttaccaagacgtgggagctgggacttgaacccaggcagtctggctggattcatgcctgcagcctctgcactcctgctacttcctgtgtgagaagcgcctgttctgtggaaggttgtgggctgagatctttccatgacttccactcatttacccccaaggctgttcttaaagacgggcatgacagttatgcccattttacagatgggaccctgaggctcacaagggcatgccactcacccatctccacaaagctatagctcgtcagcagagggcagaattcggccgcctctcccctagctcgaaggctgtgattgacacagaggtttttttgttgttgttgctgttgtttgttcctttttcttttttttttgagacagggtcttgctctgtcatcccggctggagtgcagtggtgcgatctcagctcactgcaaactctgcctccaagatgcaaatgattctcgtgcctcagcctcccaagtagctggaattacaggtgtgcactaccatgcccagctgttttttgtagagatggggttagtagagatttgtttaatagagacgaggtttcaccatggtctctactaaaccctgtctctactaaaaatacaaaaattacccaggcgtggtggcacatgcctgtagtcccagctactcaagaggctgaggcaggagaatcactcgaacctgggaggtggaggttgcagtgacccaaaatcatgcactctggcctggggtctcgcttttgcccaggttagagtgcagtggcacaatcatagtggcttactgcagcctcaaactcctgggctgaagggaatcctcccacctcagcctcccaagtagctaggactataggcatgtgccatcatggcgagttaattttttgtgtgtttttattttctcgagacagagtcttgctctgttgctcaggctggactgcaatggcgtgatcttggctcaccgcaacctccacctcctgggttcaagcgattctcctgcctcagcctcccgagtagctgggattacaggtgcgtgccagcatgcctggctaattttgtatttttagtagagacagggtttcgccatgttggtcaggctgctctcgaactcctgacctcatgatccacctgcctcggcctctcaaagtgttgggattacaggcatgagccactgagcctggcctggggagctaatttttaaatttgttatagagacaagagagacaagagtctctcttatgttgcccaggctggtctcgaccccgtggcctcaagtgatcctcccacctcagcctcccaaagtgctgggattacagatgggtgtcaccgcagctggcctctgaggagggtttcattataaacctgccctgaagggagggaatccaattttacgagagggtgtagcctggtgaggcctggatgacctccgcaggcaggggcttgtgcctgggctgaggcctaagggacaatgggcagacatgaagttgccccaggcagagggtacagtgtgggcaaagtcaggaagtggcagggcttggatcactccaggaagagagaggactcacgtgtcacaggagctcgagacccagagagagagtgaggcaggcaggcagggaccaagcttgggcacagccaggaaggcaggacagggcatggtggggccaatggaatcattacccaagacgggcattttcagggaaacagcttagataaggccaggcgtacagtagctcccacctgtaatcccagcatttggggaggctgaggtaggaggactgcttgcgcctgggagttcgagaccagcctaggcaacatagtgagaccccatatccacaaaaaatttaaaaaaggagtttgtgttcctgtagtagcatacttgggaggttgaggtggcagtatcacttgagcccgggagttcaaggctaaagtgagctgattgagccattgcactccagcctgagtgacagagagatacgctgtctcaaaggaaatacaaattaaaaaaccagccgggcatgctggtgtgtgcctgtagtctcagctacttgggacactgaagtgggaggatcgcttgagcccaggagttcaaggctgccgtgagctatgattgtgcctgtgcactccagcctgggcgacagagaaagaccctgtctcttaaaaaaaaaaaaaaaaaaaaaaaatcttagaggatgctgtgcctccctgggggtcttcagtcacccatggtcctggcagcagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcaccaccatgccacccaccccgagtatcccctgggcatcctggcatagccagatgacttccgtgcccgttgcaataaccactgcttccaactctctatagaccaccccttgggtatatctaatgtaagtgatatttattttatttattttttgagtcagagtctcgctctgtcacccaggctagagtgtgctgatgtgatcttggctcactacaacctctgcctcctgggttcaagccattctcatgcctcagcctcccaagtggctgggactacaggcatgcaccatcacgcccagctaatttttgtatttttttcagtagaggtggggtttcaccaagttggccgggctggtctcaaactccccacctcaagtgctctgcccgcctcggcctcccaaagtgctgggattacaggcatgagtcgtggtgtctggccctaatgtgagtgatctttaacaatgaagacttgaaaaagaaaaccctgaagaaacctaattctttgatgtctggacgacaaggaagaagatagatagaagtggcatcagataataaacagtgtaaatgtttatcagaaagaggctggtggttgggaccagtaggaggatcgcttgagtccaggagtgcatctctacaaaaaagttaaaggattttttaacattggccaggcatggtggcacacatctgtgatcccagctacttgggaggctgaggcaggattgcttgaagcccaggaggctgaggctgcagtgagctgtgatcgagccactgcactccagcctgggtgacagagcaaaacccagtctcaaaaaataataataatattttacataaccaaccacttctaaagactaaaaaaaaaccctacaattaaaaacctcaggtccctcaggcaatcataccagatattgaaacaaagcaataacataaggactgcagtatttattttatttttatattatttatttattctttgttagtttgtttttggagtgtgggttttgttttgttttttgatttttttcttttgttccacccacagatttcttcttattgcccaggcttgagtgcaatgacctgttctcagcttactcaacctctgcctcttgggtttcagtcatttttctgcctcggcctcctgagtagctaagggaggagtcttgagattatcatccacggagggtggaagaggagagggtggaaggggaataagaagacactccagtgaagcacttgccttgcgtgcaaaaatgtaagggggcctctccctctccctctccgtctccctctccctctccctctccgtctccctctccctctccctctccctctccctctccctctccctctccctctccctctccctctccgtctccctctccctctccctctccctctccctctccctctcactctccctctcactctccccacggtctccctctcatgcggagccgaagctggactgtactgctgccatctcggctcactgcaacctccgtgcctgattctcctgcctcagcctgccgagtgcctgcgattgcaggcacgcgccgccacacctgactggtcttggtggagacggggtttcgctgtgttggccgggccggtctccagcccctaaccgcgagtgatccgccagccttggcctcccgaggtgccaggattgcagacggagtctcgttcactcagtgctcaatggtgcccagactggagtgcagtggcgtgatcgcggctcgctacaacctacacctcccagccgcctgccttggcctcccacggtgccgagattgcagcctctgcccggccgccaccccgtctgggaagtgaggagcgtctctgcctggccgcccatcgtctgggatgtgaggagcctctctgcctggctgcccagtctggaaagtgaggagcgtctgcgcccggcagccatcccatctaggaagtgaggagcgcctcttcccagccgccatcacatctaggaagtgaggagcgtctctgcccggctgcccatcgtctgagatgtggggagcgcctctgccccgccgccccatctgggatgtgaggagtgcctctgcccggccgagaccccgtctgggaggtgaggagcgtctctgcccagccgccccgtctgagaagtgaggagaccctctgcctggcaaccaccccgtctgagaagtgaggaggccctccgcccggcagctgccccgtctgagaagtgaggagcctctccgcccggcagccaccccatctgggaagtgaggagcgtctctgcccggcagccaccccgtccgggagggaggtgggggtggtcagcccctgcctggccagctgccccatccgggagggaggtcgggggtcagccccccgcccggccagccgccccgtccgggaggtgaggggcacctctgcccggccacccctactgggaagtgaggagcccctcagcctggccagccgccccgtccgggagggaggtgggggggtcagccctccacccggccagctgccccgtctgggaggtgaggggcgcctctgcccggctgcccctactgggaagtgaggagcccctctgcccggccagccgccccgtccgggagggaggtgggggggtcagccctccgcccggccagctgccccgtctgggaggtgaggggcgcctctgcccggctgcccctactgggaagtgaggagcccctttgcccggccagctgcccagtctgggagggaggtgggggggtcagccccctgcccggccagctgccccgtctgggaggtgaggggtgcctctgcccggccgcccctattgggaagtgaggagcccctctgcccggccagccgccccgtccaggagggaggtggggggggtcagccccccccgcccggccagccgccccgtccgggaggtgaggggtgcctctgcccggccgcccctactgggaagtgaggagcccccctgcctggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaagaaaattaaaaaaaaaaaaaaaaaaaaaacaggctacctacaatttgtgttgaagatatgaatgaatgaagtttccacacccttatgtggagttctgataagtaagcaacaataaggaagggtccccaggttggggagaccccaagttgagaacaataatgaacaattattgtatgaacaattgttagagacagctaatcacaaacaacctgcgggcacaatgaccccattccacacgtagcacccttcagcaggaccctataaaactctcctccagcccttgcctctttgcaggtagccccttctgtgctgagctgcccattgcaacatattttcataatttctctaataaatctgcccttctttacctacaactatcttggtaaatggctttaccacctgcaaaactgaccctaggttgttgctacccgatatggtttggctgcatccccacccaaatttcatcttgaattgtagttcccataatccccatgtgtcatgggagggacccggtaggaggtaatcgaatcatgggggcaggtttttcccatactgttctcgtgatagtgaatacatctcactaaatctgatggttttataaagggcagtttccctgcacgtgctctcttgcctgctgccatgtaagacatacctttgctccttctttgccttccaccatgattctgaggcctccccagccttgtggaactgtgagtacattaaacctctttttctttataaattgcccagtttcgagtatttcttcatagcagtatgaaaagtaactaatacactacctgagacaccttaggagatttgtaatagctgtaatgccaggtccaccatatttttagcataaagcaaatgtttacccatgatatgactgcacaggctttctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggcaacatggaaaaacaccgtctctacaaaaaatacaaaaattagctgagtgtagtggcacacacctgtagtcccagcaccttgggagggtgaggcaggaggatctcttgaacccaggaggtggaggccgcagtgagcagtgatcatgtcagaggtgtgtgaaccagagcaactccatcttaaataggagctgggaaaaatgaggctgaaactgctgggctgcattccctgatggttaaggcattctaagtcacaggatgacatagaaggtcagcacaaaataccagtcgtaaagaccttgctgataaaacaggttgcagtgaaggagctggccaaaacccaccaaaaccaaaatagtgacaagagtgacctcccatcatcctccctgctacattcctacaagcaccatgacagtttacaaatgccatggcaacatcaagaagttaccctatatggtctaaaaagaggaggcatgaaaaatccaccccttgtttagcatatcatcaagaaataaccataaaaatgggcaaccagcagccctcacggctgctctgtctatggggtagccattcttttattcctttactttctctttttcttttgagatggagtctccctctgtcacccaggctggagtgcagtggtgcgatctcggctttctacaagcttcgcctctcgggttcatcccattctcctgcctcagcctccagagtagctgggactacaggcgcccgcaaccacacttggctaatttttttgcatttttagtagagacgaggtttcaccatgttaaccaggatggtcttgatctcctgacctcgtgatccacctgtctcggccccccaaagtgctgggattacaggcgtgagccaccccgtgcccctcctcctttactttcttaataaacttgctttcacttcacactgtggcatcaccctgaattctttcttgcacaaaatccaagaaccctctcttggggtctggattgggacccctttcctgtaactatcatgccactgcactccagcctgggcaacagagcaaggccctgtctctcaaaaaaaaaaaaaaaaaaagtaacgtgacttaatacattcattttggagggtaagtctctcaaaataggcctttcactgggggaaaatggtaaaaatactccctggtaattcaagaattggagactcctgagatgctgctcatattagctgaacacttatcaatacttcactttcttccatatatactcaaggaacaagtgctatttaaagtgtttcactctgctgtgctaggtgcaagactataaagaggtgtgaggatcaacacttttatgaaaaccaatgtcattctgaatatagtttcagatgctagtgcaaaggaagctcttggtatacggaaaaagtattcaacaataaattaggcatggttgcttccattttctgcctcacatacctttttttcatggttaaagtgatataaagtctatgatattttagattggcagttgcaaactagtggtcctcagcgtgctttttatgacacctacaaggtttgaagactctgatttcatattaaaaatctgggtttcaggctgggtgtgatgttgcatgcctgtaatcccagcactttggaaggctgaggcaggagaatcgcttgaaccagggaggtggaggttgcagtgagccaagatcacgccactgcactcaagcttaggcaatagagcaagactccatctcaaaaaatgaataaataaataaaatctgggtttcaggccaggtgtggtggtgcactcctgcaatcccagcactttgggaggctgagatgggcagacagcttgagctcaggaattccagactagcctgggcaacgtggcaaaaccccatgtctacaaataatacaaaaaaattagctgggtgtagtggagtgtgcctgtaatcccagcaacgtgggaggctgaagtgagaggactgcttgagcctgggaggttgaggttacagtgagctgagatcaccctcctacactccaacctgggcaacagagccagaccttgtcttaaaaaaaaaaaaaaaaaaaaaaaaattctgggtttctggcatctcaaaaaaaaaaaaaaaaaaaggaaaggtcagggcacatggctgctacagtcctctattaagcaatgtgccacagcaggggtccctgacccctgggccatggacatgtactggtctgtggcctgttaggaactgggccacagagcaggaggtgaatggtgggtaacaattgaagcttcgtctgtatttctggctgctcctcattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttagaatctgccatgaatctgcagcctctattatatagttccctatagactttgcttcctaccgtcttacgttctgccttataggcatctcagtttgcaacccttgtttttgtcagtatgctacgctggtgacattgaccaaattgaccacacattaatgataagcttagttggtgatgacctcaacggaataacgtgacataagtattgtgacaatacttcttgcatgtatctacaggtggaattgtaaacctggtggtccgagatggtctaattcgatcttcctatgtatctccttatattaatagtggtaacatttgtggtggtgattcagcgtttcaatgcctcttctcacggcaacaacaaacgttttccttctgaatcaacattaacctagatgttactgcagatcaaaattagtatctacattttcaaccacagaaatattgggcagtaaaaatttttcttaatattgattgcctacataggttgtgtaattagcatatgtttatagttctatgatttgtgcctggctgctacagagctggagggggtaaagcaacagtgttttctcagttgtgtgagcagcattacattataataaataggtaatattaaactgggctgatgagagttgcaaaagactactttaatgttcatatggaaccaaaaaagagcccgcattgccaagacaatcctaaacccaatgaacaaagctggaggcctcatgctacctgacttcaaactatactacaaggctacagtaaccaaaacagcatggtactggtaccaaaacagacatatagaccaatggaacagaacagagccctcagaaataataccacacatctacaaccatctgatctttgacaaacctgacaaaaactagaaatgtggaaaggattcccgatttaataaatagtgcttggaaaactggctagccctatgtagaaagctgaaactggatcccttccttacaccttatacaaaaattaattcaagatggattaaagacttaaatgttagacctaaagccgtaaaaaccctagaagaaaacctaggcaataccattcaggacatagggatgggcaaggacttcatgtctaaaacaccaaaagcaatggcaacagaagccaaaactgacaaatgggatctaattaaactaaagagcttctgcacagcaaaagaaactaggatcagtgtgaacaggcaacctagagaatgggagaaaatttttgccatctacttatctgacaaaaggctaatatccagaatctacaaagaacaccaacaaatttacaagaaaaaaacaaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagatatcatctcacaccagttagaatggcgatcattaaaaagtcaggaaacaacaggtgctggagaggatgtggagaaataggaacacttttacactgttggtgggactgtaaactggttcaaccattgtggaagacagtgtggcgattcctcagggatccagaactagaaataccatttgacccagccatcccattactggatatatacccaaaggattataaatcatgctgccataaagacacatgcacacatatgtttatcgcggcactattcacgatagcaaagacttggaaccaacacaaatgtccatcaatgatagactggattaagaaaatgtggcacatatatactatgcagccataaaaaaggatgagttcatgtcctttgtagagacatggatgaagctggaaacgatcactctcagcaaactatcacaaggacaaaaaaccaaacaccgcatgttctcactcacagatgggaattgaacaatgagaacacttggacacaggaaggggaacatcacacactggggcctcttttgtggtgggggagggggaagggatagcagtaggagatacacctaatgtaaatgacgagttaatgggtgcagcacaccaacatggcacatgtgtacatatgtaacaaacctgcacattgtgcacatgcaccctataacttaaagtataatttaaaaaaataagtaaataaataaaaaaagaaacaattgctggctttgcaattctctttcctccaaaatcaccaaggcctcaatttactcattgctgaaaaaggacgactgtatatttttaaatgaagagtgttgtttttacctaaatcaatctggcctggtatatgacaacataaaaaaactcaaggatagagtccaaaaacttgccaaccaagcaaataattatgctgaacccccttgggcactctcttaattggatgtcctgggtcctcccacttcttagtcctttaatacctgtttttctccttctcttattcagaccgtgtgtcttctgtttagtttctcaattcatacaaaaccatatccaggccatcaccaataattctatatgacaaatgctccttctaacaaccccacagtatcagcccttaccccaaaatctttcttcagttgaatctctcccactgtaggttcccatgccgcccctaatcccgctcgaagcagccctgagaaacatcgcccattatctctccatatcacccccaaaaattttcgccaccccaacactttaccactattttgttttatttttcttattaacataagaagacaggaatgtcaggcctctgagtccaagctaagccattaagccatcatatcccagtgacctgcatgtatacatccagaaggcctgaagcaactgaagatccacagaagtgaaaacagcctcaactgaagacattccaccattgtgatttgtttctgccccaccctaactgatcaatgtactttgtaatctgccacactcttaagaaggttctttataatctcccccacccttaagaagtttctttgtaattctcctcacccttgagaatgtactttatgagatccacctcctgcccccaaaacattgctcttaactccaccgcctatcccaaaacctataagaaccaatgataatcacaccaccctttgctgactcctttttcagactcagcccacctgcacccaggtgaaataaacagccatgttgctcacacaaaacatgtttggtggtctcttcacacagacacgtgagacaggagttcgagaccagcctagccaatctggtgaaactctgtctctactaaaaatacaaaaattagccgggcatggtggcgggcacctgtaatcccagctactcgggaagcggaggcacaaaaattgcttgaacccaggaggcagagtttgcagtgagccaagatcacactgtctggcatctgagcccaagccaagccattgcatcccctgtgacttgcacgtatacatccagatggcctgaagtaactgaagatccacacaagaagtaaaaatagccttaactgatgacattccaccattgtgatttgtttctgccccaccctaactgttcaatatactttgtaatctcccccacccttaagaaggtactttgtaatctccccaacccttaagaaggtcctttgtaattctccccacccttcagaatgtactttgtgagatctacccctgcccacaaaacatggctcttcaccccctatcccaaaacctgtaagaactaatgataatccaccaccctttgctgactctcttttcggactcagcccgcctgcacccaggtgaaatgaacagccatgttgctcacacaaagcctgtttggtggtctcttcacacggacgtgcatgaaacacacgactgcacttcaggctgggcgacagagctagattccatctcaaaaaaaataaaaaggagtcacctcccctgagaggcctctggaccaacccatctgagcaggccactcttccttctctatcttaccatcttgtttctgtcccagtagttagggctacctccagtaatcctatttgtccctttactgtttagtgcgtctcacttgactagaagctccatgaaagcagagatcctacctacctccttcaccactagacccccagggcctggtatgtggtgatcgctcagggcccattttcttcctttcctcctcctccaagggtggggaaagagcatcagaaggtctaggtggccccaggcccaaacaatcctcctttaaaaggaaaccagattgttacaaaggtcagaggctgaaaagttatttccgccttttatccctctaaattcttcacttcctgaaaaaacaaacaaaaaaaagccactgagggcccttggactaaatccaggcctgagttgctgggcagaggtcagtcttgtccagacatgggaaaaaaataactcgagtcagacaggtgggtcaccagagaacgaatccagcctgcaaatggtgtgtgcaatcttcagctctgtccagacctgcctccctctggggatgcctttaaaggtgatgaatgacctggatgaatgggcttagaagagggaaaaacaaatatcacaggtcaaatcattatttgtcttcaagtttaacaccgtctactggactgaaagatgtccaaagaatagttgttcaactatgtaaattcctttttttttttttttttgagacagagtctcgctctgttgcccaggctggagtgcaatggtatgatcttggctcactgcaagcaacctctgctcctgggctcaaaccattctcctgcctcagcttcccaagtagctgggactacaggcatgtgccaccacgctcagctaattttagtattgttagtagagacagggtttcatcatgttgaccaggctggtctcgaactcctgacctcaggtgatccacctgcctcggcatcccagagtgctgggattacaggcatgagccactgtgcccagccaactacataaattcctaacaacgtatctccagaaagtataggcacaacagcacatgcagtcattcctgtaatcaggtgctccgggaggccaaggcaagaagatcccttgagcccaggagtttgagaccagcctggacaacatagcaagactgtgtctctataaaatatacaaaaattgggctgggtatggtggctcatgcctgtaggcccagcactttgggagaccaaggcaggaagatcgattgaactcaggagcttgggaccagcctggacaacataatgagacccagtctctactaaaactcaagaaaattagccagatgtggttgcatgtgcctgtagtcccagcactttgggaggccaaggtgggtggatcacctgaggtcaggaggttgagaccagcctggccaacatggcgaaaccccatctctactaaaaatacaaaaattagcccggtatggaggcatgtgcctgtaatcccagctacttgggaggctgaggcaggagaatggattgaacccaggaggcagaggttgcagtgagccaagatcgcaccactgcactccagcctgggcaacagaacaagactccatcaaaaaaaaaaaaaaaaagaaagaaagaaagaagaaaagaaaattagccaggtgtggttgcatgcacctgtagtcccagcactttgggaggccaaggcaggaggatcaatcaaggctaggagtttgagactgcagaaggaaaccctgtctctaaaaacaaggtccagctaaaatcagggtccagctccaccacaagcgcagctccagggtctgttgagttttgcctctaccattccaagtagtccctgctccagaccaagtcccaccatctggcagtcaggtcagtccaaccacagtcatatcagggcgcttcccggttctttcattgagtgccccttgaggaggctggaggagaggccaatgacatttgcacttgagactccagagtctagatttataaccactatgttacggctgccagtgtggctgcaaggacacttctttcattcattcatttacaatagatgtagcatctgctgtgtgccagatgccattctaggttctagggaaacaaagcaaagcccctgttttccaaggcatccacattctaggaaagactgctaccagcctggcgtggtggctcatgcctgtaatcccagtactttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaggctaaggcaggagaatcgcttgaacctgggaggcagatgttgtggtgagccgagatcacgctaccgcactccagcctgggcaacagagtgagactccatcaaaaaatagtaataataaaataaagactgctactaaacaataaaataaccaaaccagatagatgacttcaggtggtggtaagagctttgaaagaataagcaaggtaactaactggtcagaggaagggagatgggtgcattccctcagatagaccgccccagaggtctgcctctctgacatgacatttgagcagaaacccaacaggaaaaggaagagactgctctatggccaggcacggtggctcacacctgtaatcccagcactttgggaggcccaggcgggcggatcacgaggtcaggagatcgagaccatcctggctaagacggtgaaaccctgtctctactaaaaatacaaaaaaattagccgggcgtggtggtggatgcctgtagtcccagctactcgggaggctgaggcaggagaatggcgtgaacccgggagacggagcttgcagtgagccgagattgcgccactgcacttcagcctgggtgacagtgagactccatctcaaagaagaaaaaaaaaagaaccaagaggagtccaggagaagagaacagcagatgcaaaggccctgaggcagaaacaatcttggtatgcgggaggaataggaaggcagccagtgcagctggagcaggataggttaagagaggatcaaggtgatgagggcctggaaagaggggctggggtcaaatcaccagatcctgttggttgcaatggaagagcctggagtttattctcagggcagtgagaagccactggaaagttgttttttgtttttctgtttttgagacagagtctagctctgtcacccaggcagactgcagtggtgcaatcttggctcactgtaacctctgcctcccaggttcaagcgattctcctgcctcaggctccccagtagctgggattacaggcacaggccaccacacccatctaatttttttttttttttttgagacagagtctctgtcacccaggctggagtgcagtggcacaatctcagctcactgcaacctccacctcccaggttcaagcaattctcctgcctcagcctcctgagtagctgggactacaggtgcatgccaccatacctggctaattttttgtgtttttagtagagacaggatttcatcacgttagccaggatggtctcgatttcctgacctcgtgatctgcccaccatggcctcccaaagtgctgggattaacaggcgtgagccaccgtgcctggccagccaccggaaagttttatgtaagcaggggagtgatctgttttatcatttagaaggatacacacctcttcttctttttttagagacagggtctagttctgtcacccaggctggagcccagtggcacaatcatagcttactgtaacctcaaactcctgggctcaagtgatcctcctacctcagcatcccaaagtgctggattacaggcatgagtcaccatgcctggtcacacttctcattctttaaaccagacctcatttgtccacctcccccatcccccgccccaccccacggactgtcctataatgcccatacaacaggtcactgtttagaaagtgccacaaagttacaaacacagtcccttctgagcctcccaccaatgttggtgggtgcaaggtcaaaaaaaaaatctcatctatctaaggggcataggagactttttagttagagggcccaattatagtcctcctgaaaagatgccaaaagtccccttaaacacttagcaaagattcaagaaagatgaatctcacattctttgtatgggaaatgaggaacttgacatcttcaatataatagattccactaaaataagatgacgatcaataggaaccaactaaaaaaatacttgactagctgttattgaaaggctgaaattcagctgacataagcagtattaatattgagctagaaaataattcgcattgaattcagcccaacttttgttttctgatttgggtctcttctaaattttttttttcttctggacattgggaacaatccaatttgaaggcctcaatgcccaaatctacactcgttttattctatatccttggtttctttttttttttttttgagatggagtctcactctgtcgcccaggctggagtgcagtggcgtgatcttggctcaatgcaagatccgcctcccgggttcatgccattctcctgctgcagcctcctgagtagttgggactacagatgcccgcccccacgcccggctaatttttttgtatttttagtagagacggggtttctccatgttatccaggatggtctcaatctcctgacctcgtgatccacccgcctcagcatctcaaagtgctgggattacaggcattagccaccgtgcctggcccacacctgggtgatttttaaaattcttctagtagagacagggtctcactatgttgggtcaccgtgtttgatgtcagttttccctgacagaatctacaatctccttgatcaccattatatcccaacacagagctcagtacctggtacaaagcacatttgatcaatacttgctgaataaagaaataaaaatgaagaggcattccagcctgggcaacagagtgagatggtctcaaaaaaaaaaaacaaaaaaaaaaaaaacaaaaaatgactggaaaggagatgagggtacttgtgaagccatattatatgacacgctctgtgctaggacttttatataccttgtctcatctcttcatctcatataatccttacaagtatctcaaaagtggggaaatccccatataactgaagaggaaggcagttcagaagttcactgatttgccctaaggttcctcaatttgtaaacatcaggccaatgatccaaccccaggtatgtttggcagtgaaggaccagttgagtcatagctgcaagtaacaaccctgcagtggtccctatcttggccgttagcttacattgacatttaacactcaaatttactcagtaacaccagctatcatgttttccactaaaactccacagcattctggcaacttttctattttagagcaataaagtaaattgttagcatccctttgacatataaatatttctacaaatagtaattctctagccattcatttggagtatttaaaactcaacattcatagcacattttatgtgacaaagaacttatgttcagaacacaaaaataagtcttatgtcttcattaaaaatgggtgaagaatttgaacaaacatttgcaaactaaaatacaaatgaaatacactcaacatcattaatcatcaagaaaataaaattatgagataatcctaataatcactacatatgcaccacagtgattaaaatttttttaagttaagccacgtgacccaataaggtgcattcactcaagagaaacgcaaatatatgtccactcaaagacttgcacatgaatgttgagagcaggtttatactgaatagtgcaatgtgaaaaaaccccaaaatctagcaaagaatgaagggagaaataaactgtggtatatacatacaatagaacactactcaataataaaaaggattgtattcctgatacatgcaatatgggtgaaccttaaaaatatcatgctgagcaagagaagccaaacacaagagaacatgttgttatgatttcacgtacatgaaactttagtaaagacaagtctaatccatagtgacagaaagcaaatgagtaactgctgacagggccaaatgaggagatgatcccaagggaaccttctggggtaagacggtgttctgtatctcaatcgtattggtggtcacacaagtgaagacatgttagaactcatcaaaccatacacttagaatgtgtaatataaacctcaataaagcaaaatttaaaaaaaaaaacacctttaattttctcttacaaaaaaaaaaaggaaaaccacttaactttaatttttctccaacaactgattctggtacatagtataccttactgcctgcatccatggcctcacatcatgctgtttacatgaacgtaaagcttcaccgaagagtggaataagacagtcctgccagagaaaaaccaaaattactcaacgtaaaacaggctgttgatacgtttgcagatatatagcaagtcttaagtcaaagactgcaatatagtttggctacttcagattgattgcagtagttttatctattacactatacccttacatcatttatcttctactcacaagaggcaagcacacagtaagagaaagccttttgttttgaagggaaatcttcttcagaatattaagtctaatttatcaatatacttaataaagcacattacaaaaaaaaagtcacagcacatttactataaagcagactgcagaaaaacattacaactaatgctttataatgaagttctcgaagatcatcattcattcagaagcccccatctctggttgaactttaccccatttaggatgaagaggagagatctttgtttgcagcaaatctaaaatttacgtaatctgcctaaaggaactgtctttacatacaccacctcccactccaaaaatagaagaaaaaactgagcaatttgccatccttgcgattatctcaggttcttccatctgccccatgtacttcccaaatgaaagactgcctgaaaacagcatgttagatttctggatttaccagcttgcccaactacaaatcctatttcaaaaaactcaaaaaataaggtctttgttctacagtaatgaccattaatagtcataagaatgtgcttgtaaaaatatacagacctctgtttaaagtctgttagaaactgtgttctccaaagcaggtgagcaatacagctgcaaggtacttagaactggcaaagactgtgaaactgttaaagtagaaagtctcagaggtccaacagcgatgcgggatgtttgcttcaagtactttaccacatttctgaaacaaaatatttactgtcaattaataaaaattacaattcataaccactcaaagaataaagcaattgataagatgctatcaaactgacatccaaagttagggggcagtaagaggagcagcctgctctataataaaatgatattagcaagtcaagacatttgcttttggggatttttacattttatttcatttcaacctcagtttttgttggcaagcagcattcatatatcatatgacttctacaactaaaatgaagctattagcactagtatttagtaatctagtaactctccttccagccctcttcaccccatgtatgtttatcacatgatatacacaatgtacatttatctccgtaagagtaacttactcagttatagactgccacttctgatcttgttctatcgggtttaaagcagttgccaaacaaacagaacttcttaacaattgaacttcaatggatttctgaggttcccttggatctggacttaacatgttacgaagcaggtttttcatgtctacagaagttaaatgaaatgtcattaattaatgtgcttttattataaattttgatttatgtttggcattattaaaaactaatcaccaatgaacagctcctttaatatttaaggcagttaaacactataagcattactgagagctatataaaaatcatacttcatacaaaattactgtacctcagacccctaaaaagcagttgccttcaaaggctcaaaaatcagtaagtcgaggccaggcgtggtggctcacgcctgtaatcccagcactttgggaggccaaggtgggtggatcacgaagtcaggagttcaagaccagcctggccaagatgatgaaaccccgtctctactaaaaatacaaaaaattagctgggcacagtggcagacacctgtaatcccagctactcaggaggctgaggcaggagaattgcttgaactcagaggacggaggttgcagtgagccaaaatcccgccactgcactccagcctgggcaacagagtgagactctgtctcaacaaaaaagaaaatcagtaagtcaatctactatttaagggaacaaatctagacctgcattagcaaatcttgctcaatccagaatactcattaaactttttaataacattttataaagtgttccatttgtgataaagaacttaatgagccacatcaagatgaaaatcaagaaaaatatttagctgaaacactactttgtcctttatcaaacaaaatggctagataaatctcaaagcattaaggtggtcatttttttatttgacttaattttaagtgcttttcatttcccaaatcaaacttaaatagggcagccctaaatttgttgcttcacatgggattctgccccccaaaaatgtaaaatgacttccagattttccagtaaaatatactaagccaaacattttgagcaacttgtccactaaaataactttaaaactattttctcaaatacctacctattttttcttttgatcctccagcaagtagattgatattttctcctggtaacaattctaattgctcagtacattcaacaaattttccagactcgaagctgcttaatgatctgtaattaaaatattggttagcttgtattcctacgcagcctgtggaaccattaaaaaaaaacaaacaaacaaaaacagaacaaatcctaggaagacagcaaagtacacagcatttttctgacaaaattccttccacgaggatgtcattattttggtttttatgttgaagatgtgactaccacttaattagtactcaaattggagtggcaaaccagaaagtcacagctacagactttcagtagagctgactcgcccctgtgtctccttcctgttttcatgtgttgcagcctgttctcttcagagcctaacacactgacagtagacctctgcaggacaactttgacacccagttctctccaagctgccagtgagctccttgtgcagcctcactcctcacctacagcatgagcccttgcagctctcccagcatcataatcttgtatctcagtcctggcttctttcactgctggcatccctccatctctccctttttcacctacttttcttttttcaaagaattcttctctttcatctgcttttatgaaaaataatgacacctctgaaattctttcctgtagtcctgcagcatcaatgccaggaagacaggcctcatcctcccagcttctatgctgctcctttcagatcccttaccctgtccccattttcatgacacgggctctccagccaggaagaagacactgtttctcactctctctcttttccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacattcgtcatttctgccattaaaaggtcctaagtcctctccagtgacaggttcctcaagtccccactatgctctataatgccctatgctttcagctaatgactcagtcctcagaaaaacaaacaaataaaaaaacacaggctttaatttcctctacccctacccccaatccaccatacactgccaaaattctgtctataccaactttgactgctttccttgaggcagagaaaaggtgagggccagttaatctatcaatgttctttctcctgtttcttcaacctctgctttctagtggctccttccccttggccaaaagaacataatctctccaacatttaaaataaacatctcatatctccctccagcaatagcttcctatcctcgacttcaagaaaaactcactgaccaaataacttacctcaagcttttcattttcaaatgtctctaccactcaatagtattcaatctagcttcttctgtctctctacaaaactctttttccttataatccctagagcatctgacaaggctgactactcccatctggatgtcctatatctaggacacttcccttctcaatgtccctgtatttttttgaatggcttcctcttctatactttcacaaaaatgctaaactaggattctgacccaggccttccttcctcttcactcactattctccagaggcttctctctggtttggttgcttacaaaggctctagagtatagagactgaaaaggaaacagggccttttctgtgtactaatgatgtgcaaatctctcaagcttagactttctccttagttcaaaatccaattttttttttttaattgatcattcttgggtgtttctcgcagagggggatttggcagggtcataggacaatagtggagggaaggtcagcagataaacaagtgaacaaaggtctctggttttcctaggcagagtgtgtgtgtccctgggtacttgagattagggaatggtgatgactcttaacgagcatgctgccttcaagcatctgtttaacaaagcacatcttgcaccgcccttaatccatttaaccctgagtggacacagcacatgtttcagagagcacagggttggggataaggtcatagatcaacaggatcccaaggcagaagaatttttcttagtacagaacaaaatgaaaagtctcccatgtctacttctttctacacagacacggcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtaggggcggccgggcagaggcgcccctcacctcctggacggggcggctggccgggcggggggctgacccccctacctccctcccagacagggcggctggccaggcagaggggctcctcacctcccagacggggcggcggggcagaggcgctcccatctcagacgatgggcggccgggcagagacgctcctcacttcctagatgggatggcggccgggcagagacactcctcactttccagactgggcagccaggcagaggggctcctcacatcccagacgatgggcggccaggcagagacgctcctcacttcccagacggggtagcggccgggcagaggctgcaatctcggcactttggggggccaagacaggcggctgggaagtggaggttgtagccgagatcacgccactgcactccagcctgggcaccattgagcactgagttaacaagactccgtctgcaatcccggcacctcgggaggccgaggctggcggatcactcacggttaggagctggagaccagcccggccaacacagcgaaaccccgtctccaccaaaaaagtacgaaaacccatcaggtgtggcggcgcacgcctgcaatcgcaggcactcggcaggctgaggcaggagaatcaggcagggaggttgcagtgagccgagatggcagcagcacagtccagcttcggcttggcatgagagggagaccgtggaaagagagggagagggagaccgtggaaaccgtggaaagagagggagagggagaccgtggaaagagagggagagggagaggagggagagggagagggagaggagggagagggagagggagagggagaggagggagagggagagggagagccaaaatccaattcttaacagcttacccaacaatctcatctgcacatttcattagaaatcttaaaacatagcttgttctctgtgtgctcctactccagttaatagcattgtttctcttccctctaccattgcccccacaaattaatggtctccatgcttccatacttgcccctcacctccagtctcttcaccatagcagaatgaaccaccaagtcagatcacaacacatctctgttcaaatcccacctgaaattttcagtcttactagaataacagccaaagttcttttctcagttcccagctacttctctgcccttatatcctactgtttaaggtgctcctaaacacacaggcctcccagctatttccagaacactccaagcccatcattctcacatcaggtctaggcccaaagggcatcctgatgggcatgccttgaccttgtgtcttccctccaaagaaggtcagctttacctaactgctttccttatggcacagaaaaggtgagtgaggtccaattaatccttctatcaataatctttatctaatctttgctttaaaaggttggaatttgtgtctgttttatgtgctgcctgggtcatagtatatgctcagtgaagcaattacacattaacccatttagcagtagaaagcaagggtatcagacaaagtctaatgacctttatcttcccagccaagtgtctgcaacagagtgagtgctcagttttgaattacagaattaataaaagcacagaggaatgagaagaaagtttaatttacagatgttcacaaactctgtcctcattagaataaatgtttttgatatattcagacctcatttagaaacaaagccatcaaatgtgattctttctaaatcagtacaaatttttccttatattcactctggcataatcttcaaactctattaaggttttagaatgacaggttctgaaaattaataccaaatgactatctcagcagtgttttcccattatacaaataccttccctcatctctgatgtcagtttcctgttgtcattttcataatggcagtaagttagaaatataaccattttgtattactacatatgaccaattttaatatttttttgccataggaaaaacatcatagttattggaaatttgttttataactggaaacagaaagccttactttatatagttgaattcagctttcaggttgagggaagtgctactggtactctttttcaagtcatggatagcattctgccattcctgcacagcagcgcaatcggcaattgagatgtagcactcacacatgctttatttcctaaataatttataacctcaggggaagagtcagtcggtttggacagcacagtttttctggattcacctgaaagtattttataaaataagaagagattcagatcaattagaaatatttcaaagagcacagaaacctaaaaacatgataagatcatcagtacaaaatatatcactataacttttgctttatttaaaaatactgaacgctcaccattcagacaatgtttcgggctggcactgttacacccagcattggctaaggtgagcaccaatttgtcaaagctggagatgcagcaatcaacacctgtcatggcacacaggtgctcctggtactccacagaggccttttcaaacctgaaaagcaaattgaagcagtcttatttctttatttatctacttacttactttcttttttgagatgaagttttgctcttcttgcccaggctggaatgcaatggcactgtctcagctcaatgcaacctctgcctcctgggtacaagtgattctcctgcctcagcctcctgagtagctgggattacaggcactcgccaccatgcccggctaattttcttgtatttttagtagagacggggtttcaccatgttggccaggctggtcttgaactcctgacctcaggtgatccgcctgcctcggcctcccgaagtgctgggattacaggcatgagccaccgcgcctggcctttacttacttacttacttattttttgagacagtcttactgtcacccaggctggagggcagtggcatgatcatggctcgctgcagccttgccctaccaggctcatgcaatcctccaacctcagcctcccaagtagctgggactataggcacccaccaacacacctggctaaaacaaggttttgctctgttggccagggtggtctcaaactcctggactcaagcgatccgctcacctcagtctccccaagtactgggatttcaggcatgagccaccgcgcccagccccaaaggaggctgttattttaaacacacatatctcatttcccccccccacaaaaaatggtgcaagaataaactgagctaaaacagtgagttgactatggtggggggaggtttgatgtcttcctcacaactgtgaaactaaatttaaaagtggttaaatgtttttaaaaaaatgtaagagtataaaagaactagtggaaaatattgataagtaactgatgtcagtgtgtggaaaggctttgtagaaggataaaatgcaagaaaagatgcacaagtaacagatctagatgcataatgctgaaatacaacactaaacattaaaaacaaattataaatcaagaaattggatagcatcaacaatcttagtatttaataaaatttcacagattaacacaggaaaaattgagaggccatgaagacatgatccatgttttaaaaaatcacaaaaggtcactatatggggcaacttctactattagtcattaataaatatagaaatgtaaagtacaataactattttcgctgatggtggtggcagcattcttgtttctcagtgactctcagtatccacaaagatgaagggaagggggtactctattattaagggtatacattgcagccatcttttctgtagagtaacttaccaatagaatatattataagacttatggtttggcagcctttcttctagtaaatcagtttatgagaatggattccaagaaagtaatcagaaatataagcaaagatattaagtgctatggtacatttagtaaaaaaaaaaatcagaaacaaccttaatgcccaacagtaagaaatattaaattatggtacactcataaatacaaacctttattaaaaataacactgtagaatatttaacatggcaatttttttttttttgagacagagttttgcttttgttgcccaggctagagggcagtggcacaacccgggctcacagcaacctccgcctcccaggttcaactgattctcctgcctcagcctcccaagtagctgggattacaggcatgtgccaccacaccccactaatatgttttgtatttttagtagagacggggtttcaccatgttaggctagtctcaaactcctgacctcaggtgatccacctgcctcggcctcccaaagtgctgggaatacagatgtaagccaccgaacccagcctacctaacacggaaaattttttttttttaaatattgagtgggaaaaacagatcataaaaccatgtgcctatgtacactgatgttttggtgaagaatggagaaaacgacatgaaagaaaaaagaattacaaagcatatggatatggaaatatgggactacaaaaggacacacaacagaagttactacaaagatatggaagtatgagcagttcttttatcttcctaaatttgcaagatttcattaaactaacataaatggacacagaatattatggtacaagctcctctacctggaggaagcaatgagtctgaatgtagagttcacaggactaatgagcaaatactctgacaataaagggtaatttgtatcagactctgagggggaaggagctcaactagggatcaagttcaaaagcgtttataaaacaactgacaggtcttgttttacagtgtgatttgccactaattcttaaataagaaaggcactccagtattgcggctaactaaagaacaaactgaagatgcctcctggtgaagtgatttatagcaagcttcaatgctgaaagcaaacaaagctgttttaagatttggctacaatgtcagtgagtaatacaaagaatttaaacataaagtaattctgtcacccatttccttccctccaacctacctcccttcagcctgttgagccactgagttaatccacagaagattttttccaacaatagatgatgaccagacagcaattccctgtatagcttcaggacaatgaagttcacatagtgcttctaccaccatcataatggttatttccaattcattcccctgaaaacgcattcagaaaagttagtcacccaataccattaaaacataaatccctataaaatttacaactgatcacagtctgtgcctgcttaaagccaaatgtatttaacaattattttcacaattttcacattatttagctcagaattctttaaaattttacatataaaatagccacaaagggtgactaacagaaccttagcagcacatggatgtttgtacccccaccccaaagttacccaaaaacatttaacctgtgacctctgtaggaataacacatggagtaaaaagaaagcaaaaattaaatataaataaacaggaattaaggaatgattaacttcatgtgtttgaatactgcttgacattacctgaattgctaaacattttgttatttttggattccagttatttattgtgagcccacttgcaagccaggaattactcaagcatttgtcatacgttataaaaacaatttctcctggccaggtgcagtggctcatgcctgtaatcccagcactttggaaggccgaggtgggcggatcacttgtggccaggagttcgagaccagcctggccaacatggtgaaaccctgtctctactaaaaatacaaaacttagccgggtatggtggtgggtgcctgtaatcccagggactgaggcaagaagaggcttgaacccgagaggcggagcttacagtgagccgagatcgcacaactgcactccagcctgggcgacagagtgaaactgtgtctcaaaaaaataaataaataaataaataatttcccccataaacaaattttcagaattacctttaaagttctaaactttgcacgtaagaaatatagttttaacgtgttctaacatgaatattgttttaacatgaacaaaaacatgaacattattttaacttctaacactgttttaacatgaataaaataggtaactctggcagttgttgcttttacaaaatacaggatcaaaacctttgaaaatgaatccaagctttaacttattttatccatagattaaatcataccaaaggaattaaaccatgtttttcttattaacagacttaaaatgaatttcaaacacaccactttacctgagataggctggttgttttcatctctgtaagcaagtcaaagccatgtctcactgtcactgcaggctggcctgccaacaatcctaccctcatgatggagagtcgaatccgcgttagccagtcctgacaagtttggcaactggtatagaaaaaagctctaatgacctttacgataagagaaagaaaagctcaggactggttcaatttgtaggtaaggatgtctcacctatatataaaccaaatacacaagtctattgtgatttcagctctgcacatactgccagctgtgaccattaaactgctataaaacaacactatctcccggaaaccaaccttgggaggtgaagttaatgcattagcacatccctcatatacattatacattaatttctccagattttccagatactgcagaagaagaacaagtctaagttggttgttaccatggccttcatcattgtctgcagttgtccactgactaacatcctgatcagggtttaatgtgtgagctgcgagacttcgaatgatacctgaaagcaaagacaacattctgaatttttaaaaatcttaaagttcctagaataagtgtgagttttttatgacaaattcacatttatcaagtatcctctgtctacccatcatttaaaaataaaaaatcccaacatgaaagatctttcattttaggggaaaaaatatatatatattttccacacaactcccataagttttggaaaaaaaccaaacatatttccaatgcaattattcaatgaaagcttattctaacaaacatacctgaaaattattgactttttttcaaaaaaaatcatatactctcaaatctttaacaaagatttaaaaatccattatttcttaataaggctttgaaagtattcacatcacaaagcttgagcgagttaccttcaattgtctggaaggtgtcttgagctctgcccagtggggttctcagcttagaaagaacagtgaattgtgcagcttcccatatggcccactgccaaaagatagcatctgtcttcaggagattgcgtggaattgttgactggtcacacttatccagtctctggcagctatagaacagtctttccaaccaattgtccttcctgggaaaagtagtttcatatttaaaagacaatgacaacttcattttaataatgaaaaaaaaaatgcaaggggaatgggaatacggaactgtaattttccctactccaaaaaaaggcaaaacctatgaaattgagaagcattatgtccccccctctcattttgaggtcttttatagttaacaggatgaggtacagtgtggaaggatgattagggtaaatggctcatgccagtcaggaatgaaactcattcaatgcaactaagcatctctagaatatctccacccccaccccactccccaaagtgttaatgacatcacatcagttaattgttaaccacatttcattactcaatttcaaagcccatttttgtttctacagatgctatcttcaaagcaattttcctattgatgaaaactgaaataacccatatgagaagaatgttacttgatactctgccacccccaaacatattttctcttcaaaactgcatgtaaagtcaagggaatcttaaaattatctttcccagataaaatagtcaaagaaatgccttaccctgttctatgagagttcccatacaaaataaaactaataacatcagagaaatcttgggggtggaatgtattacttggtgctttactcatgtgacttcttaatgctaaagaaatttcttgaatttctgtgtgattgttattgctgtagacagaaaataaagttgttgttatgcaaaatattttagcttaaaaggttagcacctactgtaagtggattatttacttattaactcactggaggtaaaaatatagtaaaatagagactttaaaatggatacagagatgtgattacaactttagatcctttttttattcacctcagatgggtaatgtgccgacatcataagaggatttgagggaggcatatcaaacatgtgaacataaaaacccaatcattatgcttatgtattacaaaaggatcaagtttaggctcttaaaagctcccaaatcaacttgatcaaaaacaatgaaagattactgtttagtttttcaaatatctgagctactaagaaacatattttggcactacatgagttattctatactaattattgtgagcctataaagctcattaaaaatttttaattttcttgcagaactgcaaaatttgattatttgacatcacttcaatcactggcaagcagggccataaaagatgtgtcattaatgctctaataggtgatctgtcttctcctaaagtagacaaccagtagaggctgtaaatataacagaatgtctttgctccaaaacaactgttataccttaggacaacatctaaaggaattgatttcaacagttttccaaatgcttgtcgaatacgagttccacggtgcactagttgaacacggcaaacatcaacacatctatgaaagaacgaaatagacaaagcaggtgtgttaacatttccaggttattagggttaatgtcaaaagacatgatcttaatttcatacctctgtaaaagatcatctggcaaggaagaggacagagcgtgtagactgctgcatgcctgcagacagatattcacatcttcaacgagagctattaaacattaaaagacagttactttcagctggccaaaagaaattatatcccagtttgtcataattatctgaatccattcattcattcaacaaagagtgagtgcctactacagactaggcactgttcttgtccagaatccttattgactgtcacatttggaaaaatgacacattcaacaaaacccatgtaatgtaactgatgggtcatcacacaaacctttttctgagagaaaatgtaaaagtatatgcaaaatataaacattcacataagcttaaaaatgtgacaatcacttcaaaacatttttctaatactaagaatgaaaaaaatcaagactgtgtatctgtcattaaaatgaggattacacatcttcaggtcaggaaaagagctcgattgatgaccatctcccattaccaaagacccttttaaggactgataaacaaaatagaaaaaaaaaaaacagagtcttactgttggctaaaaggcctttgcaaaatttatggaaagacggaagacagaataaaggtgcatatgtttcggacttcttcattaaaacagctacttccaaagcccaagtcattaacagtttcctgaaacacaaaatatacagttgactgtacacaaaaaaaacaacaacaaaaacaaaaaaacgttaaaagcctagtcttcttacattggttttctcttggtttttcaaacatctcaaacaataaaaaataaaaataaaaaatgaaactatagaaattactgtcaaaattgttgtgtgccttttaagaaaacctcccaacgcagcataatagcaaagaggccgggcatggtggcttacctgaggtcaggagttcaagaccagcctggccaacaacatggtgaaacaccatctctactaaaaatacaaaaattagctgggtgtggtggcggtcacctgtaatcacggctacttgggaggctgaggcaggagaattgcttgaacctgggaggcagaggttgcagtgagcaaaactccgtctcaaaaaaaaaaaaagcatagaatattaaaaatctatatatattcttctatgaaacactgggggtgagggattgaggtttttcatgtatttcttttcagaaagaataagaaagcctagattaaataataaaaccaaattataaggtgtttgacaataaagaagctgctctacctcacctctataatccacatttttttaaatgttttgtaatccacatttcttattctcaaattataaaggcaaattaacaaagttaggaatagttaatactatataatatctgttacctcgtgtcctggttaaggttatctttcttaagtaatattcccagaagatttaacataattgagaaatgtttctttgtggccgtagttacagtgctaatcacagctccatcaaacaaaggaggagaggaagaactgaggctactagagataaagtgatcatgcctgaaagacaaagcatagattatcttttcatctttaatcaaagaaagcaagcaagcccaaagttaaatcaacatacatctttaaaatctatccattaaaaaaataaaatgttttgtggggttcttttgttaagaaaaatttgtgaatacagtacctggtacaatgagaatacaaagtgtagagcacagcatactgaatggtagggaagtgaacagccaggtcactgtgcacaatcatcagattcttactcagaagtgcaaagacagttggagatagcgcccacatctgatcatgtacaaaacaaagtaagtttatggcttctccaaaataagcacaagcatacagagtttatccttcaaaacaggggtatttggacatttttaaattaaaattacagactggaagggatctagtacactacacctgggacaaatactcttttgtgaagtcagtaaagcctttgcgtgcaatatagcatctctatgcaatgcagcaactcctcgtctatcgctacagtaagaaaacagccacaggtcaggtgttgtggctcacacctgtaatcctagcactttgggaggctaaggtgggcagatcacttgagcccaggagtttgaaaccagcctgggcaacacagcgggaccgcatctctactaaaattacaaaaattagctgggcatggtggcgcacacttgtaatcccagctactcaggaggctgaggcaggagaattgcttgaacttgggaggcagaggttgcagtgacccgatatcataccaatgcactccagcctagatgacaaagttaagactctctctctcaaaacaaaacaaaacaccagccacatacaaaacacaggaatgagagtacctgtgttccaagaaaactttcttgagtcggagtctctcgctctgttgcccaggctggagtgcaatggggtgatctcagctcactgcaacctctacctctggggttcaagcaattctccctgcctcagtctcccaagtagctgggattacaggtgcccatcaccacgccctgctaacttttgtatttttttagtagagatagggtttcaccatgtgggccaggctggtcttgaactcctgagctcgggtgatctgcctgtctcagtctcctgagggattacaggcgtgaaccactgcgcccagcccgagaactttctttacaaaaacaggcactagtgttgtgatggttgtacacttctgtgaatatactaaaaatcagtgaattatacacttaaaataacaaacaaaaaacaggtgctgggctgtatttggcccacggaccatagtttgctgatctctgatctaaacagagccctttgtatgtgccttttgtggaagtagactgtatttcctcaattttccatatactgcaaatggcaaggtgccctgttcaataaggaaacaaaggcacaccctgccactctacaccttttccatccatctttttcctttacactgccaagacactccattccacctgactgccccatccccacccactttctccttatttctagagtacaggacataaacatctttgaatctgtaaataatgtgaataattttcctcaaaaatcaagctttcatgtttgaagaagagtttattgtgacttcaaacataagctgtaactggtaataagcgaagcagctatggaattatacaaggcaatccaatcaaacaacacggagcacattgaagcgcaaacatcaaattttaccttcttcctcctaaaaactttattccctaattacatccattactttctttctttgtttctttctttttttttttttttcttttgagacagagtctggttctgtagcccaggctggagtgcggtggtgtgatctcagctcactgcaacctccacttcctgggttcaagcaattctcctacctcagcctccaaagtagctaggattacagctgtgcaccaccacccctggctaatttttctatttttagtagaggtgagctttcaccatgttggccaggttggtctcaaactcctgaccacaagtgatcagcccgacttggccttccagagtgctgggtttacaggtgtcagcaaccatgcccagcctacacctattattttctattaaaaataatgtttttcaactctgtgtggtccaataggaagaagaaatacacaaaccataaacaataaatacaaatcaagagcagggccacgtcaaattacttaaaaaaaaaacacacacaggctgggcgcggtggctcatgcctgtaattccagcactttgggaggctgaagcgggtggatcacctgaggtcaggagtttgagaccagcctggccaacatggtgaaatcaagtctctactaaaaatacaaaaattagcccgtcatagtggcaggtgtctgtatctcagctactcgggaggctgaggcaggagaattgctggaacccgggaggcagaggtggcagtgagccgagattgcaccactgcactccagcccaggtgacaacagcatgactctgtctccaaaaaaaaaaaaaaaaattcccccccccccaaaagaaagactaaaggttgagtatcccttattcaaaatgcttgggaccagaagtctttcagactttgtatatgtttggatttgagaatacctgcatatatataaaatgagatatgtgggggatgggacccaagtctaaacacgaaattcacttatgtttcatagacaccttctattcatagcctgaagatcattttatgcaatattttaaataattttgtgcatacaacagtttggactcatcacatgaggtcgggtttggggttttccacttggggcatcatactggtgctcaaaaagtttcaaattttggagcattttagatttaggattttcagattagggatgctcaccagtaagtgttatgaaaatattccaaaatccggctgggcatggtggtgctcacctgtaatcccagcatttttggaggccaaggcaggtggatcacctgaggtcaggagttcacaaccagcctggctaacatggtgaaaacccatctctattaaatacaaaaaaattagccaggcgtggtggcgcatgcctgtaatccgagctacttgggaggctgaaacaggagaatcgcttgtacctgggaggcggaggttgcagcgagccaagatcgcaccattgcacttcagcctgggcaacaagagtaaaacactatctccaaaaaaaaaaaagtattccaaaatccaaaatcaaaaacacttccagtcccaagtatttcagataaggaatattcaacctgtatgaatgtttctagggaaaaagagacagccaaaatataagaccatgtataagaactaacttcagtagacagaaagaaaaaagtaccaggggaagaagaaagagaccgcattttaaaacaactatacaaatttgagctgtaagaaacactgacattttctataagcatgctagagcaaacaggagaaattcataagacattttctagaaaataaaactaatataaaaaaacttatcaagatttgtcaaggaaaaagaagaaaagttaaatataatggcaagaaaacattcctaccaattttatttatccaggcatgtcttaaatatggctgtttgttacatggagaaaccttaaatgcatactggtaagtgaaagaagccaattgaaaaggctacatactatatgactccaactacatggcattctggaaaaagcaaaatgatggagacagtaaaaagatcaggggttgccatgggcttaagatggagggagggaggagtggggagagggaatgaggaaggagtgggtagaacataaaagatttttagggaagtgaaactatcctgtatgatactggtaataggggatacatgtcattacacatgttaaagtccatagaatacataacacaaagtaaactatgaaattagttaataataatatatcaatattcactcctttgtaataaatgtaccacactaacacaatatgttaatgagggggaaactgttgggatgaagaaggtatatgggaactcattgttttctgctcaattttctgtatatctaaaaaataaagtcttttaatttagaaaaatatatctaagctatattttaaggccttaatactgtgacattaaagtgtttagacacctaaataggacacacttattttacagttatcatgggcattttttcacattagcaaagagaggtgtaattctggcagaaatgctcagcagaatgtcatctagaatttgctttaaaataagccagttagagatgaaaggatagcaaagaggcctagatgaaaccagatgggccgtttgcttctaattatagaagctgagtgttaaatatgtacaaatttattatactatgctccctatttttatgtgcttcagaatgtccataataaaagtggggggaggatatttatggttaagaaattaaaggaggccagccgggcacggtggctcacgcctgtaatcccagcactttgggaggccaaggcaggcagatcacgaggtcaggagatcgagaccatcctggctaacatggtgaaaccccgtctctactaaaaatacaattgtgccactgcactccagcctgggcgaaagagtgagactccgtctcaaaaaaaaaaaaaaaaaaaaagaaattaaaggagaccaggcatgactgctcacacctgtaatcccagcactttgggagggcaaggcaggaggattacttgagaccaagaattcaagtccagcctagacaatgcagtgagaccccttctctccaaaaaatacaaaggttagccaggcatggtggcatgcatctgtagtcccagatagtcgggaggctgagtgggaggatcacttgagcccaggagtttgaggctgcagtgagctctgattgtaccgctgcactccagccaggggaatatagcaagatcctgtgaccaaaaaaaaaaaaaaaagaaaagaaagaaaagaaaagcaaaaaacaaagaatctggtgcgtagagcaatgtttcctcagaaaaaacgagtaaagctacactgagactagctatcaaccactaaaaatagaggcctggcagagtggctcatgcctataatcccagtactttgggaggccaaggcaggtggatttcttgagcccaagaattcaagaccagcctgggcaacatggcaaaactccatctctacaaaataatataaaaaattagccaggtgtggtggtgcacgcctgtagtcctagctacctggggggctgaggtgggaggatcacctgaacccaagaggtcaaggctacagtgagccaaaatcatgccactgcacttcatcttgtgcaacagagtgagaccctgtctcaaaaaaaaattgcattaaaaataaaagtaaatagacactaaaatgaaggcatagattataagactgatgaatgtactctaaaaaaataatataataaagcaaagcccttatgttttttcttttttggagacagggccttttttgtcaccttggctgagtgcagtggcacaatcagagctcacttcaacctcaagttcctgggcttaatcgatcctcctccctcagcctcccgagtagctaggactgcaggtgcacaccactacaccaagctaatttttgactttttgtacagatggggtctcactacattgcccaagctgtgccagaattcctggatgccagcaatccttctgctttggcctcccaaagtgctgggattacaagcataagccaccatacccagacaaagcccttaatttcttacatatcgatttaagggcctgaataaaccaacacattaaaaaggaaaagaataattcacataccagcatgagtaaattcaagactgagatgatataatcggtaccacaagtctggcaattctccagttggtctaatccatatgtaatgaccatgtcacaatgtatagtcatgctaggatccaagctgccgagcaaaacaccaacacactcattagcagctgtcaacacagcctcagaaaaaaacacctggtttgcagccgtcacacatctcattactctgtacagaatctgtaaatggggaaaacaagcagctttttaaaaaaattcacgtgcttccacaaagcaaggaaatactttttatttaatgcaatttcaactgaaaattaactgcttgccttgccagcagtctcttaatattctagttctcagtagctgaataatgatacctttactacaatatgtaaacatgatcttggctaaaaaatcctaaagtgctactatgacaggaaatggaatctgccatcctctatttcccatatacccaacttcgtttctcccaatgtcactaaatggctgaagctcagaatctttatcatgaaatacaccacgacagtaatggtattgacagcatgggaatagcctgcccacacatactacaagctagctcttgggcttttgggaatcaatctttcaaaactgaacatacaagtcactttaagcttattaaactttctatctactgatggtctcttttgaaagataagcactctcatgcttaccacatagtatcttcaaaaatcatatgatttccaatacacacacaaacaaaatcccccacttaactataatggccaataattgtgtactaaatttctaataaaataggggagaaaacagagcaaatgttaaaaaatacttctataatatttaacaaccaatacatacaggattttatttagtctacccataattttcattaaaagtatccttggaggttgggcatagtgactcacatctatcatcctagcactttgagaggattagctggaaggttctcttgagtccaggagtttaagaccagccatgtcaacataacaacacctcatctctaccaaatttgtttttaaattggttgggcgtggtggctcacaccagtagtcccaccaactacttgagaggctgaggtgggaggatcacttaagcctgggaagtcaaggctgcagtgagccaagatcgtgccactgcactccagcctgggcaacagagaccagtggctcatgtctataatcccaacactttgggaggctgaggtgggaagactgcttgaggccaaaagttcaagaccagcctgggaaacactgagacgccatctctacaaaaataaaaaattagcaggagctatggtgggaggatcacttgagcccaagagatagaggctgcactgagtcgtgatggcaccaccccactttaaaaagaaaaaaaaaagagctgggtatggtgacacccgcttgtagggctgagtgaggtgggaagttcacctgggcccaagagttcaagactacagtgagctatgattgcactactacactccagcctgggtgagagagtgaggctccagctccaaaaataaataaaaataaaataaaaaaataaaaaccccaccattctaccattctcaaaggcctaaaagatcctcataaatcaatatacacctatcctataaattatgtcccttttattttatgtctgaattaacagctttttatttcaactctgtacagtcttcaaacaaccaccttttagacattaaaaatgaagcaaagatattaaaccattttgaaaccatattggtttaaaataccgatatgctggtttcatttatctttaagttctgacatttctgctcaagtacacaacttactatataatcaatatcctattttatttagcaacatgttcagcaaaagtatatgctcctaaaagcaagttttatcctaacggtaaaattttcatcagttagattaaattttttatgactgtatcacacatgcttctttctccttattcacagccgagtacaatgcctggggttcatttcttgtgtcttttccactgaaccctcattggatgtgctatatacagtgcagctaatgtttgaggctgctgaagtgtggcaatctatctacctcatttttaatttgtttatgttctttgatatcaggctatcaaagaatataaagatatacaagttttcatatgagttccatcttatgctcagagaagattactttctgaggcttctcctatagtgtgctattcgtaatatgttgaaaaactaaaaggaaacccaataatttaaaagtaaaattataagaaatattatttaaaaatgaaagaataagatttaaaaattcagagtggccttttgtcatgggagggtagggaagttggatgaaaggaggatgagatataaaaggattccctgcttttctggttatttaagaaagcagtcagacaatatatacatatacacatacatacatacatgctaaacaaatgaaggattaataacagttcacctggtaaagagaagcatttacaatgtaaaacaattttatttttgaatgacacttcaaatgcccaaaagcacttacatctgttacgtatgcctcagtaatcggaggacccgaattgggctgaagcgttccccaatgctcctcaccacagtactaaatacccggagaagcgcagtcagctttggtaatgacactgatggaggagggacgtcttcatccactgattccccagaggccacatggctgaggtcctagatgtgaattcacagcattcttaataagtagtacattgtttaaaaaaaaaaaaactctaaaatatttcaatcaattcattttagaatagatttttaggcttttagaaagagaactgtggcccatgagaatattcatgactctgaatataaaaatgggttttacctaattatttcaaaaagccaacattaaacccaatagacaacaaattaaggaaataatctcttaaatcaactcagaaagctgttggggaaaaataaattctagcacatatgctctagttatatgtaggtataaatgaagacggaagcttttgccactcctgaattagtttttggctaaaaatctcattctaggtattctttgagccactcagctcaacagtaagtcctccaaaccaagagcatgcacatgaagagcaaagggagattacaagacctggtctacagatgtgtaactgaagaagtacgatatatgaaaaggacaagattcgcaaaaactaggatactagaaccaatctatacatttacctaaaattaagcaccaaaataacagaagagaatgagatcttaaggataacaaggggaagcatctctacaaactagaatgtgtggcttatgagaggtagatcagctttaaacgtgggctgtgaaaaaagacattctaggtgtgggggcaaagaaaaaacaacacagaagcaaaacatttccttgcttttctaggaaagagtaaacacatcagtacagctaaaggtactgaattcctgttgactacaagcagcaaagatgataaaaacaagatgaggccaaaatctttatgggagccttgattggttgatctgaataggggagaaacacaaagagattcagataagagatagcacagagttaagccatgacagtggggccagaaaagccaagtaccagtaacagaggcttcagcagtgctcttaaagctcctatgctatattcgtacagccacaaaagctggctgaagccaaggcctgtcctccaaagtacgattcagatctcccgtacatatgtaagaggaaaatctttaggagcttttggtgttttgtgtttttttataacacaacatcaatttgctttaagactctgaagactgggaacaaaaaataaaaataaataacaaaaaatgtctttagaaaaataccagctaccaagagtatgtaaagctttgcgaaatacgaagcttgcaacgtttcttttagtctctccagtaattctcctggtaacttaaatacatctgaaataaatgtttaaaatactgactgagcacgggggctcatgcctataatcccagcatttgggaggccgacgcgggtggatcaccagtggtcaggagtttgagaccagcctggccaacatggtgaaaccccgtctctactaaaaatacaaaaattagctgggcatagtggcgggcacctgtaattccagctactcaggaggctgaggcaggagaatcatttgaacccaggaggtggaggttgcagtgagctgagatcgtgccattgcactccagcctgagtgacagagtgagactccgtctcaaaaaaaaatttttttttcaaaatattgcaatgggcttgtaatttctgcttaaatgtcaggaggtctgagccattttaaaataaatctagcacaatttaagattttttcttaaccaaaattttaagaaacagctttctatatactcacctcagcatatgcttccatgtcttctagaaaatgaccaagaagagtcgtagaaaatgcaagatcagctacccaaaatggctccaaactctgcaaccacccttggaatcgtataagaaattgtgaaagggtggggggagaaaaaacaccaaaaaatccaaattaaaaaaatataagaggcttgttttaaaaagtatccggttttcaagcagcataccctaaaacatgtcctatatcataaaattaagactgctaaacatgctgatcacgattaaccaatacctctttaattaatacctctttaatttctgcaaaaattaacatgtaaatgttatttccttactttttcagtaaatttcctatctatattgtcactacacatgacttaacactaaaatgccacaatctaccattggcctggctaatcccagggccacatctaaccattaaaggtgtatacttatctcctcagtgaaaatgaaacagaccactatcacctgaatatcctattttcaaaagtttattacaccaagtaagttacgagaaactatgacacttgaaacaagctgaaatgtgcaaatgagccatgctagtcattcacttaactccaaaaaaatgggaaacaaaaccatttctcatttatgacaattctccaaattaaccctatttccttttttaaaaaaataaccagaaaaacaataaaatgttacaaataacttggatcttccattgtccacttcagggtattgccactgcaatatattcttaccatatactttttcctaccagtacaaactacaaataacttgggtaagtcctgtctgtacttattctacccacctactagtaatttcttctgaaaatatatatttagctaacaagtaatgttcatttacaatataacatttctctgaattagttttcttgcattattaaagaaatgttattgatagatggtcactgggggaccactgctcctccccgacagtatttaaataactggtataggctgcaagacttaccagatacctgctgcgtgagcgaaggtttctgagtatgatctatatgccatccaactaatatatcaactgtatccttgatggaaacaaagagagagggggccaatcattttaagatattactgccattcacctgtggaccattccacagcaaaagatcctaaaaggagcatctatgttctacctactcaacattctagaaacttagaaaggggagaggggcaggaaaataaaagaactacatttctgacaacaatgaaatagtttattttcttcaaatattttaaggtacgaacgtcagaaataaaaatgcagcatttaaccctggaacctcaaatatcactgattatactcaaaggagcagaggcattgttttccatctgattcctcagttcctcacacacacaaccatccccctcaccccatgatctgaaaagcgaaatgaggaattcaccctaaaattagtgtggagaaaacaagcaaattaggttatttactaagtgactacataaaaaactgagtatgagaccaagaaaaatagattctgtagttttagttaaaaaaaaaattgacttgtaaatcccaactactcgggaggctgagacacaagaatcgcttgaacccaggaggcagaggttgcagtgagctgagattgcaccgctgcactccagcctggacaatacagccagactccatctcaaaaaaaaaaataattaataaataaataaaataaatatactgaaaatatttcactccactaagatgttaagctaaaaacaaatactgttttctcttcttcaatgtttgttaacattagtccttaataacatctgtttacaatatccctaaatgctctctttaagattccacctgtgattaaatttcaaatacaaaaaagtaaaacggatttgggaaacttttctataaagtacagcaattaatttgcaatccaaaatataaagcaaattttatataatttatgctttactatattagtacttgcttcacattaaaattaaagatcagtatggcaccacacatgaataacatgcaggctcaggttaccattatacataaatttttaaaataaatatatggcaaaaataataattgtcattccattgaaagaatatttattttgcagctgttaaaagacatttttccctaaaaaaagaaaagctgtgctttacatagcaatcttataaaagaaatgctagaatcagaaaaccatcattttaggctgggtgcagtggctcacacctgtaaccccagcactttgggaggacgaggcaggtggatcacttgaggtcaggagttcaagaccagtctggccagctcgatgaaactccgtctctactaaaaatataaaaattagcagagcacagtggcacctgcctgtaatcccagctactcaggagggtgaagcatgagaactgcttgaacctgggaggcggaggttgcagtgagccgagattgtgccactgccctccagcttggacaatagagcaagatttcgtctcaaaaaaaaagagaaaaagaaaaccattattttgcaatagccaatgttataatctacacaggcacagactatcaatgctaaaaatcatttaaaagacatcttaggggtaattacagaaatttgaatatagaacacatatgtaataaaattcattttcttaggtatgattacaatattcttgttatacagaagaaaaaccttattcttgggagatgcaaactaaaacattatgggttgaactgtcatcatgtgtatggttttcagatgctcaacaaaagtgtgtgagaaaataaaactggcaaaatattagtaactggtaaatctaggtgaagcatattattatgaaattattatcgtatttacaggtatttattttactggtgcatctatctttctatgaatgtgagaattttcacaagagctgggaaaatgttcataattatgcatgcagaataagcccaagctggtggcattctgttcagttacaggtaattttctgaatcttccctcaaatttttctcaaacctctataatcaaggggaaaaatgttttgttttgctttgcttttttgagatagggttgcctataatggagtgcagtagcttgaccatagctcactgtagcttcaacctcccaggcacaagcgatcctcctgcctcagccttcaagtagctgggactacaggtgcataccaccatgcctgacttattttttttccttttttttttttttttttttttttgatagaaacagggtttcaccttgttgcccaggctggtctcaaactcctggactcaggcgattcaccagcctcagcctcccacagtgctggggttacaggagtgagccaccatgcccagttaaaaatacactttttatttaaaaaaaaaagagaacactccttatatttcctttatattttgtaaactacatacccaaaataaagcatatcaaaaactgtaaaaaaaaaaaaaaaaaaccctaatatcagatattccagacacaacaataccataatttaatcacttaaaatcttactcaaaactaaatcaatgatcttttaggccaggtgtggtggctcatgatagtaatcacagtactttgggaggccaaggcaggaggatcacttgaggtcaggagttcaagaccagcatggccaacacaatgaaaatccatctctactaaaaatacaaaaattagccaggctaatggcacactcctgtaataccagctacttaggaggctgaggcaggagaatcgcttgaacctgggaggcagaggttgcagtgagccgagatcatgccactgcactccaggctggacaacagagcaagactccgcatcaaaaaaaaaaaaaagatattttaatatattcagatacacaaatatgaaataaaactaagtagagctggtattcatttacacataattatcttataccgtttggaataagaatttggggcacgttagcaaaccaaaaggctcagaaagacgtcgtgatatttagttcttgtctccctctacaaatgtgaagcactcttctatccggcattcctagtggagttcctattttcaaatttgcaaatcattctggtgctaagcaatctcaaaaaaaacatttactaaaaaccagaggaaaaaaatcttataactttgggaggctgaggcagatggatcactgagatcaggagtttgagaccagcttggccaacatgatgaaaccccatcttctctaaaaatacaaaaagttagctgggtgtggtggcaggtgcctgtagtcccagctattccagaggctgaggcaggagaatcacttgaacctctgaggcggaggttgcagtgagctgagatcgcgccattgcactccagcctgggcaacagagtgagactctgtctcaaaaaataaatataaaaaaataaaaagctgctattctccattaatacctgcaggcccgacaaaggcagcctaggaattctagatgaatggaatgaatacaacttgctggaagttcttaggaaacaaaatgactattcacagaaccaaataaaagccttccactagaaactaaaaataataataataataataatggttttatatatatgcatacacaagcaaagccagaagagaataaatagcaaatgaatgaaaactagaagcaaaaacaaacaggaaaccatctctacattttttttactcaatcgaccctgaatgctacagcattatccagggccgcagaaaacacacataatactttattcctgataaacaattcgatgtccttaagtccgccaatatcaccgtacattctgtgcaatcaagaaatttactcagctgggcacagtggctcacacctgtaattccagcactttgggaggccaaggcgggtggatcacctgaggtcaggcattcgagaacagcctggcccacatggcgaaaccccatctctactaaaaatacaaaaattagcccggtatggaggcatgtgcctgtaatcccagctacttgggaggctgaggcaggagaatggattgaacccaggaggcagaggttgcagtgagccaagattgcaccattgcactccagcctgggcaacagaacaagactccatcaaaaaaaaaaaaaaaaaaaaaagaaagaaagaagaaaagaaaattagccaggtgtggttgcatgcacctgtagtcccagcactttgggaggccaaggcaggaggatcaatcaaggctaggagtttgagactgcagaaagaaaccctgtctctaaaaaaaaggtccaggtaatttcagggtccagctccaccacaagcgcagctccaggggctgttgagttttgcctttatcattccaagtagtccctgctccagaccaagtcccaccatctggcagtcaggtcagtccaaccacagtcatatcagggcccttccaggaattctcgacgcaaactggaggccgatggcgcgggtcttttcgtggacggcggcagcacggtcctcggcttgcgtccgtagttgctcaggcttctggttcagggctgggcggcggcgcccctgcggcgggcggcccgcaccaggctctgctgcagcacggggtagaggcgctggcagccctcgaggcccaggcgtacggcctccgcccagctctctgtcaggccgccctcgccgctgcccagcagcccggccacctgattcagcacaggcatgagcgccacggtgaggccggcggcggcgcgctcttcctcgagccgcgtggggtccaggagccaggtgggcgcgggccccggcgcgaggctgaggccgcagcccaccaccaggtcgtacatctccacgcccgcgtcggccagggcgagcgcggcggcggtgagcgcggcggccagggccgagccaccgtcctccagcagcagcgccgacacctcgagctgcgcgcgcgggtagcggcccaggcgcacagccggctccagcgcctcctgcagcgccagcgccagctcacgctcctcgcagccgcccgggggagcgcggcgccggcggcccgcgaagggtgcgcggcggaagtcgcagagcaggcgaccgcgcagcgcggccggggcctcgccgcctgctccggccgggccgccgccgcgctcgccgccctcggcctgtcgcgggcccgacacggcacacagcaccttggtgcctcccgcctccaggtaggccgagcccttggcctggctcagcagcccggcgcgcgcgtacacgggccgtagccgcgttgggtcgcgggtgccgggcgcctcctcctcgtcggccgcgtacagctgcggcggctgcgattcttcagggccgcggatgcggcggtgatccccaggcatggcggttcttggcgtgcgaaccccttccgcccaacgccctgccgcatccactggttcttccgttgtttaaagacgcgcggctgcgcatgggctgtcgagagagcggcgggaggcactacagcgcccctggaggcccggagggagaacggcccggtcccagttgtgcagggtagccggatccatccatcttgctggaagggaggggggagagcagctccaagaaaggcttctctgcttccaactacctccacccctcatctactgaattatgaacgccttgctccaagtcaccccacctatttggcctccacctccacagacgtttgaggcagccctaggggctgttcccaaaattttgggttctggggctggactaggtgaacaccacagcagccagcaggagccacagcatttattctacagacgccaaaggctgtcaaaagagccagcccctattgggaagagggatagagatcatgcggcattaagtattgcacgtggtccttttattctctgcagcaaaaacgattcctacttgctgacgcggaaagctcaggtctggagagccgttatctatagatgcgagcgtgacgatcaacagcaatgcggggttagtggttctagaccgatggcactgacgtggagggctcagggcagaaatttaaggggcactgagacataggactgctcccaagtgtgttccagttactgctgggttaggaggggctctttaaaggtcccaagattcaaatgttcttgtagcagatgaagagctcttggctggacggatggatccagtgggagcctcctccttccccactcagttctttacatccccgaggcgcagctgggcgaaggaagtggccagctgcagcgcctcctgcaggcagccaacgttcttgcctgtggcctgtgcagacacatccttgccaccacctttaccgtccatcaagcctgacacctgctgcacccactcgctggcttttaagccccgattggctgcattctagaagacaggaagggaagggggagtcagcacagaagatgggattgagggaggaatgcagggaaagaaaggatggaggagccatcacccactccttgccctgggtgatactgctggaggccgagacagactttacggctggtacagggggcggccatggccactgccaggacaggacagagtggcaaagccaggtatcaaccagatgtcttcaccaataagaaggcctgggtaaggggtactggcaaaggtaaccaaccggtgggcagaaaggctgtttcgaatgcaggctgtacacacacaggcctcagccaacaaccttaagacctaacacttcccactggtgcgaggtggtgctgacctggggaacttgacacaggcacgtgatcttgccagcctcattgtccaccgtgaagagcatggcagaagtctgaggggagtgcatcttgaagagcttcaaggcttcattcagggcctgtggggaggacctggctcaggccacggtgctggagcagggaccctcactagtgtgagcatttgcagccctcagaaggcctgccacccacccctaccccttcccagagcaggggctgtgcccagggcctgtggggaggaccccagcgccgggccctgcccctaccctggcccaggtatgcctcccacatgcagggagctgctgctcctcccaatctcaatcccagaccgtgggcccttaggcaaccacttcgctcagagccacagaggccacatgtcagccaccagagagctgatgagccctaggggaggggaccctggcccctgggttgccttggctgaggcgccgctctccatctccaggatgacaagaggctggttggggttgctgtcgatgaactgcttcgtcttctctaacacctgcaagaaaaaagtccagaacagcagctcagaccaaaagcccaggccccgaacccctggctgttctgccagcctttgcctaggaaacactctggccactggtgctgccaggactcactcgtttctggacatcggctttgctggctcggtccaagtcatccatgaccttctttagggatttgagagtctcccgcaattcatccttctgccactgggggatgactgcagtggccagggcctggaaccaatagacgaccatctcaatctgggccacaacttgctgggatgtcagggtccagcccaccccacccgaacccaagtcctccctgactagtgtcctggaaaggaaagcaaggaaagctttgagaccagtccctttaggagcagctgtggcaggtgaaacaagcagggctagagagaaaggagcagcagaaagctgggctcccaaatcaggcccggtccttaccaggctgggaacagcctgtgataagcttcctggcagcttgaaatgcaaataaataccaggcaggcttggaagcaggggccagccttagcccattccccaaatccctccaccccagtgcccatacatgcttgggaagagctctcctgctagcagcactgggagcagcagggaatgtccagggtccaaggacaggatccatggggtccctgctacaaggctacaggacaacagaagtcagcccaaaggcccattccaccaagaaccagggcctgactgactacagatgatttcctgaagacggggcatgtttcatgcaccaggccctgaggacggagggagggaagccgcccctacctctccaaggtcagcgatctccctctgcacatccttgtttggagcagtctgagccttcactttggcttccatgacagagagacatttcttcaagctctctgctttcctgagggcctgggaggggacaccgggtcaaccccaagcaggaggtctgagtcagactcactatcctgtgtctgagcagctgcggaagccccggcggtaggccttgcagcaacataccccaacaccccaaaagtgtctgtggggagtaggtgctggcagccccaggccccagcaaggagcacagtgctcacaggcccattggcaaaggctgcacccaactcagactcaggggtgatcaagctcgagaatcaggagccccttcccccaggaagtggccacccctggggctttagcacaagtcagacacaccagttcccatgaaagagcacccatcctctactgcacggcctcagactaagcacgcccctaggagtacatggatcagcgctgggggccccgatgccacagcgaatctatgtcttaccctcctccacatggagacaggagggggtagatggccagattcacattttttttttttttttttttttggagacggagtctcgccccgtcacccaagctggaacgcagtggtgcgatctcggctcactgcaacctctgcctcccaggttcaagtgattctcctgccccagcctcccaagtagctgggattacagacgcgcgccactacacccagctaatttttgtatttttagtagagacagggtttcagtatgttggtcaggctggtctcgaactcttgacctagtgatccacccgcctcggcctcccaaagtgctgggattacaggcgtgagccactgcgtccggcctgattcacatatattttaaaagactaaacataggaaagctaggagatcttgtgtggtggcaggtttcttctgccactcaggggtaggacactggggcagggggagtggcccagcctgtactttcactctgactgcagcagccacgcagagcagtgtttgctctatggattcgcagactgggctcctcttgccttcttcagataagccacaaaccagcctgacctgctcaccttctgggcctcggcacctgtgacagccacaatcctccggatacccttggcaatggcttcttccgtcacgatcacaaaagctcctgcatgactcgagttccgcaggtgcctgaatggcagaacacaaagtccatagtgaaagaggccctggcagcccttggctggggggtcacactagcggacaagagaagcaggaatgggttgacagtcagggaaagcctgggcttgagagtattctgacaccaagcgggacaccagctcgctgagcctgagtgttctcagttctcaaatggggatgattctccccacacagttgctgtgaaaatcaaatgaggtaaacatgaaagtgctttgtggtccctaatatccaatacagtcttacccttaggctctacgtgacagttttggtcttgtagtggaacttaagctccatttttgtattctgctcactaggtgacaattttggaggattacttttaaaatcttaccacaaccccttaaacaggctttatttctcagttcagagaacctcaaatgttcattaattcatcctcattctttgaagatagtatagttttttttgtttgtttgttttgagacagagtcctgttctgttgttcaggctggagtgcaatggtgtgatcttggctcaccacaacctctgcctcccagtttcaaatgattctcttgcctcagccacccaagtagcttggatacaggtgcccgccaccactcctaatttttgtatttttagtacagacaggttttcaccatgttgcacaggctggtcttgaactcctgacctcaagtgatctgcctgcctcagcctccctaagtgctgggattaaaggcatgaggcaacatacccaacccttggtataaagtttttgaaagctgtttcctgtagtctaaagggtatgagcaaacaggtaatcaggcaaagtgggactcgtttgaaggcccaattcagctgggcagaaaagccttgaactcaatcccccaggcccctatcctactctctgcacatcctacttgctccctgcctgccagaggcctgcaggagaccctggagggtctcaaccatgacattaagaatgttcttttcagccgggcgtggtggctcacacctgtaatctcagcactttgggaggctgaggcgggtgggtcacctgagatcaggagttcaagaccagcctgaccaacgtggagaaaccccctctctactaaaaatacaaaattaggccaggcacggtggctcacacctgtaatcccagcactttgggaggctgaggtgggtggctcacgaggtcagaagatggagaccatcctggctaacagggtgaaaccccatctctactaaaaatacaaaaaattagctgggcgtggtggtgtgtgcctgtagtcccagctactcaggaggctgaggcaggagactcgcttgaaccctggaggtggaggttgcagttagccaagattgcgccattgcactccagcctgggcaatgaaactccgtctcaaaaaaaaaaaaagaatgttctcttcatggctgggcatgggggcacatgcctatagtcccagctacttgggaggctgaggcatgagaatcgaagccaggaggtagaggttgcaatgagccgagactgtgccactacactccaccctgcgggacagagcaagactccacttcaaaaaaacaaacaaaaaaaaccacaattcttttcacaaggcttcatttggaagcagaaactttccaggccaccatgaccttcccaaaaaggcccagagagatacagaggaatccaaattggcagaagtggctatcccaagccaaactgagctgagtcaaccacgtggcctgctcgggggctctgagacaatggagctacattccccagatgccgcccaagctgtcaaaggaaattaggtgagataccaggaatgggaagggctaggcccacatcaagagctcaacaagcactccaggccttgctgaatcccaaattcacacaagccttcttgctagtttcagcccagcaaacaacagcaagcaactgtgtggtaatgtgaatacaatgttttcccccttttcctcctgggaatgtttcgtcaggaaatgttaccttcagatacagggatctaatgagcatgctaggatgctgagattcttgggaacgctatttagcaacggcatttctgaggacttcacttcaaccttagacagacaagagttggtccagcctaagacctacatcctcagaggatgaaggtagatgacctgtctactctgcccctctgcagtactcacgttcccccacagaactcaacagaagtcagggagccagcaggcccagaggggtcatccagcaactcggacaccgggaccccaatggagacgactcgcacagggtcaggataggtctcatcaaacacagcccgtaggccctggatggctttcgctgctgccagggggcaatcctgggtatagacggcctgccagaccaagaagacagaaaagagctggaagagatccctggaggtgcggtacgacgaggcaggaaagcatggtcctgcaggcaggactcgggttccaacctggcttggcctagcacgtgccatgagcttcctcaatcacacgccacgtgcaaagtcaagggcatcagtatgggaatttccaactattttgttaaactgtggaccaaatctcatatgtgaacagacttaactagaacagctctggttctcccaaggtggggtgggacaaatgcctctccctctcccctccaccaaccaccaccactgcccccggcaaaagcacagatggagaatcactgctttaaacaaactttttttttttttgagacggagtctcgctctgtttcccaggctagagtgcaatggcgcaatctcggctcactgcaagctccacctcccgggttcacaccattctcctgcctcagcctcctgagtagctgggactacaggtgcccgccaccacgcccggctaattttttctatttttagtagagacagggttagccaggatggtctcaatctcctgacctcgtgatccgcccgcctcggcctcccaaagtgctgggattacaggcgtgagctaccgtgcccagcctgctttaagcaaatctacgtgcaggacgaatctgatacaacagagtgagagcaccgcactgctaagactgtggacagacagtgacggtgtggggagggggggcattcagccgtcgcccatcctaccttggctgcctcaatcatctcattagcaatctcttcagccttcttgatctgttgggtggacatggctcccttggcagtaaagtcaaatctgaggcggtcaggagcaaccaatgagcctttctggtcagcttccccaagcactgagcgcagggcgaagttcagaatgtgcgtagctgtgtggttgctcatgatgggtcttcgtcggggctggaaagggcagaggggctcatggagaggtctgtaatagactgctagttatctcctcgttatctgctcccccgagtgctacaatttttagttggaaatatggctgtgcagaataaaggttacatttcccagcttccctatggctaagtgtgtccatgtgactaagttcgggtcaaaaggttttgaacagaagtgatgtctaccattaaagggatggggcaggtcctcccatttcttttccaccgcctagaacaggaattgccaaatgacggccgatggctaaatctagcctgtcatctgtcttttcatttttagagacagggtcttgctctgtcacccaggatagagtacagcggcgcgattgtagctcagtgccacctcaaactcctgggctcaagtgatcctcttgcctcagcctcccaagtagctgggactacaggcacacaccactacccccaactaatattttttatttttttgtagagatggggtctcatgttgttgcccaggctgggtctcaaactcttggcctcaagcaatcctcccacctcagcctccccaaatgtatgtgtttataaatttttataaacagttttttttttttataaggagtttcgctcttgttgcccagtctggagtgctatggcatgatctcggctcactgcagcctccatctcccgagttcaagcgattctcctgcctcagcctcctgagtagctgggattacaggcatgcaccaccacacccggctaattttgtatttttagtagagacagggtttctccatgttggtcaggctggtctcgaactcccgacctcaggtgatctgctcgcctcggcctcccaaagtgccgggattacaggcatgagccactgtgcccagccataaacaggtttattggaacacagccacacctgttcatttacatatggtcaatggctgcttgaacactccaactatagagctgagtactcatcaccaggaacatgtggtcagcaaagccaaaaatatttagtatccagttatttacacaaagtttgccaacccctggcctagacaatggatctgatagctatcctctgaaccaggaaatcaaaggcaatgccccaggaaagaaggtggagtgacaggtgaggagaaaccaggccctctgactgtggggcagagcctccgtatcagcttgagctttttagaacatacactgctatcctggttttaagctactcttactctggagctctgtcacatgccagagcctacctcttcattcttcagcatccttggctcccaaagaagtaggtgacgttagaaaagcaatccgtgaaaacaagtccacgggatcttaactgaaatcactggtgaaatcactgacttgggaacatatagattaactcttagttgcatccctcacaatccaccaaatgcacctaaattaacccctgcggtctacttacactagggagtgataacagtgacaggacaattttttttttgaggcggagtctcgctctgttgcccaggctggtgtgcagtggcgggatcttggctcactgcaagctccccctcccgggttcacgccattctcctgcctcagcctcccgagtagctgggactataggcgcctgccaccacgcccagctcattttttatatttttagtagagacggggtttcaccgtgttagccaggatggtctcgatctcctgacctcatgatccacccgcctcggcctcccaaagtgctgggattacaagtgtgagccaccacacccggcccaacagtgacaggacaatttaaagccagaggagaagataattactaaccagatccaatgggggccacagtaacccaactcacctcatcaataaacagccagacctgatcccccactttcaggtcaccgtagatggttccaatgtgtagcacataccctcctcggacctgagcattcttcactgtaaactctgttttctaagaggggtcaaggaagagaccaataaataaatccttaaaaacatacaaattttcttatattttcaatataaactcgtgtatataacttctctttacatatgtaaattgcacacacacacatactcccttaatatcattaaatatgattaaataggccaggtgcagtggctcatgactgtaatcccagcactttgggaggctcaggtgagtagatcacctgaggccaggagttcgagaccagcttggccaacatggtgaaatcccatctctactaaaaaaatacaaaaattagccaggcgtgaaggcaagtgcctataattccacctactcaggaggcagaggcaggagaatcgcttgaacccggaaggcagaggttacagtgagccaagatcatgccactgcactccagccttggctacagagcgagactccatctcaaaaaaaaaaaaaaaaaattaaatatatttgtgcacacacacagacataaccaatattaaggagcatcttagaattttttttttttttttgagacagagtctcgctcagccacccaagctggagtgcagtggcgcaatctcggctcactgcaaccaccctctcctgggttcaagcgattctcccctctcagcttcccgagcaggtgggattacaggcatccaccaccatacctggctaatttttgtatgtcagtagagacagggtttcaccatgttggccaggctggtcttgaactcctgacctcaggcgatccacccgccttggcctcccaaagtgctaggattatagtcatgagccaccacacccagccgcatctttgagtatctaaaagcctccataaggaacctgaagcctagggagacaaagtaactcattcagcagcggcagagctcgaggctgagttttctacaaggacatctccccttcagagagctgcctctcctttttaatgtgcaaagcttgtaggaaacttgtaccctggctgcaaaaatactcctacgagggtacccgatggccaggaaagcaacaggtacaagcaacagctccctcggcttcagaaataccatggaacccaacccaaaggtgtgtcaggtctgctcccaaggcctggagcactgtggggcaaaagcagctccccggctccacgcctggccctcctcggctaacaaggaagaactgttggctcacatcttcactgctgtcatccaccttcaccaggtagccttcgtcatagatctggcctccttgctcagcatagaaacaggtcttgtccagcaccactccacactcctggcctgtggacacctcttccacgaacatcttctccctgcgcagagccatcaccgtagccactgtgttctcaaatactgctcaagggaaatgcatagaaaggggacagtggggtcaatgaccttttcactccttcttggctgacttttgctggattctctttcgcaaactcttcttagctcctaattgtccaattgtattttggaagcaaactcattagacaatatgaaagggcttcgcggccgggcgcggtggctccccctataatcccagcactttgggaggtcgaggcaggcggatcacggggtcaagagatcgagaccatcctggctaacacgctgaaaccctgtctctaccaaaaatacaaaacattagccgggtgtggtggcgggcacctgtagtcccagctactcaggaggctgaggcagaagaatggcgtgaacccaggaggcggagcttgcagtgagccgagattgtgccactccactccagcctgggtgacaaagcaagactcggtctcaaaaaaaaaaaaaaaaaaaaaaaaaaaaaaacaacaacaacaaagggcttcgcatgctggctttccatcaaagaatgcaacactctgtcgggtgaccaactgtcccaatttttaggactgaggggtttcctgggatgcaggcttcagtgttaaaactgggacaatgggttaccctaactctgagctactgaacagaaacttggtgcatcagattagtagatctttaagagtagtaataaattccctagtccaaggtcaactcacaaagaatgtactcattttgtaggcttgcttgaatagatttaggtgtaagattgttctcagccgggcacggtggctcacacctgtcatcctggcactttgtgaggctgagacgggtggataacctgagctcagcagtttgagaccagcctggccaacacggtgaaaccccgtgtccactacaatacaaaaattagccaggtgtggtggcacatgcctgtaatcccagttaattgggaggctgaggcaggagaatcacttcaagctgggaggcagaagttgcagtgagccgagaatgcgccactgcactccagcctgggtgacagagcgaaactccatctcaaaaaaaaaaaaaagattgttctctaccagggcaaaaaagctgcaaaaacatgtattgccaatttatttttatgttttttttgagacagggtctcactctgtagcccaggctggagtgcagtggcacaaatatggctgactgcagcctctcaatctcccaggctcaagtgatcctcctgcctcagccccacaaatagctgggactacaggcatgcgccaccacacctagctaatttttgtatttctggtagagacagggtttcgccatgttgcccagactggtctcaaacaccagagctcaactgatcagcccaccctggcatcccgaagtgctgggattacaggcatgagtcattgcactggctttgtttcttaactttagaatactattatccggtcgggcgagatggcttacgcctgtaatcccagcactttgggaggccaaggcaggcagatcatgaggtcaggagtttgagacctgcctggcaaacatggtgaaaccctgtctctactaaaaacacaaaaatcagccgggtgtggtggtgcgtggctgtaatcccagctacttgggaggctgaggccggagaatcgcttgaacccaggaggtggaggttgcagtgagccgagatcacactattgcactccagcctgggcaacagagggagattccatctcagaaaaaaaaaagaatgctattaggataatagcattctaacagcattaggataatagaatcctaatagcattctttttctttttccccgagacggaatttcactcttgttgtccaggctggagtgcaatggcatgatcttggctcactgcaacctctgcctcccaggttcaggcgattctcctgcctcagcctcccgagtagctgggattacaggggcacgccaccacgcccggctaatttccgtatttttagtagagatggggtttcatcatgttggtcaggctggtctcaaactcctgaccttaggtgatccacctgccccggcctcccaaagtgttgggattacaggtgtgaggcacagcgccaggcccctaatagcattctgatagtcactgtggattgtatcaatgtcaattgcccagtttcctgcatgatgttacaattaggggaaactggataaaagggtgtgagacccttcctacaaattttttttttttacaacttcctgtgacaataattatttcaaaatagagttaagaaaacctccagccaagggtgcctatgtgtataaaagtgcatagcgtgactgtacggcactccaggagaggctgtcagcagtctgctggagagctaatcttgagaaacaatctttcaaataccccccagatacggggcagaatgctcagatgtggaaggagcacagcaacataccatagctaccactggagtccaaatggtaattgtactttggggaatcatctgtgacctccagaccccgtgcccggagctcttcgatagcgtaaatgtccagcataatgaggtcttccccaccagctcccttgccctgtgatttcagctgtcagcaagagaaacaagcataagttaccgtaaagtaggagaaaagggactccaaaggactggaacttgctaaactatgcccagcataaactgccagaacagggtttttcaatcctggcactactgacatttggggccagatcattctctgttgtggaaacttctcttgcagtgtgggatgctgaggggcaccctggcctctaccaagtacgtgacagcaggatctgcccctagttgtgaaaatcaaaaatgtcttcagacattatcgccaattactccctggaaggcagactcgcccccacttgagaaccactgatctaggggaaaaagcacttcaaagactttaatggaaggaaactcatgctcagtctgcagccaagtggtgctgggttggaaggtgttgggtttcctgttcactctccaagttctttacctgggccagtttcctctcctcttcaaagccatccatgtctaccaccaggcccttctcttcagcaatcagtccagtcagatccactggaaacccataggtgtcatagaggagccaagcagtgtctcctacacagcacaaaggaggtgtgtcaaaaaaaacagacagccccttttccatgccaagccctccaaaaggatgctgggactggcagaaggaattaaagacacaaggctatcagtatcggccctgtgtgcccatcagaaaatccagcacatctttttcagttaacctgggggaagcacaatggatgtcctgatacaattctgttttgttttgttttgttttttaaacctcacctgggctgggcaccgtggctcgcgcctgtaatcccagcactttgagaggccgaggcgggcggatcatgaggtcaggagattgagaccatcctgactaacatggtgaaaccccgtctctaggaaaaatacaaaaaatttggccaggcgctgtggctcacgcctgtaatcccagcactttgggaggccgaggcgggcggatcaggaggtcaggagatcgagaccatcttggccaatacggtgaaaccctgtctctactaaaaatacaaaaaaattagccgggcatggtggcgggcgcctgtagtcccagctactcgggaggctgaggcaggagaatggcgtgaacccgggaggtggagcttgcagtgagccgagatagcgccactgcactccagcctgggcgacagagcaagactctgtctcaaaaataaaaaataaaaaaaaataaataaaaaaattgccaggcgcggtggcggacacctgtagtcccagctactagagaggctgaggcaggagaatggcatgaccctgggaggcggagcttgcagtgagctgagatcacaccactgcactccagcctgggcaacagagtgagactccatctcaaaaacaaaaacaacctcacctggacaattttctatttctttttttttgagagtctcactctgttgcccaggctggagtgtactggtgtgatctcggctcattgcactctccagctccaggattcaagcgattctcctgcttcagtctcccgagtagctgggattatgggtgcccgccatcatgcatggctaatttttgcatttttagtagagatggggttttaccatgttggccaggctggtctcaaattcctgacctcaggtgatctgcctgcctcagcctcccaaagtgatgggattaaaggtgtgagccactgtgcccagccttacacatctatttctttttctttttctttttgagatggtgtttcgctcttgttgcccaggctggagtgcagtggcatgattttggctcaatgcaacctccgcctccccggttcaagcaattctcctgtctcagcctcccaagtagctgggattacaggcgcatgccaccacacccagctaattttttgtatttttagtagagacggggttttgccatgttgggcaggctggtcttgaactcatgacctcgtgatccgcccgcctcggcatcccaaagtgctaggattacaggtgtgagccaccacacccagctgacaaatctatttcttgatctgaatgtgtgttcaatttgtgaaaattcatcaagcttttcccttgttcattatacttcaataaagaatctttggaaactggggagaaaatctttggaattaattttccccaaattgcaaaacagtacataccaaatattcccacttttgcttgaaaaatacacacacacaaatatctacatgtatttgcatgcaaacagagaagaatcctgaagagttctacaccaaaccattaagagttgttccctctgagaaatgagtgtggaaaagaggattttcattttctgaacacttttgtattctgtattgtttgaatactttggccacaatgatgcattacttttaccattttactataaattccagtttgcaccaaaagcaattcaatcaagctatgttcagcctcagagacatgagagcccacagtcagtctgtcagaaagggcttgtctttcccagaaagatcaaacggccaggatggagaagggcaaaaactggtacctaccgggaatggtcttgctgtctcccaggctctgaattttcctgtccaggatgcgacgccctctgctgagagtcttgagaaactgcacctcttcttcattaatgatgtccttcaccatgtctgggtccttcttcagctcaggaaatgcatctccctgacaaaggggaagcaagatgaggggctggatgaagccagagactgttccctgccccgtcttaaaaaagctccttagctgggtgcagtggctcacgcctgtaatcctaccactttgggaagccgaggcaggtggattgcctgagctcaggagttcaagaccagcctgggcaacacggtgaaaccctgtctctactaaaacagaaaagattagccaggcttggcggtgtgcacctgtaatcccagctattcggaaggctgagacaggagaatcgcttgaacccaggagacagaggttgcagtgagccaagatcactctattgcactccagcgtgggtgacagagtgagactccgtctcaaaaaacagcaacaaaaagctgcttaacagtatgccctctcccactccatccctcttaacggactgctttagcacagaagggtaagcagagaaataaacctaccagggactggacgacaacatccactaacgtagcaaagaagcccctgctggcattgagcttttcatgggcgtatcggacagctcggcggagaatccgtctcaacacatatctgtaagaggcaaaaactagtccccaacgttcccagctgagggttttgtcttgagtcccttggaatcctacccaaagcaacacctctttcaggaactttcttttatcctaagcctgcttctttcgcattccccaagg

SEQ ID NO: 423 - DNA, 106018 bp, Homo sapiens
ttttgtttgggatggtgtgagatcagggaccacagatcacactcttctggctttttttacttattgctgttgaagattagaccttaagggaaatgaattttttttttttccgagacagtcttgctctattgcccaggctggagtgccgtggcgtgatttcggctcactgcaacctctgcctcctgggttcaaacaattctcctgcctcagcctcccgagtagctgggattacaggcgcctgccaccatgcctggctaatttatgtatttttagtagagacagggtttcaccacattggtcaggctgatcttgaactcctgacctcgtgatccgcccacctcgacctctcagtgctgggtttacagacgtgagccaccacacccggcctaagagaaatgaattctgaccctagctttgttgtgtgaataatgtcattggtacaatacaatataacttctcagatttcagagccacctaatcaagctgcaatatgtaccctttcacttcagaagtgagttaattatcagggaggaaatgtctgtaacaggtctgagatcctaacacaggcacaatgaagaatcgaatgccattttttcacattttgttaccacctgtgtcccacttagtaaccttcttctctgctatgaagcttggtaaggtttaggaccctgacctttctgccatcatttctacctactaatgtggaatgctgaatgtgaatacaggccgagtcatgccgtgacacgtagctccagggagggacgatagcagcttggcaggattgtcttttccttctggagcatgcctgatacactgggtaattttgaaaattagactacattagcctggaaattgggccgggcagagtggctcacgcctgtaatcccagcacttcgggaggctggggcgggcagatcacctgaggtcaggagtttgagaccagcctgaccaacatggagaaaccctgtctctactaaaaatacaaaaattagtgtggcacggtgacacgtgcctgtaatcccagctactcgggaggctgaggcaggagaatcgcttaaacccaggaggcagaggttgcagtaagccgagattgtgccactgcactccagcctggacaacaagagcaaaactccgtcttaaaaaaaaaaaaaaactacgttagcctggaaagctcttttgaatagaaacaactccagagtctagtggacatgggctactcaggtctagaatctgtgtcttgggctttgatagactactcgtgtcttttctagctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaagggtaagaagtcacattctcatttttgcttcttttttttttttttgtcctgggaattaataaaacatattttcaaatgcataggctagaatgtgttcacagaagaaaaagaaccacgtggactacactaaactctacagggccttgtgatttttccattccgtagacctcctggcattggagcagagcaagactttctataagccagattggtttgacatcgtggagtctgaagtcaagtgctgtaaggaagctgtgtgtgtcattgacatgtcctctttcacaaagtttgagataacagtaagtatttgggaaccaaaaagtaatagattaggaaactttacatatttattgaatgccttttgtttttcatcttcaaaactgattcctgactgggtgcagtgggtcatgcctgtattcccagcactttgggaggccaagggggcgtggatcacctgaggtcagagttccagaccagcctggccaagatggtgaaaccccgtttctactaaaaatacaaaaattaaggccaggagtggtggctcatgcctgtaatcccagcagtttgggaggccgagacgggtggatcacctgagatcaggagttcaagaccagcctggccaacatggcgaaaccgtctctaccaaaaatacaaaaaattaaccaggcatggtggcgggcacttgtaatcccagctactcgggaggcaggagaatcgcgtgaactcatgaggtggaggttgcagtgagctgagattgcgccactgcactcagcctgggcaacagagtgagactccatctcaaaaaaaaaaacaaaaaacaaaaacaaaacactgatttcttaagaattctggtatattttagtgtttcatctgtattgtaacatttttctgaaattttagctccttgtttcaggtttttaatttgctagagaggcctgtttatcataagaatcaatagctagcgttccctggagcttcttgcagtggagtaggtctgcaaatgttgtcacatgggaattggctgattgaattttctcaatgaggttcattgctggtggggccatgtggcccagccaggtgctctcacgctcactctctctgtttcattccctaaccctgcagtccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcaggtgagatgagctgccgtcccgctctgctccctccaacatgttgattccttaggggtgctgtagcagaggctctcaggcgcttctccgggaaccataaatcccagagtctaagaatcattacatgaaatcaaagccagtttattagcagtcctaaacaaaagaaatcaccaggaggaaaagaaaaaaaagcccaccagattatgtaccctactgggagaagatgccttgtcttttttcttttttttttttttgagacagggtctcactttgttacccaggctggagtgcagtgatgcgatcatggatccctgcagcctggacctcctgggctcaagtgatcctcccacctcagctttccaggtagctgggaccacaggtacacgccaccacacccagccagtttttgtatattttgtagagatagggttttgccacattgcccaggctgatcttgaacacctgagctcaagcaatctgcccaccttggcctccaaagtgctgggattacaggtgtgagccactgtgcccagccgatgtcttaacgttagtaaatctgtataatttcttggcattaacaggaagccagaattttgttttgttgttaggtggtgtatcctagaatggtgctactggccttctgtgaaagctaagaaatcatttcctagtatttgcctcattgctttgaaaccaaataagatttgattgcttcctgatccttttgctgctacctggttttgattattttggggtctcacttttcagtttcttcatgatctctccaaccgaccagcaggtccactgttgggcctggcttaagaaacacatgccgaaagacagcaacctgctcctggaggacgtcacctggaagtacacaggtacgggggttcgggctctgccacgtcgaaaaggccagcagatgcagatgtgtccacgtttgccttctttacatttgactctcaaaaatgaacattagagttagcataaaagaggctctctggtcatagaaaattgatctctaggggatgcggtggctgacacctgtaatcccagcacttttggaggccgaggttggaggatcactaggtcaggagttcgagaccaacctggactatatggtgaaaccccgtctctactagaaatacaaaaattagctgggcgtggtggcacacacctgtaatcccagctacttgggaggctgaggcaggagaatcacttgaacccaggaggcagaggttgcagtgagccccagattgcaccactgcactccagcctaggcgagtgagactccatctcaaaaaaaaaaagaaaattgagggctggacacagtggcttacacctgtaatcccagcactttgggaggctgaggcgggcggatcatgaggtcaggaatttgagaccagcctggccaacatggtgaaaccccatctctactaaaaatacaaaaattagctggacatggtggtgcatgcctgtagtcccagctactcatgaggctgaagcaggagaatcgcttgaatctgggaggcagaggttgcagtgagccaagatcatgccattgcacctccacctcccgggttcaagcgattcttctgcctcagcctcccaagtagctgggattataggcgcccgccaccacgccgggctaatttctgtatttttagtagagatggggtttcaccatgttggccaggctggtcttgaactcttgacctcgtgatccacctgcttcggcctcccaaagtgctgggattacaggcatgagccaccacgcccagtcccagagagtacctaatttttaaggatgacttggttccctgattttctcactctcagcagtctcggcttaacccctcccaccttcccacctaactgatcttgccccttggccccaccagcgtttgctctcccaggctctcattctcaattccttgtagtagcaaatatgatatacgtcctgctcctggattgggatactacagaatgttactgaacaaaagtcatgttctagcctgtcttaggatggatgacatgtaattagcacaagctgatgtcacaaacactggtgtccagaataatgctttccttatctagtaagcattaggatatgtttgaagtggatttagcttctctgaatttaaagtctgtatactttttggttgggcagatctccaccgggtactgatttggggttggggcttcttccatcacatagccttgctgggaaaaggaggagaacgggaattgtgtggggtggttatggccagccctgctgcgttcagcaggccctgttggcagaggtgtattcgccagaatcggggtgcttagcatccatccttggagtgtctaagcaaagggacatattcctggtctctgcacccaggcctggctatagctgagcaagtctacagtagacctttcccattggctcagctgttcagaaggagagctggacatctcttgttcttttccatttagccctcaatctgattggccctcgagctgtggatgtgctgtctgagttgtcctatgcccctatgactccagaccacttcccaagcctcttttgcaaggtaagtgctgataaagttctgtttcttaaatgggcagagaatgtgtctttcatagcggtggcaggtacatattcttactatggtgttagcacccacaaagagtgtcttggctgggtgaggtggcacatgcctgtaatcctagcactttgggaggccgaggcaggtggatcacccaaagtcaggagtttgagaccagcctggccaacatggtgagaccctgtctctgttaaaaatacaaaaattagctgggtatggtctcacgcacctataatcccagctacttgggaggctgaggcacaggaatcgcttgaactctggaggcagaggtcgcagtgagccgagaacacgccactgcactccacctgggtgacagagtgagactctgtctcaaataaaagagtgtgctggccaggtgcagtggctcacgcctataatcccagcactttgggattacatcttatatttataaataaatataaaaatacaaaaattagccgggtgtggtggcgcatgcctgtggtcccagctactcgggaggctgaggcaggagaatgacttgaacctgggaggcagatgttgcagtgagccgagattgcgccattgcactccaggctggcaacagagcaagactgtctcaaaaaaaaaaaaaaaaatgtgctgcccttcattagcaaagaagtgactaagtatatttatttatttatttatttatttatttattttgagacagagtttcactcttgttgcacaggctggcgtgcaatggtgcgatctcggctcactgcaacctccacttcccgggttcaggcgattctcctgtttcagcctcccgagtagctgggattacaagcgcccgccaccatgcccagctaactttttgtatttttagtagagacagggtttcaccatgtttgccaggctggtcttgaactcctgacctcaggtgaaccacccacctcagcctcccaaagtgctgggattacaggtgtgagccactgcgcccggccttatttgtttattttttacactccaagcttgctttatttaataagcattaggatatctttgaagtggatttagcttctctaaatgtaaagtctttatgctttttggtttctgtagcactggattaaaatttgaagttacaggattatgacacacacaaaaatgcctttcgaagttaggtcccttctctccatgcagtgtggcctcttttctgtacacagagtaacttctgtgtctgtggcatcttcagggaagaaatggcgtaggtgaatctctgaacttcctacataattttctttcctataagtggcaaccacagctgagtgaaacaaactgtaaccgaatgaaagcaatgacaacggaatcctccccaggaagctgctgattagagagggccaaacggacagacatcttggccacctgtaacgagcaacttccaggtggttactgatggagactctttgaagttcacccaaagtgggatccacctacaaattgtttcacagttttccttcttctccgaggcaaagtgaaagcaacagaaaactctccactgttagctatcagtggacccctcccagcgtttgctctgctgcttggaggagtgacccatacgctcaacacctggcgagtgctgcatcctgtcagcctcctgtggaagcggttcacttcggtgctgtccaggactttccactttcctttataggaacggtgattgcgtcagtggccgctgttagggaactgagctgctatgtaacgtgttctgagaatcagaagcccatctttgaccccaggatagcagattaattatgtctgtgggcatcgggcatcatcttttgtatggcaggcggccagggtttgtctgctgattcccccagagaagacactcgccttgtcctcattgtgcctgctaccctcgactaacacaaggacctggcaaagaggaatattttgtgcttgtcaaggactttcctccactctctaccatcagcttggctaaaactcctgagatggtaacagtagcaagcagagatgtcacataggcagtgctccattctctgtgcctcaggacctggaagttaaccactttcgggatgaaattcttgccttgacgtctgtctccctcaacagtaaacagagggtgcagcactaatgaaaggtttccccaggcgtccctcccttgacaagtaatgtgagtgcccaggctgactgctgcctttgtccctgcaggagatgagtgtgggctatgcaaatgggatccgggtgatgagcatgacgcacacaggagagccaggattcatgctctacatccccatagaggtgagagggcacccttcccttcccttcccttcacttcccttcccttcccttcccttcccttcccacaaccactgtggggtgccagtgctcccagcagcgcgttcaccagcactggcaggtttggagagctgtatctgattgggccttgggagctgaggtaggctgcattgaagagatttgaccatttttaactaagttatataagtttttttgaataggtgatacatttaaaaagtatttggcgccgtctgatctgttctcaccaactgtcaccaataatattagtattacttttatatgtcatttcagatttgtatgcatattgcaagcaaattcataattaatttttttttttttttgagacagggtctcactcttttgcccagggtggagtgcaatggcatgaccgtggctcactgcagcctcgacctcttgggctcaagccaccctcccacctccgcctcccgagtagctgggactgtaggcatgtgccaccatgcctggctaatttttgtatttttttgtagagacaggttttgccatgtcgctcaagctggtctcaaactcctgacctcaggtgatacacccaccttgtcctcccaaagtgctgggattataggtgtgagccaccatacccagccaagccccctttttaaaaacagaaatggaagcatactgctattcttcatcctgtttttttttttttcacttcacaattttttttttaattgaggcagagtctcactctgtcacctagggtggaatgtagtggcataatctcagttcactgcaaccttcgcctcccaggttcaagtgattgtcctgcttcagcctcccgagtagctgggattacaggtgcacgccaccacgcctggctaatttttgtatttttagtacagacggggcttcaccatgttgcccaggcttgtttccaactcctgacctcaagtggtccacacacctcagcctcccaaagtgctgggattacaggcatgagctaccatgcccggcctcacttcacaatttctcttagagctctttctttgttggtacctaaagcaaaagagcttccttgttctttttttctttattttttaacagtggcgtagcattccattgtggtacatcattccgatactaatagacatttatgttatttctagtcttttgctgttataaaaaggtctgcaggctgagttcagtctaatcatatgcaaatagtaatagtttcttccttctccagaaccttttttttgagacggagtctcactctgtcgcccaggctggagtgcagtggcgcaatctcggctcactgcaagctccgcctcccgggttcacgccattctcctgcctcagcctcctgagtagctgggactacaggcgcctgccaccacgcccggctaattttttgtatttttcatagagacggggtttcaccgggttaaccagaatggtctcgatctcctacctcgtgatctgccagccttggcctcccaaagtgctgggattagaagcgtgagccaccgcacccggccggcttttttttttttttttcttttttttttttgagatgaagtctcacacttgtcccccaggctggagtgcgatgacatgatctaggctcaccgcaacctctgcctcccgggttcaagtgattctcctgcctcagcctcccgagtagctgggattacaggcgcctgccaccacacccgactaatttttgtatttttagtagagacaggatttcaccatgttggccagcttggtctcgaactcctgaccttaggtgatccacccacctcggcctcccaaagtgctggaattacaggcgtgagccaccgcacccgggcccatagtctttcttcctataatttccttcctttgttctattgtgacaggtagcaatcaatgattgtaggcatgcttgttttcttcttgatgttagtcatactacttgtagtgataggttttctcttaattttttttttttttgtgagacagggcattgctctgtcacccaggctggcttactgcagcttgacctccgaggctgaagtgatccccctgcctcagcctcctgaatagctgggactacaagcatgtgccaacatccccagctaattttttaattttatttttgtagaggcagggtcttgctatgttgcctaggctggtctcagactcctggactctagtgatcctctcacgtcagcctcccaaagtattgggattacatgtgtgagccactaccccgaccttatttattactattttttagtgcagtgggatgatcatagctcactgtagccttgaacttctgggcttaagcagtcatcccacttcagcttcctgagtagataggaccacagatgcccagctatcttttatttttttgtttttagacggagcctcccactgtcgcccaggctggagtgtagtggcatgatctcggctcactgcaagccccacctcctgggttcaagcgattctcctgcctcagcctcctgagtagctgggactacaggcacacgccaccacactcggctaattttttgtatttttcatagagacagggtttcaccgtgttggccaggatggtctcaatcgcctgacctcgtgagccgcctgcctcagcctcccaaagtgctgggattacaggcatgagccaccgcacccggcctatttttttattttttgtagctttgagagtctcaatatgttgcccaggctggactctaactccagcctcaaatgatcctctcatctcagcctcccaaagtgttgggattaccggcgtgagccactgtgtctggccctgttttaactatttgagccactgtgcccaaccctttttaaatgattaaagcacagataatatcagcgcatgaaatttcatctgcttttccacactcagaagtattacaacaatatgaagatgaagagattgttcaagacttgggaagaatttaaacagatgcagctgccatggttggcctgtgcaggcaggttgattctgaagtgccacccagtggttcaggtgttgtcacctgggtgcttgtggtcaaacctcatcaggaaggggaggctctgtggctctagcagcttcatccttgcttggaggccttggtttcagctttctgatttccctgggctgttcccattcttatgatttttcaagagtctaagagattatttgtgccacgcttgggttctttataagctggcttttgtccaggaagcttatgtttgtctctctgagaagaggtcttccaaaacatgggggcagatggcagattctcgttttgttcacactaaatctctggtattttgtgagaaaaacgagtaaatggtggggaactactctttgagtaaatggtggggacccactcttctctttgattttcccagcattagtcacgtagttggatctggcccaacactagtcacctggttacatcgttcttccttggtcatcctcttacctaaaggaccgggcattgagcttgaggtgggagagtaccacattccctggagatgccagctgtgtattctcctcgtcctgccgcattctgtgggtctcctgcacccaccttggctgattcaggtgtttcccttacacacataccacaggcgagtgttgcatgcaatagcttggattccttttttccacatttaaagttgtcttcccggcacggtggctcatgtctgtaatcccagcaatttgggaggccaaggtgagtgaatcatctgaggtcaggagttcgagagcagcctggtcaacatggcgaaacctcgtctctactaaaaatacaaaaattagctgggtgtggcggcagccacctatagtaccagctactcgggaggctgaggcaggagattcacttgaacccgggagtggagatggcagtgagccgagatcgcgccacttcactctagcctgggcaaaagagcaaaactctgtctcaaaaataaataagtaaataaagttgtcttgatcatagtggtctgtttggtagatgcctgttcagctacagtggtgcagttcatagaaacatactgtgctaggataaagaactgcagtaccactgaagctggttctttgctacgtcttgctttggatttcattttacagttttaaaagcaaacagtgtagtctcatttttgttggactttaaacttaacagcgtatgttcagacagggattgaatatttgctttcagtttggaaaaccttctgttcactgatctgataacgtacatgtttctgaaaccaagaaaagagcagcttgagagcctgaatgctgtgggacatgagcaggcgagccctgccttcctggctcccccgccgtcatccgatgtgtgcacacgtctcgagtaacgtgtgagagctgggcctcacagcttgggccagtacgtgagggagtaacagtggttgggaaattggagcaaaagaacaaagccagaatcagatgaagaccatggagggttggtgggctgttttagaaatgatgatgagattggccatttaccaaatggtgagagagcttctataaattattatttaagaattgctgtaagctagaatcaccacacaagacattttagagaggtgaaaagacatggatcctgttgtcatggagcttaagtccaggctggggtgaccccagctcatcactcctgggctgtgccctgagcgtgtcaaggatgagacatcctgggagttttatacgcctcctctcttgtccatgttaatagtgtgagccatcagcgcttccagacatgctccatgcttaattctgaaggtctgctgcttatgaactttctgtctcttcctatagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaaggtactgtgtttacccagactccactttcactcagcatcccgagtagtgaatctgcactagactaggaagaagaactgatgtgacaggaaaagggggaaaagattgaggccttgatgttagcatcaggtaaatgaggacaagagtgccctgagaatgaaaactttataggataaaatatcttcaaatgaaaacataataatggtggctcacgcctgaatcccagcactttgggaggctgaggcgggtggatcacctgaggtcaggagttcgagaccagcctggccaacatggcaaaacccgtctctactaaaaatacaaaaagtaggccgggcacggtggctcacacctgtaatcccaacactttgggaggccaaggcgggcggatcacaagttcaggagatcgagatcatcctagctaacacagtgaaaccccgtctctactaaaaatacaaaaaattagccgggtgtggttgcgggcgcctatagtcaggagaatggcgtgaacccaggaggcagaggttgcagtgagccgagatcacgccactgcactccagcctgggcgacagagcgagactccgtctcaaaaaaaaaaaaatttacaaaaagtagctgggcgtggtggccagcacctgtagttccagctactcgggaggctgaggcaggagaatcacttgaacctaacaggcagaggttgcagtgagccaaaatcgcaccactgcactccagcctgtgtgacagggcaagactccgtctcagaaaaaagaaaacatagtaaatagatgacacttggtcaggtgcggtggctcacaactgtaatcctagcactttgggaggccaaggcaggaggatcacttgagctcagcctgggcaatacagcaagaccttgtctctgaattacaattgaaaaacaaacaaaaaaacccacttatttctagtgttctgctgtctaaaagactgagtgctttctgggaagctattctgagttaattatggtgatgcattaacatgccacgaatatttgtacaaactagtcgtcctatagtcagctgcctaatttttgtggtttttttcttttgtttttgattttgaggtggggtctcattctgtcacccaggttggagtgcagtggcgcgatgttggctcactgcaatgccctctcatgctcaagtgatcctcccacttcagcctcccaagtggctgggaccacagatgcacaaccatgcccagctaatttttttgtattttggtaaagacagagtttcaccacattggccagggtggtctcgaactcctgagctcaggtgatccgccctcctcggcctcccagagtgctgggattacaggcgtgagacagcacacccggcctaatttttttggtttttttgttttgggcggatcacctgagttcacaagttcgagaccagcccggccaacatggtgaaaccccgtatctgctaaaaatataaaaattagctgggcatggtggcaggcacctgtaatcccagctactcggtaggctgaggcaggagaattgcctgaacctgggaggcagaggttgcagtgagccgagatcataccattgtactcccacctgggtgacagagcaaggctccatctccaaaaaaaaaaaaggtaataacccattttggaaaatataaagaaggaaattaaaatcacccatattttgtctatttaatggtagtaactattttttttttctttcttgagacggagtttcgttcttgttgtccaggctggagtgcagtggcgcgatctcagctcactgcaatctctgcctcctggcttcaagcgattctcctgcctcagtctcccgagtagctgtaagccatccagctaattttgtattttttgtctttaccaaaatacaaaaaattaggtgggtgtggtggcgcatctgtgggcccagctacttgggaggctgaagtgggagaatcacttgagcatgagaaggcatttttgtattttttctttttttagtagagatggggtttctccaggttggtcaggctggtctcgaactcctgacctcaggagatccccccgccttagcctcccaaagtgctgggattacaggcgtgagccaccgtgcctggccataatcaccgttaatagtttattctagtcttatttgttgtacatatgtgtatatatgtgtgtatgcattgaatatagatgtgcatggtcttgttgggattatataaaaaagtctttttttttttttttttgagacagagttttgctgtgtcaaccgaggctggactgcagtggtgcaatcttggctcactgcagcctctgccacccaggttcaaacgattttcctgtctcagtctccctagaattataggcacactccaccagaatcttggctcactgcagcctctgcctcccaggttcaagtgattttcctgtctcagcctcccaagtagctagaactataggcacactccaccacacccagcttatttttgtatttttagtagagatgaggtttgcctcatctctgttcaaggcgtgagccaccacgactggccaatataaaaacatttttctaaagtactggactgataaggtattttattaagtgagtgagttttcttcctaaacgtttttgttctatctggtcttgtgactttatgtttataaaataggaaacaaaatgcgtacctctgttgttacaaaaattaccgcggcgtcttttatatttcacatgcagtttttcacatggtagaaatcgcacagtttcccaaaagctggcagggttgtgggaggaggcggctgtgccccattgcagtgacaccaggggacccttcccacggtgctgctctctgtgccgagggtctgagtgtcgctggatgactcggcgtttcctttctttcttagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcctaaacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggcactagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctcaaaaaaaaaaaaaaaaaaatctaagatagaggtttggtcaacagtgcttaataataaataagaacctcctgccattctaattttcctgctgcaccccatcccccacacacccctcacgaacattgatataagcagtattaacacagtataaagaatgttcaccttgcatatgtcatttcaggcacatggattcaggagaagcacagttgagtggaagaaatggtagacttgtgaggcttgccccaggccttgtgtacacgcaataagtggtgagccatgggtctctccgtcagcgcctccctccccgccaccacttcaggccaacaatttaaggtgctgagttgtaaggctcctccattgtcagtacagggctcgcctttgtagccctgatcactaccagtacacttttcaagacaactgagtatttttgtatgcctttgccttccctttgtccatgaaacatgaagagttgtttatggttcttgacttctctgagcagagtgtctgcatctcttggagagttacacatttcttcatgagccatttttctcattcttagatgcacctgtttttatcctttgcagaccatcttctgccttcttattttcctgtctgtcaaagacagaaattacaggagatagggagggttttttagcatctctttcaaaagatgtatgtcagaatttcctttgcacaccaagaactggagcttagagccccactattctctaagccaggttctagtgccttacactccagaatgtcagatggtgggtgcagattggaagaaagagaaaagttcatctcggtgtgtgggttcccatccgccccacatagcctctccttcttcggaacaatgggcgtggggtagaaagctctttcagtgaagggtgttctagcagctcagttaacactttactctccagtcaacacttgggacatataaaaatgccattgtaactactgtagagtcctgtgactcatcgtttgtgtttgtcaatttgcagttcagcttagcccttccctgttcctgtgtagttacaatctggccctgaagacatccgaggcacttcagtaagtgggatcttttctagagatcctgggtgactttgggtgcacagggtgaccgagcatttctgcccctgtgaatgtggcactaacactgtgcactgtctccaccaagcaaggtttccactgagtttcttctcatgttactgggtttgtaaatgaataaacacattttaactactcttgcacggctgcttgtgaaatgttcttcatctgtagtgacttaaatgtgtttgccaccacaaagcataaacagcgtgcagaggagagtgtgtacctccctgtgtgtaccagtgtgagggaggatttggggacgggggtagagaagatgtaggtgtttatcttaccctccctgcagcgctggagtggctgggggtaaaagcttcccgcctcctgaaattccgaccggccttctgcctacagctgacctcaggaggaacctgccacctgatgttccacacgggcacgtgtgcactcaggtttgtgtggaaagcaaggggggtcgtgttctcaccctgtggaaacaaccctgagagaaacaaccagtgctctttttctacaccagcttccatccacaagttggtccctggacttgacctgttcactaatttttttttttgaggcagagtcttgctcttttgcccaggctggagtacagtggtgtgatcttggcttactgcaacctccactcccaggttcaagtgatttcctgccttagcctccagagtagctgggattacaggcacgcgccaccatgcccagctaatttttgtattttcgtagagacggggtttcgccaggttggccaggctggtctcaaacccccaacctcaagtgatccacccaccttggcctcccaaagtgctgggattacaggcgtgagccactgtgcctggcccaaagtaatttttgagtagtttttttttttttaagtatttgtacttttgagaatctcataggttaacatgtttacaacaatctcttcatcttgtcttctaaatcagccccttctattccagttccaggaatagtcaaccacgccagaaacctgggactcacctggtctccccactcgcctctccctacacctcccgctcattacccagcctcacagggctgtctcctcagtgcctctcctctgttcggacctcactgtccccaccactgctgctgtggcagagagggttgtcagccctgacttcgagaacaatctcttactgattttcctgcttctcatgtcatcccccctccctctgcagggttgtctttgtaaaacaggggaggtcaatttactcactgccttgaaaccctcaagggactcccctttgtcgtgagacaaagctctcagtccttagcctggccagccagggtctccagggtgtggcaggccacgctgccccagggctccggcctgcgctgcgtgtgatgtgggtcctgcagccgagtgcgtgctcgccatccacagctggatctcacctcgaatcctgctttccagtcacactgagaggtctcccactcccatatttgctcactaaaatgcctcctggcagccctcccctgtgcttgtggaaagtcgcaaattgaggatcacatggacccccactcccccaagttgtcctgacagagacctcctgtctttcatttgattgattgattgagacggagttttgttcttcttgcttaggctgctggagtgcagtggcgagatctcggctcaccacaacctccgcctcccaggttcaagcaattctgcctcagcctcctgagtagctgggataacaggcatgcgccaccatgcctggctaattttgtatttttagtagagacgaggtttcactatggtggtcattggtcaggctggtctcgaactcctgacctcaggtgatcaacccacctcagcctcccaaagtgctgggattacaggtgtgagccacagtgcctggcccctcctgtctttcaaaagctctgcccaagaccaccatcatcccacagtggagcctttccttccccaagagaatggcccctttggggtcctcacacacccgtttctgatgtgtctttatttggttatctgccctgctccttctgtaagtccctcggagaaagactcgaattctcccaaactccaacacctcacatggtgtttggtgtttaacagatgattaaatgaatgggcaaaaagtggagggcaaaatctttaaaatgtcttttaagatttaaggattttaggccaggtgcggtggctcacacctgtaatcccagcactttggaatgccgaggcgggcggatcacctgaggttgggaattcgagaccagcctgaccaacatggagaaaccttgtctctactaaaaatacaaaattaggcgtggtagcgcatgcctataatcccagcttcgcgggaggctgaggcaggacaatcgcttgaactcaggaggtggaggttgcagtgagccgagatcacgccattgcactccagcctgggcaacaagagcgaaactctgtctcaaaaagaaaaaaagatttaaggattttaaatgtttgatttttttttcttgttgagatagagtcttgctttgtcgccaggctggagtgtagtggcgtgatctcggctcactgcaacctctgactccctggttcaagggattctcccacctcagcctcccgagtagctgggattacaggcacacgccaccacgcccagctaattttttgtatttttagtagataccgggtttcaccatgttgaccagcatggtctcgatctcctgaccttatgatctgcccacctcagcctcccaaagtgctgggattacaggcgtgagccaccgcgcccggcctgaaaatttttaaatgattgtttgccgactttacaacaggacgatgttgttgttcgcaggccagtaggtggcgctgtggcacgtgatctgagcctcctggattcacacaactgttcatgtggagaacccagtgccgggacccattagcaccccagtcaggctatgcgtctccctcccaagggtgctcacctggtgtggccttcatggcacagggggagtgagatgaggctcctttagtacaccctcccctgagaagagcgacgtgtgcttaccctccagtggcttgttctcatgaaaggctccacagttagggaccttcagatgcttagatctggggtgtcacctgactcaagcagctcagaatcccagattgttgtggtgggtcaagggcatggggctttgggtttactggcctgggtctgaatgccagcattgcctcttccttggtgtataggaccttgggtggttacttttcctaggcctctgtttacttgttttaaaatggacagtgatgcctactttatagggttgttatgaaactcaactaatgaatataaaatactcgacccagactggcatggtggttcacgcctgtaatcccaacactgggaggccaaggtgggaggatctcttgagcccaggagttcaagaccagcctgggcaacttagggagaccccgtctctaccaaaaataaaaaaattagccaggtatagtggtgtgtgcctgtagtactagctacccgggaggcagaggtgaaaggatcgcttcagcccagaagttcaagactgcaatgagccgtgatcatgccaccgcactccagcctgggtgacagatcaaggccctgtctcaaaaaataaattaacaggtcgggcgcagtggctcacgcctgtaatcccagcactttgggaggctgaggcaggaggatcgcttgagcccaggagttcaagacaagcctgggcaacttagggagaccccgtctctaccaaaaataaaaaaattagccaggtagagtggtacgtgcctatagttccagttacccgggaggctgaggtgaaaggatcgcttcagcccagaagttcaagactgcaatgagccctgatcgcgccactgcactccagcctgggtgacagatcaaggccctgtctcaaaaaataattaattaaatacttgacccattgcacgatctttccatgcacgacagctgctcttctattattcttccaggatgagctgcacagcctgcccccttgggtttccaggttgtgggagatgagcaaaactgaatgacctcagtaggccaagagcaaaggatgtgggtccggacctggtggccagttgcttgtgacaggagctgggctggagtccccaagtgccactagtgctgacatcttttaactgtgttcattgtgacttgtttatttctaaaagtaaccactggcgccttggtgcagatggaactccaggtgcatgcggtgagttaaccatggtctggggagctttgtttccacgcctaggacatgcatctgtgtgcatgatatgtgagctgatatagccatgcctctggtgatttgaacgcctgcgcttcccagctgcttcagggccctgaacatcgctggatgtttgtacttcattccctcctcagcccagctggtcccactccgcagctgtgctctaggcatttcatctcaactgggtgatatatttgaatacagcaattataagaacagcaacctcagaagaacatctggcatccagacctccccagcctagttccacaaggtaccaacttccgtaagccttgaagagctaagtaagacatccgggccgggtgcggtggctaatgcctgtaatcccagcactttggaaggccaaggcgggcagatcacttgaggtcaggagttcaaaaccagtctggccaacatggtgaaacgccatctctactaaaaatacaaaaattagccgggtgtggtagtgcatatctataatcccagctacttgagaggctgaaggaggagaatctcttgaacccgggaggcagaggttgcagtgagccaaggccacaccactgcactccagcctgggcaacagatcccttggtatagatacggggagcttgggtggtctcatcacagcagaacctcagctcttggcatgttctttcctttgctaccagcttttgaaactgaagtgtagcagagtcatgaaccagactttgaaacatgaaccagacagagaaacattttaagaagtagcggctgaccaggagttggagattgcagtgcactatgattgcacctatgaatagccactgcactccagcctgggcaacatagtgagacccctatctaaaaaaaaagaaaaagaagggccaggcacggtggctcatgattgtaatcccagcactttgggaggccaaggcaggtggatcacaaggtcagatcaagaccatcctggctcacacagtgaaaccccttctctactaaagatacaaaaaattagcctggtgtggtggtgggcgcctgtagtcccggctactcgggaagctgaggcaggagaatggtgtaaacccgggaggcggagccgggcgcggtggctcacaactgtaatgccagcgctttgggaggccaaggcaggaggatcgcttgagcccaggagttttagaccagcctagacaacatggcaagaccccgtctctaccaaaaatacaaaaaattagccgggcatggtggtgcatgcccatagtcccaactacctgggacgctgaggtgggaggatcacctgaaccccggagccgtgagcacaccactgtactccagcctgggtgacagagtgagaccctgtctggaaaaaaaaaaaaagtagctgggtatggtggcacgtgcctatcgtcctacctgctcaggaggctgaggcatgaggatggcttgagcccaggaattcgaggctactcagcaattatggtaccactgcactccagcctgggtgacaaagtgagaccctcaaataaaacaaaataaattggccataaatgtaagagttttttcctgtattgttcattctgttccttgatctatatgtcttgtcctttttccatatcttatagatgtgattactagaagtttcatagcaagttttgaaatcaggtagtatacattctccagttttattctttttcaaatgtgttttggttattctaattcctttgcgtttccatgcaaattttaagatccagttttcaaattttttttgagatggatcttgctatattgcccaggctggtctcaaactccagggctcaagggatcctcttgcctcagtctcccaaatagctgggattacaggcacatgccaccaaacctggcctctcaattgctttaaaatacaacaacaacaaaaatcttttggaagtttgatgggcattgcattgaattaatagacaaatttggggagaattaccatctatcttaacaatattgagtcttcccctggccaacatggtgaaatctgtctctactaaaaatacaaaaactggccaggtgcagtggctcatgcctgtaatttcagcactttgggaggccaaggtgggtggctcacttgaggtcaggagttcaagacctgcctggccaacatggtgaaaccatgtctctactaaaaatacaaaaattagccgggtgtggtggcgggcgcctgtgatccaagctacttgggaggctgaggcaggagaatcacttaaaccgaaggggtggaagttgcagtgagcccagatcgcgccactgaactccagcctcagtgacagagtgagactctgtctcaaaaaaaaaaaaaaaaaaagaaaagaaaaaaaaagaaattagctggacatggtggcaggtgcttgtaatctcagctacatgggaggctgaggcaggagaatcacttgaacccaggaggcggaggttgcagtaggaagagatcacgccactgcactccagcctggacgacagagcaagactcagtctcaaaaaacaaacaataaaacaatattgagtcttctattccatgaaggtgaaatgtctatgcatttttttagatctttagtttctctcagcaatgttgttttacagttttatgtgtatggattttcttttttttttttttttttttgagaatgagtcactctgtcgcctagtctggagtgcagtggctcaatctcggctcactgtaacctccgcctcccgggttcaagcaattctcctgcctcagcctcctgagtagagtagctgggattacagttgcccaccaccacgcctggctaattttttgtatttttagtagagatgaggtttcaccatgttggccaggctggtcttgaactcctgacctcaagcaatccatctgcctcggtctcggaaagtgctgggattacagatgtcagccactgtgcctggccatgtgtggaactgtttcctcaatttcattttcagattgtttattgccaatgtgtagaaatgcagtggattttggtatgttaattttgtattctgagacctttattctagtagggtttttttttttttatacattcctttggattttctacagtagaattatgtcatctgcaaatgaagatagttttacttctttcttttcagtgtggatgcctttaatgtctttttcttaacttattgcacaaattgcgcattcaatagtacaatgtttagtgggaccggtgagaaaagacatccttgccttgttttgatcttagggaggaaagtctttggtctcactgttaagtgtgatattagctgtacgttttgcgtaagggctgtattcgtttgctaggactgccatacaaggtaccacacactgggtggcttaaaaaacagaatgtattttctcagagttctggaggcataaaggccaggatcaaggtgccggggggttggttccctctgaggacctctctccttggcttgtctacagccgccttctccctatgtcttcacaggatcttccctctgtgtgtctcttcttataatgaggccagtcagactggatcaggacccaccccagtgacctcatttaactttaattacctctttaaagaccctatctctaaatacagtgacacggaggtaatggaggtaggacttcaacatactaatttggggctggttgtggtggctcacgcctataatcccagcagatgacttgagctttgagaccagcctgggcaacatggggaaggcccatctctactaaaaatacaaaaattacctggcatggtggcgcacacccacagtccagctactcaggagcttgaggtaggaggatggcttgagcctgggatgtggaggtcaaagccccaggagcagaggtcacagtgaaccaaaattgtgccactgcattccagctgggcaacagagccagacttcgtctcaagaaaaatttaaaaatcaaatagacatgatttttttttagacagagtctcattctgttgcccagcctggagtgcagtggtgtgatctcagctcactgcaacctctgtctcctgggctcaagtgattctcatgcctcagcctcccaagtagctgggattacaggtgtgtgccaccatacccagctaatttttgtatttttagtagagacgggattttgccatgttggccaggctggtctcaaactcctgacctcaggtgatccgcccacctcagcctcccaaagtgctggtactacaggcatgagccactgcacctggcctaatttttttttttttcttgagacagaatcttggtctgttacccaggctggtgtgtagtggcacgattacagctcactgcagccttgacctccctggctcaggctatcctcccacctcagcctcccaggtaggtgggactatggacacgtgctaccacgcccagctaattttttgtattttttttagagacggggtttcaccatgctgcccaggcaggtctcaaactcctgagatcaagcagtccacccagcttggcctcccaaagtgctgggattataggtgtgagtgagctactacgcctggcctggacatgtaatttttaaaagaaaatgtggccacaactctcctagagttaaatgttttttttgtttgtttgtttgtttgttttttgagaccatcaacaagatttcaaggctttaaagaaaggagctgcttcaggaagagataaaatgactcaaacgctataaccttcaaatgtagactgggagaagaggtatcagctatgcatgagctggagaggggtgggatagatagagacacaggtgataaagaaaatatagcaaaatgtgaatcctacaatctgggtggtggatgtaaaccctgtagtagcctcacctggggaaagctgccttgcaacaatgaggctgcccattctccaaacccaccccagccaccgagcaggctccactaaaaagtctgaacccaggagggagtaccatggaaaccaagttgcaatgccctggttaggggcccagcagaggggtcatcccagctctacgccattggatactgagtttcaggagtgggagtgccatcctcagggtcacacagcgtgtcggttccagcctaggtcttccagtgtctcattaatcttttatccactcagcttctcttctggcccatgaaccttgctctcctgggactcttttttttttttttgaggggtcgggggtgggacagagtctcgctctgttgcccaggatggagtgcagtggtgccatcttgcttcactgcaacctccgcctcccagattcaagcaattctcctgcctcagcctaccgagtagctgggactacaggcacccaccaccctgcccagataatttttgtatttttagtagagacaggatttcaccatgttggccaggctggtctcgagctcctgacctcaagtgatccgcctgccttggcctcccaaagttctgggattacaggcgtgagccatcacacccggcctgggactcttcttgcagtgagccagggccatgggacccttcaaaagttgctccaccctaatccccaaaatatctttttctcccgcctgtcccaagtgcctggcatcatactatatgggtcaactggccatgtttgccatggaagcccaattgtaggaagtgggtcttttatcacccggcatagcagagctgtggaaactgcactgggaaagatcaggatgtgaattaaagcgttgggaatgggaaggcagagaccttggattagctgggatgctccatgcactcgctgagtgaccttggacaagccccttagacacactaagcccgtttcctcatctacacgacgggcatcccatctgctactgcaccaggttcttgtggcaataacttgaactcacacatgcaaacaggctttgtgagctccataaacacaggtggctcggccaggtgtggtggctcatgcctgcaaccccagcactttgggaggccaaggtgggaagatcccttgagcccaggagttggagaccagcctgggcaagacgatgaaatcctgtctctaccaaaaaaaataataataattagccaggcatggtggcacacacctggtcccagctccttgggaggctgaggtgggaggatcacttgggcccaagaggtcaaggctgcagtgagctgagattataacactccaacctgagtggcagagtgaaactgtctaaaaaataaaaataaaaatacatcaaaaaacaggtagctattaagcattgctaggacccacacgcagtgaccctgagggtgctgggtttctgtttgagggagaagaaactcctgagcccctaggtattgtgggggacatgcagttccagaccgccttcatggcctgtatgcctggcctcatccccatccctggcacccatgacgatagccacattccactggtgtttccccaggaaagccaaccctacctgcatctcagcagagcttccacggagttggaaccccgctccgagagggtgtgggctcaggggccaggggtcacacaaactccagaaggaggacgtagttggtttgcaaggctgtcctttgccctggttgaataacctttggtcttccccgagaggaacgtgggcattaggctgcagcccacaggaagctatgtattttctgagaaacttggcccatggtgcagatctgctccagctcactctggtgggatcacgccagccacggccgggccacggcacatcatggcaacgtgctgcccacctgctacgccacctgtttttctagaggcggacgtgatcccagcaggactggagtcagcccagggcatcacgtgctctggtccccgcctgctttgactcctcctgcctcactccccccctggcctgtagtcacgttggtgagggtggtgggcaccggggctgggcccagcccccgaccctgcccagacagactttcctaaggcacccttttcctcgtgcaggtgcggcctcagcccacccccctttgagcccacagattgcacccctctggtgtgcggttacctcttgcctatgtttaattcatggctggggggttgggacgagcttcccaagaaaggaaagaactcccctggggtcttgcccagtttctgctcaccagaaggaccatagccgaggtcctcctcccagggcccggggctggggagcggaagccatcagtgggctcggaggacactgtcccagccaggacacggccatcggtcactaatctgcagcactggaatgtccgcaggccaatcagcggggtctctgggggctccccaagggtgctaataatcccacaatgattagcaggggccgcgggtcagtgcacgccactctgcctgctgtcgggggcgggctggccaggccgaggccggagcaggcaggcatcccccggagttgtctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggaggtaagggacacctggtgaggaggtaggtggaggcaccattatgagctctgaggagtgggtgctaggagacttctggaagcccggtcccaggcctgagccccaggccgtgcgggtggtttaatgaggaagccctgggacagcccgggggcggtgaggggtggatgctggactggggaggaaggaggaggaaggaggaccagggctggggtcaaggaggaacgccgaggagcgctgtggctggggcctggagaaatccgtggcccggaggagccccagacaggggcctgcgggagccagggctggcccctacacccagcccgcaccgctgttccctcccgccaccccaaccccagcactcagcccacgcctgctgtacctggtctctctctcagcctcgctccattgctatgccccacgtcccctgcacccaccacactcctctcccatcttgttttccaagggcagggacacatgcttattctgccgtgtgttgggttcaggtccccccatcctcgggctgcctgaccttctctctccaccccagccctgaacaggaaggagagtttcttgctcctctccctgcacaaccgcctgcgcagctgggtccagccccctgcggctgacatgcggaggctggtgagtacccgacccagctgggctctgccaggggggtggccggaggcgcggaccccagagggcggctcaggaggccacgcctgtccaggtgcccttccacttgaccagggtgggcaggcacagccagccaccttgcccctgagggacggaggccctggttgctgggggtctctgcagtttcttaaccccccaccctcagttcaggaggtcgggccccttggctcccactcgcctgaagggcaggaccttgggccttccctggcatcttgttgccacagagaccaggagccacaggaggagccggatcccctcctccagggaaggggagcttcacgaggagccctgcaggatgggcggccgggccagggagggagaaggtcgtgctgggctggggaggggcttctgtgcggcaaggacccagcgcctcctcctgagcttatctgagccacgaggacgggccttgcccatgttctctgctcactcactcgtccacattttccacattttcagcaggggccgggggtcgggggtatagagttccccaccagcccggctggggctgcggggttgggactgtcatctggaggctcagaaacgctgccctccattgtctgggaccccagcagccccagcccatgttagcaggccagggagccagggcagggtggtgggggcgggagggttccccatggctgcttcccatgaactcctccaaggcaggtggccacagtggcgaccttgagcactctagggtcagtttcccaggaggtgggggtggggtggctaaatgcggggggtcgcttctcccccattcccagccctgagtggctctgcctctcctcaggctcagaccctgggcaaccaggggtgctcccagctgtgacctccgtggttgggtactcctgcctgggaccccaggaggggctgcggtggtcgttggctggcagctggcaccctttccagggcccttttgtcaaagtcttagaaaacttcatttccataaaggtgcaaatggagctccatggctcagcctccctcgtggcccggccccgagcaccctccgggcctctagggctccagggcaccccttctttggacacagtggagactgaaggtcttgtgggggtggagggctgctgagggaccccggggagcccccagctcctggccccagccttcatcagaggtaaaaccccgatggacattagtgcaggatgaagttggcttggggtgcagccccgaggggcccccctccctgcatccactcagtgcttgtgagtcctatcctgcaggcacctccctgctccgtttacagatgagctcagggagtctcgggagatcaggggactgcaccaagtcacccaggggtggtgattgccaggcccacttgtttaagaagagggagggggctgggcacggtggctcacacctgtaatcccagcactctgggaggctgacacaagcagatcacctaaggtcagcagtttgagaccagcaatggccaacatggtgaaaccccgtctctactaaaaatacaaaaattagccaggtgtggtgtcacatggctgtaatcccagctgcttgggaggctgaggcaggagaattgcttgaacctgggaggcggaggttgcagtaagccgggatttctccactgcactccagcctgggcgacagggtgagactctgtctcaaaaaaaaaaagaagagggagggggcggggtcagctgtgcgtggtggggagcatatgaggccaggctcctgggggcaggagactagggcagagaggcgtggctgtagggctttttgcatcacaggagggcagcatggccgggtgggagcagtggagcctttctgacaatggccagggcccaaacacagaaccagtctgcaacgcgtgggcactgctcacatgaccagatgggagaaagacagcaggagcgggtcccactgcctgggcagggccgaaggatgcccacgacaggatttggagatggaggctcagtcgtgagaggagctgggctcctcctggagggacatcagacaacaccagtgcttcctccagcaggactcctcatccagtgctctctttgccacctgacctggcacccggtggatgctcagagatggcaggggagttgaatctttgaggcctggcccagcagtcaaaggcctcccacagatgtctgtttgtgctgcccccaggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcaggtgagtgtgctgcaggtgaggccagcgtgccagctcccagatacagacttccactggtccatctcagaagaggctacagtttgtcctaaatgttgggattccttttcctccaattggtttagttttactttttttttttttgatacggagtcttgctgtgttgcgcaggctagagtgcagtggcgtgatctcggctcactgcaacctccgcctcctggactcaagtgattcttgtacttcagcctcctgactagctgggactacaggcatgtgccaccaggcctggctaatggctttatacttttagtagagatagggttttaccatgttggccaggttggtcttgaactcctggcctcaagtgatccacccacctcagcctcccaaagtgctgggattacaggcgtgagccactgtgccccgccacattttttctttttttggagacatggtctcagtctgtcaccccaggctggagtgcagtggcgtgatctcagcttactgcaacctccgtctcctagattcaagcgattcttgtgcctcagcctcacaagtagctgggattacaggtgtgcgcctctacacccagctcatttttttgtatttttagtagagacagggtttcaccatgttggccaggctggtctcgaactcctgacctcaaatgatctgcctgcctcagcctcccaaagtgctggggttacaggcgtgagccaccatgcctggcctaagccactttttttcaatctgaaatataaataatttcaaacataaacgtatttatttatttatttgagacgaagtcttgttctgtcacccaggatggagtgcaatggcttgatctcggttcactagaacctctgcctcccagattcaggtgactgtcctgcctcagcctcccaagtagctaggactacaggcacgagccaccacaccccactaatttttgtatttttagtagagatagggtttcaccatgttggccaggctgggtctcaaactcctgacctcaagtgatccacctgcgtgggcctcccaaagtgctgggattacacgtgtgagacaccgcacccagcctcaaacgtaaatttaaaacggccccactcttacccactacctaggtttagaagatgctactaaactaaagccctgctcctccccttttcccgctgtccctccctggagggaatcttcccaaagttcaggagcatcactgccaagcaagtttccattttttctcttcattcaacaaatatttgttgagggtcttctacacacacctggtgctcttcagatgcactgaaaaacacaagcaaaatcccaggaaatatttaatacctccactacctgtgcaagtgggttgtgcatgtttaaatattacacaaggctgggtgcggtggctcacgcccgtaatcccagcactttgggaggccaaggtggcaggattgcctgagcccgggagttcgagaccagcctgggccacatggaaaaaacctgcctctacaaaaaaatacataaattacccaggtgtgatggtgtgcgcctgtagttccagctacttgggaggctgaggtaggagaattgctggagcctgggaggtgaagattgcagtgagctgagactgcgccattgcactccagcctgggcagcaggagtaaaaccctggcttagtaaaaagaagaacatgtgcccctacaactaggtgctgccaaagtgcttacgccaactgtgcagaccagcaaaccagttcccacttcccgaagatcttctggctccttaatttttttttttttttttgagacggagtcttgctctgtcgcgcaggctactgtgcagtggcgcgatctcggctcactgcaagctccgcctcctgggttcacaccattctcctgcctcagcctccctagtagctgggactgcaggcacacgccaccacacccggttatttttttgtattttgtttagtagagacagggtttcaccgtattagccagggtggtcttgatctcctgacctcatgatccgcctgcctcggcctcccagagtgctgggattacaggtgtgagccactgtgcccagccttggctccttaagttttgtcagactcaaaggtgtgaaaaacctaactctgttttgttgttggtggttgttttttgtttgttttgtttttgtttttgttttttcgattcagagtcttgctctgttgcccaggccagagtgcagtggtgcgatcacagctcactacaacctccgcctccccagttcaagagattctcctgcgtcagcctcctgagtagctgggattacaggcgcctgccaccacacctggctaatttttgtatttttagtactcctgacgtcaggtaatccacctgcctcggcctcccaaactgttgggattacaggcttgagccaccacgcccagcctctattattgtttctaattttcttgatgtgaatgtttagatcattaattttaaatcattttttgtttctactatatacatttaaagctataaatttccctttaaacgatttcagctgcatccaataagttttgatgttttttctatttccaatcatgatgttgtttttgtttgttttgagacatggtctggctctgtcgcccaggctggagtgcagtggtgcaatctcagctcactgcagcctcaatttcctgggctcaggtgatcttctcacctcaggtccggagtagctgggactacaggtgtgtgccaccatgcctggctaattttttgtatttgtaatagagatggggttttgccatgttggccaggctgatcttgaacttctgaactcacatgatccacccaactcagcctcccaaagtgctgggattacagatgtgaaccaccacacctggccatgatgttgttttagattttgaagtgtatctttaagtttctaaactatgttatcttctctatttacttgtaaattatttactttaaatttcattgcattgaattcatagaatgtgggctgtaggatgtgctgattctttgctatttgttgaaacttgcttagtggtctaatgtatggtcctcctttctggtttgcaaaagtcccatgcattcctaaaaacgatacatattctttaagtgttggatacatgtatatgatcacatgttcacatctgcctgctacaagccagtcttgtacatgtcatttttagtctctactggagagtttgtttcactcttcttatatattgcccatttgtgctatttccaagctgttgctgattctaagactttaaactggtttgcagacctgtatccattaggttttattgcatgacatactaccccaaaatttagcagcttacgattctgcaggtcagccacttgggttgggctcagcagggaggttttctggtcttggctgggcccactcatacacctgcaatcaactagggggccggctgggagctggctgtgcaaaaaggcctctaatggttcatctctgttccatgaggccttccaaactcctatactgagtttgttcatgtggtgactgagcatggttctatgagaatgagtggaaatggcaaggtctcttaaggcctaggttcaaaatcggctcagtatcacttctgtggcattctggtggccaaaccagttacagagccagccagattcaaggagcaaggaaagagacacctctctttgctgcaaaaagctgcagagtcacatttaaaggagtggcctggtgcaagaaatgaatggttgtggtcaccatgcagtcacaaggcccttgatgttccagtctttttttggctactcccctccacccatcaacaatctcccctcatttcaggtacctcccctctccatccccctctcaactaagaaagccttcctaggccgggcacggtggctcacacctataatcccagcactttgggaggccgaggcaagcagttcacctgaggttgggagttcaagaccagcctgaccaacatggagaagccctgtcgctactaaaaatacaaaaaaattaaccgggcctgtaatcctagctactcgggaggctgaggcaggagaatcacatgaacccaggaggtagaggttgtggtgagccaagatcaggccattgcactccagcctgggcaacaagagcaaaactccatctcaaaaataaataaataaataaataaataaataaataaataagccttcctgaactattcccacccatgcttctacccctgcccaggacagctgctgctcctgagccctcgaggaggtaagggagccctctgttcacctggatgatagcgaaagctgtgtccccctccccaggggtggttcacaatagggtttctgatcccctgtgtctcctgtagctcgtgtgggccacctcaagccagctgggctgtgggcggcacctgtgctctgcaggccaggcagcgatagaagcctttgtctgtgcctactcccccaggtaagccctgctacaccctctgctgggatgtctgggagacagggaggggtgctttcaccgagggtgagattcccacacatccacccgaaagtagagtccctgatgccttgctctgcacccttggtgggagaggggaggagaggaaaggcagagggtgctaaagattctggccacgcagaaggtgctgctctgcggatgtcccttcctggatactggtcctggtatcagggagtttgtccaggattggtttggaggccatctcttctctcccagggaatctccctatctcacccagctccctgactccctggcctggccgcaggagctgaaggggccaggggggcaggcagcagggccctgcctctgccttgcccaaggccaggccctcccacaccctgtggtgcctgctcgtcctcacagaggcaactgggaggtcaacgggaagacaatcgtcccctataagaagggtgcctggtgttcgctctgcacagccagtgtctcaggctgcttcaaagcctgggaccatgcaggggggctctgtggtgagtgcatgagggctcagtctggtgaccctggggtgggggtggtagcatcctactgggctgtcccagaagccctggcccttagcacccagggaggctcctgcccggcctgctgggaggagacccttttctcagagtcccctcctcctctgaccagaggtccccaggaatccttgtcgcatgagctgccagaaccatggacgtctcaacatcagcacctgccactgccactgtccccctggctacacgggcagatactgccaaggtgagggcactggagcctgggtgtgcccagccctgctctcgtggcaggtcctagggctgctacacttcctgagagtctcaagggtgtcagaggtgctgactgtgtactccctgagtctgcccactgcatacattctttcaacaagcattcactgagcactagctgtttgccagaccctgagctgtgcaggagattcaaagtgaaatcaggttcagccccttaggctctgggaggaggacagaattaggacccagaagtggattcttgccctactgcccctctaccctaacccactctgtgaccatgggcaggtcacctcccaaactccaatatgcctcactctgcaatggggaccaaaccaaagacaccaggcgtgccagcaatcggaagccttggtgggttctgtctatgggaggggtattcttgctgtggttggcattccctggatgttcgaggcctctggggggcagcgtggggtccagaaggctgggggctgagcctctgccccactgccctgccctggcagtgaggtgcagcctgcagtgtgtgcacggccggttccgggaggaggagtgctcgtgcgtctgtgacatcggctacgggggagcccagtgtgccagtgagtcctgccccagggcccccaaagagccagctcctctcaagaccccccttcaatggggcatcagctcccaggagcccgctgtgtgcctctctttccaactcattcagtgacaacacgttgagatcttgaaactggccacagcatggatatttacaccaaagaaattggcaaatgctataaaccatggatttttttttttcttttgagagagagcaagctcaatattccaacttaccagctcgctcctgaccctcaccacccactcttttggagcaggtggccagaggaaggggcaccctgagcttagctccccggcagggcaggaaagggcagggattctgaagtccacacacaaactcaggctcccctaccccagccaaggtgcattttcccttccacacctgtgacctgaggatcgacggagactgcttcatggtgtcttcagaggcagacacctattacagagccaggatgaaatgtcaggtgacagtcacccctagcttcctaggaaccccctagggcctcaagtgagggtcttaatgcagggaccctggagtgagaggtggttccttccacgtctctgacctcaccctattcatcagcataaagcaggggtcgtggactccaaggctcatagaagccaggaggtcacttattgacctgaggggccaaggtcaagaccaacctccatctaagggagttccagccactggttgccttgcaggaatgcaaggtcagggtggccagagctcggggttgttcaagaaaaccagcaacccagacttccactggcaactctcgaaaccacaattaattactggggttggcaatcaacttggatatatttaagacactgtgcaggtgaaacagaacctcctcaggggccagaccttgcctgggcttgtgggctgctggtcgcgcccccgtgcacagggagaagagaagcagacgggagcagaagggacccctgctcttggaagggaggctgtgcgggctgggggtgatgatagcccggccagcacacacacgtggcatcttaggccatgggcaggggtggcaggaaggggcagcctgggctctgggagccttgcctgtgtgacccagggtggggttacagaggaaaggcggggtgctggcccagatcaagagccagaaagtgcaggacatcctcgccttctatctgggccgcctggagaccaccaacgaggtgattgacagtgacttcgagaccaggaacttctggatcggtgagtgcccagctgattgggggtatggcgagtaaggggttgtgatgccccaccctgctgcaggaaccctgggccatggcggctgccagcagatggcaagggtgtgttgagggcctggagcccagagcggggccagctgctcaccccctttcccgggaagggcccaggtagggagcacatgggggctgccagcgctgggaagaggggccagaaaggcagctggcagcagactccagggtctgagtgggccaaccttgactaccccggcccagggctcacctacaagaccgccaaggactccttccgctgggccacaggggagcaccaggccttcaccagttttgcctttgggcagcctgacaaccacgggtaagtgtggggtgcctccctcccctgggcctccttctcacttgggcctgcctggtggagccccccatcccgctgcctggctgggccctttgagggtctgatccttccctggtgcctgcccaggtgccagagagttgtgggcacagctggtgtgggccggtggtggggtgagggagatgcaagccggaaggcacgtcacgtgggggagagagggacccaggaagcctccatccatctgtccatccccagtgtcccctggtgtgactccatccctccaattctcatccactcacccctccgtctgcatgccctctgcctgcatcagttacactgatgccagcattccttagctgtcacccacctgcactcattcacaatacaaccctgcacctgcagacccaccagccatcctgtagcaagaaccctctggtcacgtggccccaccctgctcttcaaagcccagcaatgcccagggccagggtggaggtggtccggctgcgaggccaccaagggctccagcgatttcagccagccctccttgccaacagccggcctgtgcccctggcctcttgcctggaggaagtctgggccttgttgggttcccaggtgtacctctcaagtgggctgtctattccagtccccaccatccccacaggctggtgtggctgagtgctgccatggggtaggcagagctgttaccccaggaaggggcttccctgagaagtggagcagggctgggggcttggggacgggcctggctcccggcagccccgtcggcaggtgggggcactggagcccctgagatgcagggtcctgatgggtggagggcttaggcctctcccggatccctgacttcactcttgcctcctgaccaccacaccatggcctgcaggtttggcaactgcgtggagctgcaggcttcagctgccttcaactggaacaaccagcgctgcaaaacccgaaaccgttacatctgccagtttggtgagggacttcctgaggctccccttctctgatctctgaccctgggggtgctgctgacccggtccagcctgcaagggtatctaggtggcaggttcagagtgggtctgggcacacggggccatagaggatgccctgttgatggccttgtacctgtgggctcctgagcccagaggggcaacgacgggcccagcttcatacagcaaggccacgcaggaaggactagagctacagctctgcaggggatttctccaaggaccctctcctgtcatgaaagctgctgcctgggaacctgttgggttccttggtgttcccgggagccccatgaactgtggtggaggcggaggtgaaacctagcatggcaccagctcccagcagcctctgctaggaaggcctggagcgccacagggaccacggccatgggcacttccagaccgagtgcaacagggctgccatcttgggactgcctgggctgccatcgagccctgctctcttctgcttccttccagcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggggcagttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcagacatcacccacaaggggttatcactgtcccagtttacagcggaagaaatgaaggcagagagattgagtaacttgcataagatcatacagctgggagtcaaacccagtgagtctggctgtcatttatttattttttttcttttcttttcttttttttttttttttttttttttttgagacggagtctcgctctgtcgcccaggctggagtgcagtggcacgatctccgctcactgcaaactccgcctcccaggttcacgccattgtcctgcctcagcctcccgagtagctgggactacagacgcccgccaccacgcccggctaatttgttttttgtatttttagtagagacggggtttcaccgtgttacccaggatggtatcgatctcccgacctcgtgatccacccgcctcggcctcccaaagtgctgggatgacaggcgtgagccaccgctcccggccctatttttttcttttttgagacagagtctcgctttgtcgtacaggctggagtgcaggggtgcaattggggttcactgcagcctcgaactcccaggctcaagcgatcctcctgcctcagccacccaagtagctggaaccacaggtccgcaccaccacgccccgctattttttgtgttttttgtagggacggggttgcaccatgttgctcaggctggtctcgaactcccgtgctcaagcgatccgccatcctgggcctcccaaagtgctggggttacaggcatgcggcccggcgccggcccagtctttccctctcccactgcttcccagggcttcgcctgtctaaccgggcgcgggcagttgtcctgtgtcctggctcagcgcggacctacgcggggtggtcacacagatgcccccagctctctctacctcccgcgaaggcgctgagccccctgatccctgcccgggcactggcgcaaggtcgcctgcgagcgccaggccttcctgcccggtgggagacgggagggcccgctctccggctcggtctggttcccgggtcagccagcagccgcgcctcttcctcccagacccgggacccgccccttggccggggccgcggccgcagcgcccggaggggccgccctgcgcatgcccgcgggaggtgggtgacccgggagcgcgctgcccgaggccggggggcggtggggacagcacaggcggggcggccgaaccgagaccttcccaccccgccccacgcctggttggggacctgacgcgccgtcgtgagtggggcgggtgcaggtgtccctgggggccgggggcagacactggtgcgggacgacctgctcccgagggggtccgcaggccacacccagagaaactggggcgcctccagtcaccgccgcggtccgccccgccggaggctttgaccccctgaatcagcgtcggggcagggatccgcgtggggtggaagaggctgggaaacttgggagtcccgggcctcctctggagccgcccgcccttggctggctggtccttctcttcctcggctcccgccgggctgggccctgggccgccctcactccctcccctctgcagcctcccttgcgtttgtcattcactctgccaggctctccttctgcctccgcatgcccaacgatccggagaaaaacacggaccatgacatcaaaaggccttggccaaggaatcgtgattattgtgatacaagattctgcacctcaaaggggatccctgtagtgagttttggaaaacgtacaaagcctgacttacaatatgcctgttatctgtggcgtttcatctggggaacttacttttccttgatagggtaaactattctcatccagagtatgtccctcagtctgtaaaagtccatggtgccctacatctattaggggagtgaggaagggcagtgggcattggatctgcttctttgaaagcccccacctgtgtttagcttctgttagaggcctttgaaccagagcaactccatcttgagtaggcgctgggtaaaatgaggctgagacctactgggctgtgttcccaggtggtggaggcattctaagtcacaggatgagatgagaggccggcacaagcagtaaagaagccgcggccaaaacccaccaaaaccaagatggtgatgcgaatgacctctggtcgtcctcactgctacactcccaccagcgccaagacagcttacaaatgccatggcaacgccagaatgttaccctatatggtctaaaaaggggaggcatgaataatccaccccttctttagcatataatcaataaataaccataaaaatgagcaaccagcagccctcggggctgctctatggagtagccattgttttatttctttactttttttttttttttgagagggagtcttgctcttgctcaggctggagtgcagtggcgtgatctcggctcactgcaatctccgtctcctgggttcaagcgattctcctgcctcagctttcgagtggctgggactacaggtgcccaccaccatgccggctttttttttttttgtacttttaatagagacggggtttcaccacgatggccagggtggtctcgaactcctgtcctcagatgatctgcctgccttggcctcccaaagtgctgggattatatgcgtgagccaccgcgcccagccctattcctttactttttttttttgaggtggagtctcacacctggcctccaatatgtttattcatattgctgaggcaggggattgcttgagcccaagagtttgaggttgcagtgaaccatgatcataagctgtatttcagcgtgagtgagagattgagaccttgtctcacaaaataaaagttaaaaagcccttatctggaggtgagaaagccaaatacaaaggtcttctcagttggttcccagtcttcccagtccagcagcctcagcatcaccagggagctggttaggcaaattctcggcggccccaacctactgaattggagaccctgaagatggggctatctgaattttaacaaggcctccaggtttgcatgctcaagattgagaaccactggcaaaagcaaacaatttgaatctgaagtcagcccacctgcatttgaatacaggccctgccacttaataactgtgatttagagcaagttagttacttaacagctaggttgaccaattgtccgagtttgcctggcactatcctgatttcagcactgaaagtactacattatcgctgtggctcacgcctataatcccagcttctcaagctgtccctgtggaatcctcaatatcggtacattcatccctatctagcatccccttcctccctcacccatcctgcaccctcagaattcattctcagatcagcttcccagatttttgccaatatcaattaaaaaaattttttagccaaccatgtactgtgagtaagccaatatcaattagcaaaatctttaagtttcttttggtgattcagtatcttccccctggagttttttgatgattcagtaccctcctagatttggcccctggggcctgcggggatgtgacttgtcatttaattctggagaaaatgaggggtagggcttataaggagactccttcggggcagggtcattacagggtgtgttacatagggaaatgctagctgctggctagctctcgctcttgaaaggctcttcctccctcaactgaaatggggaagggggaaccccggccgactgaggtcctgacatctttagcacatggcttcttaggtcacccagggcatccaggttaccagcttgggaaacaggagatgtaggttggaggaagaggctacagcccaccctggaaataactgccatccgtcccacccatatggttaggctttgtgtccccacccagatctcatctcgaattacaatccccacgggttgagggatggaccaggtggaggtacttgcatcctgggggcagtttcccccatgctgtgctcgtgacagtgagtgagttctcacgagatctgatggttttaaagcgtggcagttcctctttctcgtgcttacatcctcgtaactatcctgtggagaaggtgtctgctttcccctacctccatggttgtaagtttcctgaagcctccccagccgtgtggaactgtgagtcaattaaacttctttataagttacccagtctcggtgtttgcttttttgagatggagatttgctcttgttgcccaggttggagtgcaatggcgtgatctcggctctttgcaacctctgcctctcgggttgaagctattctcctgcctcagcctcccaagtagctgggattacaggcgtgaaccaccacacccagctagttttgtatttttagtagagagggggtttcattatgttggtcaggctggtctcgtgctccaagcctcaggtgatccgcccacctcggcctcccaaagtgctgggattacaggcatgagccaccgcacccaaccttggatgtttctttatagcagtgtagaaacagactcagccgtcgctgcaggccatacctcagctacatagaacacctaactgcccgcaagggagttcctgctactaggatcttcagagtgacaaagaggaagctttggctggcaagggtggtggggaggggaggggctaggtacctaaggcttccctatctttccacacagcctaattttcatagcctctggtctccacatttcactctttcccaaataaagaccttttaaggtgtgggtccccttggtcattctgtaaccattggatcaagttttcagttttttctgctctctcagctgcaaaataacacattcgagttttggtttttttttttttggagacaaagtctcactctgtcgcccaggctggagtgcagtggtgtgatctcagctcactgtaacctctgcctcctggatataagcgattctcctgcctcagcctcccaagtacctgggattacaggcacccgccaccacacctggctaatttctgtatttttagtagagacggggttttgccattttggccaggcacactcgggttttctaaccataccttgagccaagaatttggattctgagcttgtcttttcatttaagctatgtggcgctgttagcatgaccgccctgcccagcagatcttgacttcagtgtaatctttattctcttctatggcaggagccattaggtcccccaaagccttgcctttgatgggtactttgttcccggggacaatgggattagctgtcttgccagggcgtgccatggggctgctggtgtcctgtcccttaataccagctggattttcactgtcctctgaccactttccagccttcaattgctcctgtttcctttggggcttcttgctctgtccagtcctggtcctatttttgtgagaatcaaggttcttagttttaaccaacagaaactaattctggcaactctaaacagaaagggacttggtcagaggtcctggctagttcccaggagctcaaaagggtcagaaaatcaaatcaggaagaggacattgggcaaagctggccaggtgaagaccccacagcctctgctggcacagaagctacaattggcaccaccgaagtgggacagaagctgccacctgtgcaagctagatgtagtcgctgccgctgtcaccatcaatttttgagatgatgcttcttcctgcctgccactttaattcaaagcgaaggccaggtgcagtggctcatgcctgtaatgccagcactttgggaggccaaggcaagaggatcgcttgaggacgggagtttgagatcagcctgggcaacagggtgagaccccgtctagccaaaaaatacaaaaaaaaagagctgggcagaaagaaaatggctcatgcctgtaatcccagcacttcaggaggccgaggcgggtggatcacctgaggtcagaagtttgagattagcctggccaacacggtgaaacactgtctctactaaaaatacaaaaaattagtcaggttgggtggcgcacgcctgtaatcccagctactcaggagactgaggtaggagaatcgcttgaacccgggaggtggaggttgtagtgagctgagatctcaccattgcactccccgctgggtgacagagcaagactagtctcaaaaaaaaaaaaggggccacgtcgatggaaggacaagaataaagaaactgaggccgggtatggtggctcacgcctgtaattccagcactttgggagtccgaggtgggcggatcacctgaggtcgggagttcgagaccagcctgaccaacatggagaaaccctgtctctactaaagatacaaaaattagccaggcatggttgcgcatgcctgtaatcccagctattggcgaggctgaggcatgagaatcacttaaacctgggaggcggaggttgtggtgagccgagatcgtgccattgcactctagcctgggcaacaagagcggaactgtggctcaaaaaataaataaataaaaaatagagacattgggccaggcacagtggctcgtgcctgtaatcccagctctttggaagaatgaggtaggaggattgcttgagcccaggagttcgagggtgcagtgatcacgtcattaaactcccacttgggtgacagagtgaggagctgtctccccacccccatcccccaaaaaaagaaggtaactgggcaaagaagttatttttagtagagactggctttcatcatattggccaggctggtcttgaattcctgacctcaggtgatccacccacctcggccccccaaagcgctgggattacaggtgtgagccacggtgcccaacctcctcttctcatttaatcctcaaaatcatctcacaaagcaggtgctattaatacccgcgtcttacagaacggttaacagatgtgtccagggccgcatggagaacaccttgagagagcaatgagatctcgctctcctgcctcatgaccgatacacggtttcaagaagttagatgacatcacagatactcagggcacccagctccaggccttactgccttcgcacaaggccgctctctactagcttcaccccgcatggaatgcaatggtcaatgaggccctggtcagaacatgggactgacaaagccagcacttgtaggctgagtctcagatcacgtggcttgtttgttttgtttgtttgtttttgggagatggagtttcactcgtgttgcccaggctggagtgcaatagcaccgtctcagctcactgcaacctccgcctccttgttcaagtgattctcctgtctcagcctcccgggtagctgggactacaggtgcatgccaccatgcctggctagtttttgtatttttagtagagatggggtttcatcacattggtcgggctggtttcgacctcctgacctcaggtgatccacccaccttggcctcccaaagtgctgggattacaggcgtgagccactgtgcccggctggcttttttttttttttgaggagtcgcactctgaaatccaagctggagtgcaatgatgtgatctcccaccatgctagttgtgtttgttgttgttgttttttctttagtagagatggagtttctccatgttggtgaggctggtcttgaactcctgacctcaggtgatccaccccccacctcggcctcccaaagtgctaggattacaggcgtgagtcaccatgcctggcctcaatttcttgaaagacaaagaaaaaagacagaaagagagaaagaaagaaaaagaaaaaaaagagaaagagaaagagaacaagaaaaagagaaggaaagctccatgggtttaaatgcaagagtcagcttcaaggagggctgggaagtcaggtgacgccacccttgtgcttcccgcagccagatcacctggtggaggtaccgttggttttgggcccctctctcagcacttgctaccagagaggacagctctacaccagagagtgagggtgggaacctgctcactgctgtctgctcagggctgggcatgaggcaggtgctcagtaggggtctggagaataaatgaatgaaccatcacggggccaagcacctggaagcgggctggagatgcttgctctggactcctggctcaggagtggactccccaggtggacttcctcctgcatcaccacagctgagtgcatggagcacaggtagggcagctaatgagcagggtcatcatgaatgacagcagatgacaccaggacaggggaggtcagtagccagatgggaagaaagcagaatgaaacaggtcacccgggtgcagtggctcatgcctgtaatcccagcatttcgggaggccgaggtaggcagatcatgaggtcaggagatcgagaccatcctggctaacacggtgaaaccctgtctctgctaaaaatacaaaaaattagccggacgtggaggcgggtgcctgtagtcccagctactcgggaggctgaggcaggagaatggcgtgaatctgggaggtggagctagcagtgagccgagatcgcaccactacactccagcctgggcgacagagcgagacagtctcaaaaaaaaaaaaaaaaaagttctggcggagagtgtgggtgagcactagggtactggaaagattccatgcctgggaatcgtgcgtggattgattacatccccacttctggcaaaatgcttcatggccttgtgcaagttaactttgtctccctgggcctctgtttactcatctgagaaacggggtaaagacatttgctcttcttaggtcacagggctcctgtacacgatgtgaaaggactttggaaagtatcctccggtgtgcaaatttctctgagaagtgctgtggctgtttatccttagactggaatgagaagggggagatgtgacttttgtgactttcagggtgggccaggtgttgtaggtgacaggacaatctcaggctggtagcagtggctcatgcctgtaatcccagcactttgggaggctgaggtgggtggatcacttgaggtcaggagtttgagaccagcctggataacatggttaaactccatctctactaaaaatacaaaaattagccaggttggggtggtgtgtgcccggagtcccagctactcaggaaggtgaggcaggagaatccttgaacccgggaggcggaggctgcagtgagccaagattgctccgctgcactccagcctcagcaacagagtgaaactccatctcaaaaaaacaaagacaatctcagatgtgcagttcacaccctggggctctccgtgggatcaggctgagggtcgcatttaactgaaatcttcaggagttcagcgtcggggtagatattccctgagaagcagctgagaggtaaagcttcctccgggaagtactcacttgctccttgttgatttcatggggtctcaggtttcaggaggaaagtaaagatgaaaagcccttgctctggcatcttggaggacttctgggtgagagccaggaaggggaaggcgtttggactcattgccctcccaggcctggagtctgattttcctgctctgtctggttttggaggtggaggctgcgaagccgaagcagtgctggtcctgccagctcctcccagctcctcccctgccctctgcttccctggccttgcacagggacaaggagctccaaagagcggctctgtcctgtctcagcctgggagggaagagggaggtggcatagatggttccacaaacagttcagtacgtgccaaaggagggcctgggaagccccaggtcaggagagggtgcctgcccttcccgtgaaggccagggctgagctgcttcctgccagcatccagttttgctcagagcacccagaacgccgtcttggaggaacgggggcaggcgctgccgcagaaccctggagctgtgtctcctgcctccagggctggccgtagctgcaaagaccagctggcaggtggaggactcaggaagactctccctgtgttggccctgcagccccatgtccccttctctgcttcttgggaacaggaggcctgtgtctgcctgtcctgagcatctcaaaaggaaaagctattctagggatgatgagagggaatcagggcctgaggcacttggaggaacatttgctgagctccctgtgcaacagcccattccaaggccaaggttgcaaaggtggcttagatgctgtccctaaatggccatcgaggttccaagcctggcaggaagggctcgagtggtggggccacagcggagacaaggccaagcagcctgattcttgggagtggaggttaatgagcagcgtttgcacttggctttctatagggtcaggctgtagtgcaacatcctgaggtgcgtggctgcccacaggtgctcagccagcccagcctctgccaaggcagacagagcctgggctgggaagcgggggatcccactgcttggggagtccccttttcttctgcatagtggggatgccaggagcagtgaacaagctcagcaaagagttctccagcccgacccgaggtttccttcctcctgactttgtcacctcactgggagaatatacagctctgtctgaaacaagtttcctgcggggcaccctgtgcaggggaagctcgggcagcccaacctaccagatggaagggaaagatagaggctgtgaggttcttctgggcctgtctacagcctcttctacctggctgccctttgttcagagtaaaggatgcagttcccaagacataagcaccgcgggcttcagagtatgaaggatccttccaggtcagccactttgggcaactggtgagcaaggcgggtgtgcagggccggctacatcatttgtggggcctggtacagaatgaaaatgtggggcccttattcagaagttactaagaatttttttttttttagatggaatctcactctgttaccccggcgggagtgcagtggcacgatcttggctcactgcaacctctgcctcccgggttcaagtgattctcctgcctcagcctcccgagtaggtgggattccaggtgcccgccaccacgtctgggtaatttttgtatttttagtagagacagggtttctccacctggctggtctcgaactcctgacctcaggcgatctacctgccttggcctcccaaagtggtaggattacaggcatgtgctaaaaatttcaagatgaggacagcagagcataagtgaagcgcaggacccttgcaagtgggtccgtctgggtgtgactgcatttggggagaaggggatggggtcctgcctgtccctgcagtcacagcataccacgagtcctggggcagaggagcctggattcaggcccttggtgctcagcggtcctggctcacggacacccctcgttcagcagccagggggttcctcactgtgtcccagatgtcactctaaagattgcttcagaggctccctccccgaatcgttggagggactctgccagttccaatgaccagccagctgccttcaggtcacaaaagaatctggggctggtctgagaccaggtgtacccccagaccccatctctgtccagatcatgagagggggtccagggtcccccgcctcccacagttgggcttcactgcacagctggaactcagccaggcctgttccgggaagcagggctgtgagtgtgagcagtccaggaccttggcattttgaacaaagaattgaacaaaacccacaaagtaacatagcaatgaaacatgggaaggaagcagtgaaagcaggaatttatgaaacagataaagcactctgcagggctggagtgggcctaagcaagcggctcaagagcctggttacaaagtttcctaggtgttttgttagtttgtttttgtattttattttttttattattattatttttgagaagtctcttacccaggctggagcgcagtggcatgatcttggctcactgcaatctccgcctcctgagttcaagtgattctctggcctcagcctcccaagtagctgggattacaggtaagtacccaccacgcccggctaattttcatattttttgtagagatggggtttcaccatgttggacaggctggtcttgaactcctgacctcgttaatcggcccacctcggcctcccaaagtgctgggattacaggcacgagccatggcacccagcctcctgggttttaagtactgcttttgaggttctattggctaccccttatctggatgaaggatttggtctgtggctcataaaaggctaatgtgaactggcgccctgtgcagatgaagggatgacccatgcttcgcctgcggctaatccaggacactctcccttcccatctaagatgtggtggagacaggagggtgatagggtgtctctatattaaaaacacacacacacacacacacacacacacacacacacacacacacacacacacacaaaggcagccagactatgcactaggaactgccctgggaatcccgttgcgttctcacaacaatcccacttcacagataaagaaaccaaggcacagaaatattcagtaacgtgtccagatgcggtggctcatgcctgtaattccagtattttgggaggctgaggcaggcagatcacgaggtcaggagttcgagaccatcctggccaacatggtgaaaccccgtctctactaaaaatacaaaaattagctgggtgtggtggcaggtgcctgtaattctagctactcaggaagctgaggcaggagaactgcttgaacccgggaggcggaggttgcagtgagccgagatcacactactgcactccagcctgggtgacagagcaaaactctgtctggaaaaaaaaaaaagaaaaaagaaatactaagtaacttgtctgaggccacttagttaccaagacgtgggagctgggacttgaacccaggcagtctggctggattcatgcctgcagcctctgcactcctgctacttcctgtgtgagaagcgcctgttctgtggaaggttgtgggctgagatctttccatgacttccactcatttacccccaaggctgttcttaaagacgggcatgacagttatgcccattttacagatgggaccctgaggctcacaagggcatgccactcacccatctccacaaagctatagctcgtcagcagagggcagaattcggccgcctctcccctagctcgaaggctgtgattgacacagaggtttttttgttgttgttgctgttgtttgttcctttttcttttttttttgagacagggtcttgctctgtcatcccggctggagtgcagtggtgcgatctcagctcactgcaaactctgcctccaagatgcaaatgattctcgtgcctcagcctcccaagtagctggaattacaggtgtgcactaccatgcccagctgttttttgtagagatggggttagtagagatttgtttaatagagacgaggtttcaccatggtctctactaaaccctgtctctactaaaaatacaaaaattacccaggcgtggtggcacatgcctgtagtcccagctactcaagaggctgaggcaggagaatcactcgaacctgggaggtggaggttgcagtgacccaaaatcatgcactctggcctggggtctcgcttttgcccaggttagagtgcagtggcacaatcatagtggcttactgcagcctcaaactcctgggctgaagggaatcctcccacctcagcctcccaagtagctaggactataggcatgtgccatcatggcgagttaattttttgtgtgtttttattttctcgagacagagtcttgctctgttgctcaggctggactgcaatggcgtgatcttggctcaccgcaacctccacctcctgggttcaagcgattctcctgcctcagcctcccgagtagctgggattacaggtgcgtgccagcatgcctggctaattttgtatttttagtagagacagggtttcgccatgttggtcaggctgctctcgaactcctgacctcatgatccacctgcctcggcctctcaaagtgttgggattacaggcatgagccactgagcctggcctggggagctaatttttaaatttgttatagagacaagagagacaagagtctctcttatgttgcccaggctggtctcgaccccgtggcctcaagtgatcctcccacctcagcctcccaaagtgctgggattacagatgggtgtcaccgcagctggcctctgaggagggtttcattataaacctgccctgaagggagggaatccaattttacgagagggtgtagcctggtgaggcctggatgacctccgcaggcaggggcttgtgcctgggctgaggcctaagggacaatgggcagacatgaagttgccccaggcagagggtacagtgtgggcaaagtcaggaagtggcagggcttggatcactccaggaagagagaggactcacgtgtcacaggagctcgagacccagagagagagtgaggcaggcaggcagggaccaagcttgggcacagccaggaaggcaggacagggcatggtggggccaatggaatcattacccaagacgggcattttcagggaaacagcttagataaggccaggcgtacagtagctcccacctgtaatcccagcatttggggaggctgaggtaggaggactgcttgcgcctgggagttcgagaccagcctaggcaacatagtgagaccccatatccacaaaaaatttaaaaaaggagtttgtgttcctgtagtagcatacttgggaggttgaggtggcagtatcacttgagcccgggagttcaaggctaaagtgagctgattgagccattgcactccagcctgagtgacagagagatacgctgtctcaaaggaaatacaaattaaaaaaccagccgggcatgctggtgtgtgcctgtagtctcagctacttgggacactgaagtgggaggatcgcttgagcccaggagttcaaggctgccgtgagctatgattgtgcctgtgcactccagcctgggcgacagagaaagaccctgtctcttaaaaaaaaaaaaaaaaaaaaaaaatcttagaggatgctgtgcctccctgggggtcttcagtcacccatggtcctggcagcagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcaccaccatgccacccaccccgagtatcccctgggcatcctggcatagccagatgacttccgtgcccgttgcaataaccactgcttccaactctctatagaccaccccttgggtatatctaatgtaagtgatatttattttatttattttttgagtcagagtctcgctctgtcacccaggctagagtgtgctgatgtgatcttggctcactacaacctctgcctcctgggttcaagccattctcatgcctcagcctcccaagtggctgggactacaggcatgcaccatcacgcccagctaatttttgtatttttttcagtagaggtggggtttcaccaagttggccgggctggtctcaaactccccacctcaagtgctctgcccgcctcggcctcccaaagtgctgggattacaggcatgagtcgtggtgtctggccctaatgtgagtgatctttaacaatgaagacttgaaaaagaaaaccctgaagaaacctaattctttgatgtctggacgacaaggaagaagatagatagaagtggcatcagataataaacagtgtaaatgtttatcagaaagaggctggtggttgggaccagtaggaggatcgcttgagtccaggagtgcatctctacaaaaaagttaaaggattttttaacattggccaggcatggtggcacacatctgtgatcccagctacttgggaggctgaggcaggattgcttgaagcccaggaggctgaggctgcagtgagctgtgatcgagccactgcactccagcctgggtgacagagcaaaacccagtctcaaaaaataataataatattttacataaccaaccacttctaaagactaaaaaaaaaccctacaattaaaaacctcaggtccctcaggcaatcataccagatattgaaacaaagcaataacataaggactgcagtatttattttatttttatattatttatttattctttgttagtttgtttttggagtgtgggttttgttttgttttttgatttttttcttttgttccacccacagatttcttcttattgcccaggcttgagtgcaatgacctgttctcagcttactcaacctctgcctcttgggtttcagtcatttttctgcctcggcctcctgagtagctaagggaggagtcttgagattatcatccacggagggtggaagaggagagggtggaaggggaataagaagacactccagtgaagcacttgccttgcgtgcaaaaatgtaagggggcctctccctctccctctccgtctccctctccctctccctctccgtctccctctccctctccctctccctctccctctccctctccctctccctctccctctccctctccgtctccctctccctctccctctccctctccctctccctctcactctccctctcactctccccacggtctccctctcatgcggagccgaagctggactgtactgctgccatctcggctcactgcaacctccgtgcctgattctcctgcctcagcctgccgagtgcctgcgattgcaggcacgcgccgccacacctgactggtcttggtggagacggggtttcgctgtgttggccgggccggtctccagcccctaaccgcgagtgatccgccagccttggcctcccgaggtgccaggattgcagacggagtctcgttcactcagtgctcaatggtgcccagactggagtgcagtggcgtgatcgcggctcgctacaacctacacctcccagccgcctgccttggcctcccacggtgccgagattgcagcctctgcccggccgccaccccgtctgggaagtgaggagcgtctctgcctggccgcccatcgtctgggatgtgaggagcctctctgcctggctgcccagtctggaaagtgaggagcgtctgcgcccggcagccatcccatctaggaagtgaggagcgcctcttcccagccgccatcacatctaggaagtgaggagcgtctctgcccggctgcccatcgtctgagatgtggggagcgcctctgccccgccgccccatctgggatgtgaggagtgcctctgcccggccgagaccccgtctgggaggtgaggagcgtctctgcccagccgccccgtctgagaagtgaggagaccctctgcctggcaaccaccccgtctgagaagtgaggaggccctccgcccggcagctgccccgtctgagaagtgaggagcctctccgcccggcagccaccccatctgggaagtgaggagcgtctctgcccggcagccaccccgtccgggagggaggtgggggtggtcagcccctgcctggccagctgccccatccgggagggaggtcgggggtcagccccccgcccggccagccgccccgtccgggaggtgaggggcacctctgcccggccacccctactgggaagtgaggagcccctcagcctggccagccgccccgtccgggagggaggtgggggggtcagccctccacccggccagctgccccgtctgggaggtgaggggcgcctctgcccggctgcccctactgggaagtgaggagcccctctgcccggccagccgccccgtccgggagggaggtgggggggtcagccctccgcccggccagctgccccgtctgggaggtgaggggcgcctctgcccggctgcccctactgggaagtgaggagcccctttgcccggccagctgcccagtctgggagggaggtgggggggtcagccccctgcccggccagctgccccgtctgggaggtgaggggtgcctctgcccggccgcccctattgggaagtgaggagcccctctgcccggccagccgccccgtccaggagggaggtggggggggtcagccccccccgcccggccagccgccccgtccgggaggtgaggggtgcctctgcccggccgcccctactgggaagtgaggagcccccctgcctggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaagaaaattaaaaaaaaaaaaaaaaaaaaaacaggctacctacaatttgtgttgaagatatgaatgaatgaagtttccacacccttatgtggagttctgataagtaagcaacaataaggaagggtccccaggttggggagaccccaagttgagaacaataatgaacaattattgtatgaacaattgttagagacagctaatcacaaacaacctgcgggcacaatgaccccattccacacgtagcacccttcagcaggaccctataaaactctcctccagcccttgcctctttgcaggtagccccttctgtgctgagctgcccattgcaacatattttcataatttctctaataaatctgcccttctttacctacaactatcttggtaaatggctttaccacctgcaaaactgaccctaggttgttgctacccgatatggtttggctgcatccccacccaaatttcatcttgaattgtagttcccataatccccatgtgtcatgggagggacccggtaggaggtaatcgaatcatgggggcaggtttttcccatactgttctcgtgatagtgaatacatctcactaaatctgatggttttataaagggcagtttccctgcacgtgctctcttgcctgctgccatgtaagacatacctttgctccttctttgccttccaccatgattctgaggcctccccagccttgtggaactgtgagtacattaaacctctttttctttataaattgcccagtttcgagtatttcttcatagcagtatgaaaagtaactaatacactacctgagacaccttaggagatttgtaatagctgtaatgccaggtccaccatatttttagcataaagcaaatgtttacccatgatatgactgcacaggctttctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggcaacatggaaaaacaccgtctctacaaaaaatacaaaaattagctgagtgtagtggcacacacctgtagtcccagcaccttgggagggtgaggcaggaggatctcttgaacccaggaggtggaggccgcagtgagcagtgatcatgtcagaggtgtgtgaaccagagcaactccatcttaaataggagctgggaaaaatgaggctgaaactgctgggctgcattccctgatggttaaggcattctaagtcacaggatgacatagaaggtcagcacaaaataccagtcgtaaagaccttgctgataaaacaggttgcagtgaaggagctggccaaaacccaccaaaaccaaaatagtgacaagagtgacctcccatcatcctccctgctacattcctacaagcaccatgacagtttacaaatgccatggcaacatcaagaagttaccctatatggtctaaaaagaggaggcatgaaaaatccaccccttgtttagcatatcatcaagaaataaccataaaaatgggcaaccagcagccctcacggctgctctgtctatggggtagccattcttttattcctttactttctctttttcttttgagatggagtctccctctgtcacccaggctggagtgcagtggtgcgatctcggctttctacaagcttcgcctctcgggttcatcccattctcctgcctcagcctccagagtagctgggactacaggcgcccgcaaccacacttggctaatttttttgcatttttagtagagacgaggtttcaccatgttaaccaggatggtcttgatctcctgacctcgtgatccacctgtctcggccccccaaagtgctgggattacaggcgtgagccaccccgtgcccctcctcctttactttcttaataaacttgctttcacttcacactgtggcatcaccctgaattctttcttgcacaaaatccaagaaccctctcttggggtctggattgggacccctttcctgtaactatcatgccactgcactccagcctgggcaacagagcaaggccctgtctctcaaaaaaaaaaaaaaaaaaagtaacgtgacttaatacattcattttggagggtaagtctctcaaaataggcctttcactgggggaaaatggtaaaaatactccctggtaattcaagaattggagactcctgagatgctgctcatattagctgaacacttatcaatacttcactttcttccatatatactcaaggaacaagtgctatttaaagtgtttcactctgctgtgctaggtgcaagactataaagaggtgtgaggatcaacacttttatgaaaaccaatgtcattctgaatatagtttcagatgctagtgcaaaggaagctcttggtatacggaaaaagtattcaacaataaattaggcatggttgcttccattttctgcctcacatacctttttttcatggttaaagtgatataaagtctatgatattttagattggcagttgcaaactagtggtcctcagcgtgctttttatgacacctacaaggtttgaagactctgatttcatattaaaaatctgggtttcaggctgggtgtgatgttgcatgcctgtaatcccagcactttggaaggctgaggcaggagaatcgcttgaaccagggaggtggaggttgcagtgagccaagatcacgccactgcactcaagcttaggcaatagagcaagactccatctcaaaaaatgaataaataaataaaatctgggtttcaggccaggtgtggtggtgcactcctgcaatcccagcactttgggaggctgagatgggcagacagcttgagctcaggaattccagactagcctgggcaacgtggcaaaaccccatgtctacaaataatacaaaaaaattagctgggtgtagtggagtgtgcctgtaatcccagcaacgtgggaggctgaagtgagaggactgcttgagcctgggaggttgaggttacagtgagctgagatcaccctcctacactccaacctgggcaacagagccagaccttgtcttaaaaaaaaaaaaaaaaaaaaaaaaattctgggtttctggcatctcaaaaaaaaaaaaaaaaaaaggaaaggtcagggcacatggctgctacagtcctctattaagcaatgtgccacagcaggggtccctgacccctgggccatggacatgtactggtctgtggcctgttaggaactgggccacagagcaggaggtgaatggtgggtaacaattgaagcttcgtctgtatttctggctgctcctcattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttagaatctgccatgaatctgcagcctctattatatagttccctatagactttgcttcctaccgtcttacgttctgccttataggcatctcagtttgcaacccttgtttttgtcagtatgctacgctggtgacattgaccaaattgaccacacattaatgataagcttagttggtgatgacctcaacggaataacgtgacataagtattgtgacaatacttcttgcatgtatctacaggtggaattgtaaacctggtggtccgagatggtctaattcgatcttcctatgtatctccttatattaatagtggtaacatttgtggtggtgattcagcgtttcaatgcctcttctcacggcaacaacaaacgttttccttctgaatcaacattaacctagatgttactgcagatcaaaattagtatctacattttcaaccacagaaatattgggcagtaaaaatttttcttaatattgattgcctacataggttgtgtaattagcatatgtttatagttctatgatttgtgcctggctgctacagagctggagggggtaaagcaacagtgttttctcagttgtgtgagcagcattacattataataaataggtaatattaaactgggctgatgagagttgcaaaagactactttaatgttcatatggaaccaaaaaagagcccgcattgccaagacaatcctaaacccaatgaacaaagctggaggcctcatgctacctgacttcaaactatactacaaggctacagtaaccaaaacagcatggtactggtaccaaaacagacatatagaccaatggaacagaacagagccctcagaaataataccacacatctacaaccatctgatctttgacaaacctgacaaaaactagaaatgtggaaaggattcccgatttaataaatagtgcttggaaaactggctagccctatgtagaaagctgaaactggatcccttccttacaccttatacaaaaattaattcaagatggattaaagacttaaatgttagacctaaagccgtaaaaaccctagaagaaaacctaggcaataccattcaggacatagggatgggcaaggacttcatgtctaaaacaccaaaagcaatggcaacagaagccaaaactgacaaatgggatctaattaaactaaagagcttctgcacagcaaaagaaactaggatcagtgtgaacaggcaacctagagaatgggagaaaatttttgccatctacttatctgacaaaaggctaatatccagaatctacaaagaacaccaacaaatttacaagaaaaaaacaaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagatatcatctcacaccagttagaatggcgatcattaaaaagtcaggaaacaacaggtgctggagaggatgtggagaaataggaacacttttacactgttggtgggactgtaaactggttcaaccattgtggaagacagtgtggcgattcctcagggatccagaactagaaataccatttgacccagccatcccattactggatatatacccaaaggattataaatcatgctgccataaagacacatgcacacatatgtttatcgcggcactattcacgatagcaaagacttggaaccaacacaaatgtccatcaatgatagactggattaagaaaatgtggcacatatatactatgcagccataaaaaaggatgagttcatgtcctttgtagagacatggatgaagctggaaacgatcactctcagcaaactatcacaaggacaaaaaaccaaacaccgcatgttctcactcacagatgggaattgaacaatgagaacacttggacacaggaaggggaacatcacacactggggcctcttttgtggtgggggagggggaagggatagcagtaggagatacacctaatgtaaatgacgagttaatgggtgcagcacaccaacatggcacatgtgtacatatgtaacaaacctgcacattgtgcacatgcaccctataacttaaagtataatttaaaaaaataagtaaataaataaaaaaagaaacaattgctggctttgcaattctctttcctccaaaatcaccaaggcctcaatttactcattgctgaaaaaggacgactgtatatttttaaatgaagagtgttgtttttacctaaatcaatctggcctggtatatgacaacataaaaaaactcaaggatagagtccaaaaacttgccaaccaagcaaataattatgctgaacccccttgggcactctcttaattggatgtcctgggtcctcccacttcttagtcctttaatacctgtttttctccttctcttattcagaccgtgtgtcttctgtttagtttctcaattcatacaaaaccatatccaggccatcaccaataattctatatgacaaatgctccttctaacaaccccacagtatcagcccttaccccaaaatctttcttcagttgaatctctcccactgtaggttcccatgccgcccctaatcccgctcgaagcagccctgagaaacatcgcccattatctctccatatcacccccaaaaattttcgccaccccaacactttaccactattttgttttatttttcttattaacataagaagacaggaatgtcaggcctctgagtccaagctaagccattaagccatcatatcccagtgacctgcatgtatacatccagaaggcctgaagcaactgaagatccacagaagtgaaaacagcctcaactgaagacattccaccattgtgatttgtttctgccccaccctaactgatcaatgtactttgtaatctgccacactcttaagaaggttctttataatctcccccacccttaagaagtttctttgtaattctcctcacccttgagaatgtactttatgagatccacctcctgcccccaaaacattgctcttaactccaccgcctatcccaaaacctataagaaccaatgataatcacaccaccctttgctgactcctttttcagactcagcccacctgcacccaggtgaaataaacagccatgttgctcacacaaaacatgtttggtggtctcttcacacagacacgtgagacaggagttcgagaccagcctagccaatctggtgaaactctgtctctactaaaaatacaaaaattagccgggcatggtggcgggcacctgtaatcccagctactcgggaagcggaggcacaaaaattgcttgaacccaggaggcagagtttgcagtgagccaagatcacactgtctggcatctgagcccaagccaagccattgcatcccctgtgacttgcacgtatacatccagatggcctgaagtaactgaagatccacacaagaagtaaaaatagccttaactgatgacattccaccattgtgatttgtttctgccccaccctaactgttcaatatactttgtaatctcccccacccttaagaaggtactttgtaatctccccaacccttaagaaggtcctttgtaattctccccacccttcagaatgtactttgtgagatctacccctgcccacaaaacatggctcttcaccccctatcccaaaacctgtaagaactaatgataatccaccaccctttgctgactctcttttcggactcagcccgcctgcacccaggtgaaatgaacagccatgttgctcacacaaagcctgtttggtggtctcttcacacggacgtgcatgaaacacacgactgcacttcaggctgggcgacagagctagattccatctcaaaaaaaataaaaaggagtcacctcccctgagaggcctctggaccaacccatctgagcaggccactcttccttctctatcttaccatcttgtttctgtcccagtagttagggctacctccagtaatcctatttgtccctttactgtttagtgcgtctcacttgactagaagctccatgaaagcagagatcctacctacctccttcaccactagacccccagggcctggtatgtggtgatcgctcagggcccattttcttcctttcctcctcctccaagggtggggaaagagcatcagaaggtctaggtggccccaggcccaaacaatcctcctttaaaaggaaaccagattgttacaaaggtcagaggctgaaaagttatttccgccttttatccctctaaattcttcacttcctgaaaaaacaaacaaaaaaaagccactgagggcccttggactaaatccaggcctgagttgctgggcagaggtcagtcttgtccagacatgggaaaaaaataactcgagtcagacaggtgggtcaccagagaacgaatccagcctgcaaatggtgtgtgcaatcttcagctctgtccagacctgcctccctctggggatgcctttaaaggtgatgaatgacctggatgaatgggcttagaagagggaaaaacaaatatcacaggtcaaatcattatttgtcttcaagtttaacaccgtctactggactgaaagatgtccaaagaatagttgttcaactatgtaaattcctttttttttttttttttgagacagagtctcgctctgttgcccaggctggagtgcaatggtatgatcttggctcactgcaagcaacctctgctcctgggctcaaaccattctcctgcctcagcttcccaagtagctgggactacaggcatgtgccaccacgctcagctaattttagtattgttagtagagacagggtttcatcatgttgaccaggctggtctcgaactcctgacctcaggtgatccacctgcctcggcatcccagagtgctgggattacaggcatgagccactgtgcccagccaactacataaattcctaacaacgtatctccagaaagtataggcacaacagcacatgcagtcattcctgtaatcaggtgctccgggaggccaaggcaagaagatcccttgagcccaggagtttgagaccagcctggacaacatagcaagactgtgtctctataaaatatacaaaaattgggctgggtatggtggctcatgcctgtaggcccagcactttgggagaccaaggcaggaagatcgattgaactcaggagcttgggaccagcctggacaacataatgagacccagtctctactaaaactcaagaaaattagccagatgtggttgcatgtgcctgtagtcccagcactttgggaggccaaggtgggtggatcacctgaggtcaggaggttgagaccagcctggccaacatggcgaaaccccatctctactaaaaatacaaaaattagcccggtatggaggcatgtgcctgtaatcccagctacttgggaggctgaggcaggagaatggattgaacccaggaggcagaggttgcagtgagccaagatcgcaccactgcactccagcctgggcaacagaacaagactccatcaaaaaaaaaaaaaaaaagaaagaaagaaagaagaaaagaaaattagccaggtgtggttgcatgcacctgtagtcccagcactttgggaggccaaggcaggaggatcaatcaaggctaggagtttgagactgcagaaggaaaccctgtctctaaaaacaaggtccagctaaaatcagggtccagctccaccacaagcgcagctccagggtctgttgagttttgcctctaccattccaagtagtccctgctccagaccaagtcccaccatctggcagtcaggtcagtccaaccacagtcatatcagggcgcttcccggttctttcattgagtgccccttgaggaggctggaggagaggccaatgacatttgcacttgagactccagagtctagatttataaccactatgttacggctgccagtgtggctgcaaggacacttctttcattcattcatttacaatagatgtagcatctgctgtgtgccagatgccattctaggttctagggaaacaaagcaaagcccctgttttccaaggcatccacattctaggaaagactgctaccagcctggcgtggtggctcatgcctgtaatcccagtactttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaggctaaggcaggagaatcgcttgaacctgggaggcagatgttgtggtgagccgagatcacgctaccgcactccagcctgggcaacagagtgagactccatcaaaaaatagtaataataaaataaagactgctactaaacaataaaataaccaaaccagatagatgacttcaggtggtggtaagagctttgaaagaataagcaaggtaactaactggtcagaggaagggagatgggtgcattccctcagatagaccgccccagaggtctgcctctctgacatgacatttgagcagaaacccaacaggaaaaggaagagactgctctatggccaggcacggtggctcacacctgtaatcccagcactttgggaggcccaggcgggcggatcacgaggtcaggagatcgagaccatcctggctaagacggtgaaaccctgtctctactaaaaatacaaaaaaattagccgggcgtggtggtggatgcctgtagtcccagctactcgggaggctgaggcaggagaatggcgtgaacccgggagacggagcttgcagtgagccgagattgcgccactgcacttcagcctgggtgacagtgagactccatctcaaagaagaaaaaaaaaagaaccaagaggagtccaggagaagagaacagcagatgcaaaggccctgaggcagaaacaatcttggtatgcgggaggaataggaaggcagccagtgcagctggagcaggataggttaagagaggatcaaggtgatgagggcctggaaagaggggctggggtcaaatcaccagatcctgttggttgcaatggaagagcctggagtttattctcagggcagtgagaagccactggaaagttgttttttgtttttctgtttttgagacagagtctagctctgtcacccaggcagactgcagtggtgcaatcttggctcactgtaacctctgcctcccaggttcaagcgattctcctgcctcaggctccccagtagctgggattacaggcacaggccaccacacccatctaatttttttttttttttttgagacagagtctctgtcacccaggctggagtgcagtggcacaatctcagctcactgcaacctccacctcccaggttcaagcaattctcctgcctcagcctcctgagtagctgggactacaggtgcatgccaccatacctggctaattttttgtgtttttagtagagacaggatttcatcacgttagccaggatggtctcgatttcctgacctcgtgatctgcccaccatggcctcccaaagtgctgggattaacaggcgtgagccaccgtgcctggccagccaccggaaagttttatgtaagcaggggagtgatctgttttatcatttagaaggatacacacctcttcttctttttttagagacagggtctagttctgtcacccaggctggagcccagtggcacaatcatagcttactgtaacctcaaactcctgggctcaagtgatcctcctacctcagcatcccaaagtgctggattacaggcatgagtcaccatgcctggtcacacttctcattctttaaaccagacctcatttgtccacctcccccatcccccgccccaccccacggactgtcctataatgcccatacaacaggtcactgtttagaaagtgccacaaagttacaaacacagtcccttctgagcctcccaccaatgttggtgggtgcaaggtcaaaaaaaaaatctcatctatctaaggggcataggagactttttagttagagggcccaattatagtcctcctgaaaagatgccaaaagtccccttaaacacttagcaaagattcaagaaagatgaatctcacattctttgtatgggaaatgaggaacttgacatcttcaatataatagattccactaaaataagatgacgatcaataggaaccaactaaaaaaatacttgactagctgttattgaaaggctgaaattcagctgacataagcagtattaatattgagctagaaaataattcgcattgaattcagcccaacttttgttttctgatttgggtctcttctaaattttttttttcttctggacattgggaacaatccaatttgaaggcctcaatgcccaaatctacactcgttttattctatatccttggtttctttttttttttttttgagatggagtctcactctgtcgcccaggctggagtgcagtggcgtgatcttggctcaatgcaagatccgcctcccgggttcatgccattctcctgctgcagcctcctgagtagttgggactacagatgcccgcccccacgcccggctaatttttttgtatttttagtagagacggggtttctccatgttatccaggatggtctcaatctcctgacctcgtgatccacccgcctcagcatctcaaagtgctgggattacaggcattagccaccgtgcctggcccacacctgggtgatttttaaaattcttctagtagagacagggtctcactatgttgggtcaccgtgtttgatgtcagttttccctgacagaatctacaatctccttgatcaccattatatcccaacacagagctcagtacctggtacaaagcacatttgatcaatacttgctgaataaagaaataaaaatgaagaggcattccagcctgggcaacagagtgagatggtctcaaaaaaaaaaaacaaaaaaaaaaaaaacaaaaaatgactggaaaggagatgagggtacttgtgaagccatattatatgacacgctctgtgctaggacttttatataccttgtctcatctcttcatctcatataatccttacaagtatctcaaaagtggggaaatccccatataactgaagaggaaggcagttcagaagttcactgatttgccctaaggttcctcaatttgtaaacatcaggccaatgatccaaccccaggtatgtttggcagtgaaggaccagttgagtcatagctgcaagtaacaaccctgcagtggtccctatcttggccgttagcttacattgacatttaacactcaaatttactcagtaacaccagctatcatgttttccactaaaactccacagcattctggcaacttttctattttagagcaataaagtaaattgttagcatccctttgacatataaatatttctacaaatagtaattctctagccattcatttggagtatttaaaactcaacattcatagcacattttatgtgacaaagaacttatgttcagaacacaaaaataagtcttatgtcttcattaaaaatgggtgaagaatttgaacaaacatttgcaaactaaaatacaaatgaaatacactcaacatcattaatcatcaagaaaataaaattatgagataatcctaataatcactacatatgcaccacagtgattaaaatttttttaagttaagccacgtgacccaataaggtgcattcactcaagagaaacgcaaatatatgtccactcaaagacttgcacatgaatgttgagagcaggtttatactgaatagtgcaatgtgaaaaaaccccaaaatctagcaaagaatgaagggagaaataaactgtggtatatacatacaatagaacactactcaataataaaaaggattgtattcctgatacatgcaatatgggtgaaccttaaaaatatcatgctgagcaagagaagccaaacacaagagaacatgttgttatgatttcacgtacatgaaactttagtaaagacaagtctaatccatagtgacagaaagcaaatgagtaactgctgacagggccaaatgaggagatgatcccaagggaaccttctggggtaagacggtgttctgtatctcaatcgtattggtggtcacacaagtgaagacatgttagaactcatcaaaccatacacttagaatgtgtaatataaacctcaataaagcaaaatttaaaaaaaaaaacacctttaattttctcttacaaaaaaaaaaaggaaaaccacttaactttaatttttctccaacaactgattctggtacatagtataccttactgcctgcatccatggcctcacatcatgctgtttacatgaacgtaaagcttcaccgaagagtggaataagacagtcctgccagagaaaaaccaaaattactcaacgtaaaacaggctgttgatacgtttgcagatatatagcaagtcttaagtcaaagactgcaatatagtttggctacttcagattgattgcagtagttttatctattacactatacccttacatcatttatcttctactcacaagaggcaagcacacagtaagagaaagccttttgttttgaagggaaatcttcttcagaatattaagtctaatttatcaatatacttaataaagcacattacaaaaaaaaagtcacagcacatttactataaagcagactgcagaaaaacattacaactaatgctttataatgaagttctcgaagatcatcattcattcagaagcccccatctctggttgaactttaccccatttaggatgaagaggagagatctttgtttgcagcaaatctaaaatttacgtaatctgcctaaaggaactgtctttacatacaccacctcccactccaaaaatagaagaaaaaactgagcaatttgccatccttgcgattatctcaggttcttccatctgccccatgtacttcccaaatgaaagactgcctgaaaacagcatgttagatttctggatttaccagcttgcccaactacaaatcctatttcaaaaaactcaaaaaataaggtctttgttctacagtaatgaccattaatagtcataagaatgtgcttgtaaaaatatacagacctctgtttaaagtctgttagaaactgtgttctccaaagcaggtgagcaatacagctgcaaggtacttagaactggcaaagactgtgaaactgttaaagtagaaagtctcagaggtccaacagcgatgcgggatgtttgcttcaagtactttaccacatttctgaaacaaaatatttactgtcaattaataaaaattacaattcataaccactcaaagaataaagcaattgataagatgctatcaaactgacatccaaagttagggggcagtaagaggagcagcctgctctataataaaatgatattagcaagtcaagacatttgcttttggggatttttacattttatttcatttcaacctcagtttttgttggcaagcagcattcatatatcatatgacttctacaactaaaatgaagctattagcactagtatttagtaatctagtaactctccttccagccctcttcaccccatgtatgtttatcacatgatatacacaatgtacatttatctccgtaagagtaacttactcagttatagactgccacttctgatcttgttctatcgggtttaaagcagttgccaaacaaacagaacttcttaacaattgaacttcaatggatttctgaggttcccttggatctggacttaacatgttacgaagcaggtttttcatgtctacagaagttaaatgaaatgtcattaattaatgtgcttttattataaattttgatttatgtttggcattattaaaaactaatcaccaatgaacagctcctttaatatttaaggcagttaaacactataagcattactgagagctatataaaaatcatacttcatacaaaattactgtacctcagacccctaaaaagcagttgccttcaaaggctcaaaaatcagtaagtcgaggccaggcgtggtggctcacgcctgtaatcccagcactttgggaggccaaggtgggtggatcacgaagtcaggagttcaagaccagcctggccaagatgatgaaaccccgtctctactaaaaatacaaaaaattagctgggcacagtggcagacacctgtaatcccagctactcaggaggctgaggcaggagaattgcttgaactcagaggacggaggttgcagtgagccaaaatcccgccactgcactccagcctgggcaacagagtgagactctgtctcaacaaaaaagaaaatcagtaagtcaatctactatttaagggaacaaatctagacctgcattagcaaatcttgctcaatccagaatactcattaaactttttaataacattttataaagtgttccatttgtgataaagaacttaatgagccacatcaagatgaaaatcaagaaaaatatttagctgaaacactactttgtcctttatcaaacaaaatggctagataaatctcaaagcattaaggtggtcatttttttatttgacttaattttaagtgcttttcatttcccaaatcaaacttaaatagggcagccctaaatttgttgcttcacatgggattctgccccccaaaaatgtaaaatgacttccagattttccagtaaaatatactaagccaaacattttgagcaacttgtccactaaaataactttaaaactattttctcaaatacctacctattttttcttttgatcctccagcaagtagattgatattttctcctggtaacaattctaattgctcagtacattcaacaaattttccagactcgaagctgcttaatgatctgtaattaaaatattggttagcttgtattcctacgcagcctgtggaaccattaaaaaaaaacaaacaaacaaaaacagaacaaatcctaggaagacagcaaagtacacagcatttttctgacaaaattccttccacgaggatgtcattattttggtttttatgttgaagatgtgactaccacttaattagtactcaaattggagtggcaaaccagaaagtcacagctacagactttcagtagagctgactcgcccctgtgtctccttcctgttttcatgtgttgcagcctgttctcttcagagcctaacacactgacagtagacctctgcaggacaactttgacacccagttctctccaagctgccagtgagctccttgtgcagcctcactcctcacctacagcatgagcccttgcagctctcccagcatcataatcttgtatctcagtcctggcttctttcactgctggcatccctccatctctccctttttcacctacttttcttttttcaaagaattcttctctttcatctgcttttatgaaaaataatgacacctctgaaattctttcctgtagtcctgcagcatcaatgccaggaagacaggcctcatcctcccagcttctatgctgctcctttcagatcccttaccctgtccccattttcatgacacgggctctccagccaggaagaagacactgtttctcactctctctcttttccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacattcgtcatttctgccattaaaaggtcctaagtcctctccagtgacaggttcctcaagtccccactatgctctataatgccctatgctttcagctaatgactcagtcctcagaaaaacaaacaaataaaaaaacacaggctttaatttcctctacccctacccccaatccaccatacactgccaaaattctgtctataccaactttgactgctttccttgaggcagagaaaaggtgagggccagttaatctatcaatgttctttctcctgtttcttcaacctctgctttctagtggctccttccccttggccaaaagaacataatctctccaacatttaaaataaacatctcatatctccctccagcaatagcttcctatcctcgacttcaagaaaaactcactgaccaaataacttacctcaagcttttcattttcaaatgtctctaccactcaatagtattcaatctagcttcttctgtctctctacaaaactctttttccttataatccctagagcatctgacaaggctgactactcccatctggatgtcctatatctaggacacttcccttctcaatgtccctgtatttttttgaatggcttcctcttctatactttcacaaaaatgctaaactaggattctgacccaggccttccttcctcttcactcactattctccagaggcttctctctggtttggttgcttacaaaggctctagagtatagagactgaaaaggaaacagggccttttctgtgtactaatgatgtgcaaatctctcaagcttagactttctccttagttcaaaatccaattttttttttttaattgatcattcttgggtgtttctcgcagagggggatttggcagggtcataggacaatagtggagggaaggtcagcagataaacaagtgaacaaaggtctctggttttcctaggcagagtgtgtgtgtccctgggtacttgagattagggaatggtgatgactcttaacgagcatgctgccttcaagcatctgtttaacaaagcacatcttgcaccgcccttaatccatttaaccctgagtggacacagcacatgtttcagagagcacagggttggggataaggtcatagatcaacaggatcccaaggcagaagaatttttcttagtacagaacaaaatgaaaagtctcccatgtctacttctttctacacagacacggcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtaggggcggccgggcagaggcgcccctcacctcctggacggggcggctggccgggcggggggctgacccccctacctccctcccagacagggcggctggccaggcagaggggctcctcacctcccagacggggcggcggggcagaggcgctcccatctcagacgatgggcggccgggcagagacgctcctcacttcctagatgggatggcggccgggcagagacactcctcactttccagactgggcagccaggcagaggggctcctcacatcccagacgatgggcggccaggcagagacgctcctcacttcccagacggggtagcggccgggcagaggctgcaatctcggcactttggggggccaagacaggcggctgggaagtggaggttgtagccgagatcacgccactgcactccagcctgggcaccattgagcactgagttaacaagactccgtctgcaatcccggcacctcgggaggccgaggctggcggatcactcacggttaggagctggagaccagcccggccaacacagcgaaaccccgtctccaccaaaaaagtacgaaaacccatcaggtgtggcggcgcacgcctgcaatcgcaggcactcggcaggctgaggcaggagaatcaggcagggaggttgcagtgagccgagatggcagcagcacagtccagcttcggcttggcatgagagggagaccgtggaaagagagggagagggagaccgtggaaaccgtggaaagagagggagagggagaccgtggaaagagagggagagggagaggagggagagggagagggagaggagggagagggagagggagagggagaggagggagagggagagggagagccaaaatccaattcttaacagcttacccaacaatctcatctgcacatttcattagaaatcttaaaacatagcttgttctctgtgtgctcctactccagttaatagcattgtttctcttccctctaccattgcccccacaaattaatggtctccatgcttccatacttgcccctcacctccagtctcttcaccatagcagaatgaaccaccaagtcagatcacaacacatctctgttcaaatcccacctgaaattttcagtcttactagaataacagccaaagttcttttctcagttcccagctacttctctgcccttatatcctactgtttaaggtgctcctaaacacacaggcctcccagctatttccagaacactccaagcccatcattctcacatcaggtctaggcccaaagggcatcctgatgggcatgccttgaccttgtgtcttccctccaaagaaggtcagctttacctaactgctttccttatggcacagaaaaggtgagtgaggtccaattaatccttctatcaataatctttatctaatctttgctttaaaaggttggaatttgtgtctgttttatgtgctgcctgggtcatagtatatgctcagtgaagcaattacacattaacccatttagcagtagaaagcaagggtatcagacaaagtctaatgacctttatcttcccagccaagtgtctgcaacagagtgagtgctcagttttgaattacagaattaataaaagcacagaggaatgagaagaaagtttaatttacagatgttcacaaactctgtcctcattagaataaatgtttttgatatattcagacctcatttagaaacaaagccatcaaatgtgattctttctaaatcagtacaaatttttccttatattcactctggcataatcttcaaactctattaaggttttagaatgacaggttctgaaaattaataccaaatgactatctcagcagtgttttcccattatacaaataccttccctcatctctgatgtcagtttcctgttgtcattttcataatggcagtaagttagaaatataaccattttgtattactacatatgaccaattttaatatttttttgccataggaaaaacatcatagttattggaaatttgttttataactggaaacagaaagccttactttatatagttgaattcagctttcaggttgagggaagtgctactggtactctttttcaagtcatggatagcattctgccattcctgcacagcagcgcaatcggcaattgagatgtagcactcacacatgctttatttcctaaataatttataacctcaggggaagagtcagtcggtttggacagcacagtttttctggattcacctgaaagtattttataaaataagaagagattcagatcaattagaaatatttcaaagagcacagaaacctaaaaacatgataagatcatcagtacaaaatatatcactataacttttgctttatttaaaaatactgaacgctcaccattcagacaatgtttcgggctggcactgttacacccagcattggctaaggtgagcaccaatttgtcaaagctggagatgcagcaatcaacacctgtcatggcacacaggtgctcctggtactccacagaggccttttcaaacctgaaaagcaaattgaagcagtcttatttctttatttatctacttacttactttcttttttgagatgaagttttgctcttcttgcccaggctggaatgcaatggcactgtctcagctcaatgcaacctctgcctcctgggtacaagtgattctcctgcctcagcctcctgagtagctgggattacaggcactcgccaccatgcccggctaattttcttgtatttttagtagagacggggtttcaccatgttggccaggctggtcttgaactcctgacctcaggtgatccgcctgcctcggcctcccgaagtgctgggattacaggcatgagccaccgcgcctggcctttacttacttacttacttattttttgagacagtcttactgtcacccaggctggagggcagtggcatgatcatggctcgctgcagccttgccctaccaggctcatgcaatcctccaacctcagcctcccaagtagctgggactataggcacccaccaacacacctggctaaaacaaggttttgctctgttggccagggtggtctcaaactcctggactcaagcgatccgctcacctcagtctccccaagtactgggatttcaggcatgagccaccgcgcccagccccaaaggaggctgttattttaaacacacatatctcatttcccccccccacaaaaaatggtgcaagaataaactgagctaaaacagtgagttgactatggtggggggaggtttgatgtcttcctcacaactgtgaaactaaatttaaaagtggttaaatgtttttaaaaaaatgtaagagtataaaagaactagtggaaaatattgataagtaactgatgtcagtgtgtggaaaggctttgtagaaggataaaatgcaagaaaagatgcacaagtaacagatctagatgcataatgctgaaatacaacactaaacattaaaaacaaattataaatcaagaaattggatagcatcaacaatcttagtatttaataaaatttcacagattaacacaggaaaaattgagaggccatgaagacatgatccatgttttaaaaaatcacaaaaggtcactatatggggcaacttctactattagtcattaataaatatagaaatgtaaagtacaataactattttcgctgatggtggtggcagcattcttgtttctcagtgactctcagtatccacaaagatgaagggaagggggtactctattattaagggtatacattgcagccatcttttctgtagagtaacttaccaatagaatatattataagacttatggtttggcagcctttcttctagtaaatcagtttatgagaatggattccaagaaagtaatcagaaatataagcaaagatattaagtgctatggtacatttagtaaaaaaaaaaatcagaaacaaccttaatgcccaacagtaagaaatattaaattatggtacactcataaatacaaacctttattaaaaataacactgtagaatatttaacatggcaatttttttttttttgagacagagttttgcttttgttgcccaggctagagggcagtggcacaacccgggctcacagcaacctccgcctcccaggttcaactgattctcctgcctcagcctcccaagtagctgggattacaggcatgtgccaccacaccccactaatatgttttgtatttttagtagagacggggtttcaccatgttaggctagtctcaaactcctgacctcaggtgatccacctgcctcggcctcccaaagtgctgggaatacagatgtaagccaccgaacccagcctacctaacacggaaaattttttttttttaaatattgagtgggaaaaacagatcataaaaccatgtgcctatgtacactgatgttttggtgaagaatggagaaaacgacatgaaagaaaaaagaattacaaagcatatggatatggaaatatgggactacaaaaggacacacaacagaagttactacaaagatatggaagtatgagcagttcttttatcttcctaaatttgcaagatttcattaaactaacataaatggacacagaatattatggtacaagctcctctacctggaggaagcaatgagtctgaatgtagagttcacaggactaatgagcaaatactctgacaataaagggtaatttgtatcagactctgagggggaaggagctcaactagggatcaagttcaaaagcgtttataaaacaactgacaggtcttgttttacagtgtgatttgccactaattcttaaataagaaaggcactccagtattgcggctaactaaagaacaaactgaagatgcctcctggtgaagtgatttatagcaagcttcaatgctgaaagcaaacaaagctgttttaagatttggctacaatgtcagtgagtaatacaaagaatttaaacataaagtaattctgtcacccatttccttccctccaacctacctcccttcagcctgttgagccactgagttaatccacagaagattttttccaacaatagatgatgaccagacagcaattccctgtatagcttcaggacaatgaagttcacatagtgcttctaccaccatcataatggttatttccaattcattcccctgaaaacgcattcagaaaagttagtcacccaataccattaaaacataaatccctataaaatttacaactgatcacagtctgtgcctgcttaaagccaaatgtatttaacaattattttcacaattttcacattatttagctcagaattctttaaaattttacatataaaatagccacaaagggtgactaacagaaccttagcagcacatggatgtttgtacccccaccccaaagttacccaaaaacatttaacctgtgacctctgtaggaataacacatggagtaaaaagaaagcaaaaattaaatataaataaacaggaattaaggaatgattaacttcatgtgtttgaatactgcttgacattacctgaattgctaaacattttgttatttttggattccagttatttattgtgagcccacttgcaagccaggaattactcaagcatttgtcatacgttataaaaacaatttctcctggccaggtgcagtggctcatgcctgtaatcccagcactttggaaggccgaggtgggcggatcacttgtggccaggagttcgagaccagcctggccaacatggtgaaaccctgtctctactaaaaatacaaaacttagccgggtatggtggtgggtgcctgtaatcccagggactgaggcaagaagaggcttgaacccgagaggcggagcttacagtgagccgagatcgcacaactgcactccagcctgggcgacagagtgaaactgtgtctcaaaaaaataaataaataaataaataatttcccccataaacaaattttcagaattacctttaaagttctaaactttgcacgtaagaaatatagttttaacgtgttctaacatgaatattgttttaacatgaacaaaaacatgaacattattttaacttctaacactgttttaacatgaataaaataggtaactctggcagttgttgcttttacaaaatacaggatcaaaacctttgaaaatgaatccaagctttaacttattttatccatagattaaatcataccaaaggaattaaaccatgtttttcttattaacagacttaaaatgaatttcaaacacaccactttacctgagataggctggttgttttcatctctgtaagcaagtcaaagccatgtctcactgtcactgcaggctggcctgccaacaatcctaccctcatgatggagagtcgaatccgcgttagccagtcctgacaagtttggcaactggtatagaaaaaagctctaatgacctttacgataagagaaagaaaagctcaggactggttcaatttgtaggtaaggatgtctcacctatatataaaccaaatacacaagtctattgtgatttcagctctgcacatactgccagctgtgaccattaaactgctataaaacaacactatctcccggaaaccaaccttgggaggtgaagttaatgcattagcacatccctcatatacattatacattaatttctccagattttccagatactgcagaagaagaacaagtctaagttggttgttaccatggccttcatcattgtctgcagttgtccactgactaacatcctgatcagggtttaatgtgtgagctgcgagacttcgaatgatacctgaaagcaaagacaacattctgaatttttaaaaatcttaaagttcctagaataagtgtgagttttttatgacaaattcacatttatcaagtatcctctgtctacccatcatttaaaaataaaaaatcccaacatgaaagatctttcattttaggggaaaaaatatatatatattttccacacaactcccataagttttggaaaaaaaccaaacatatttccaatgcaattattcaatgaaagcttattctaacaaacatacctgaaaattattgactttttttcaaaaaaaatcatatactctcaaatctttaacaaagatttaaaaatccattatttcttaataaggctttgaaagtattcacatcacaaagcttgagcgagttaccttcaattgtctggaaggtgtcttgagctctgcccagtggggttctcagcttagaaagaacagtgaattgtgcagcttcccatatggcccactgccaaaagatagcatctgtcttcaggagattgcgtggaattgttgactggtcacacttatccagtctctggcagctatagaacagtctttccaaccaattgtccttcctgggaaaagtagtttcatatttaaaagacaatgacaacttcattttaataatgaaaaaaaaaatgcaaggggaatgggaatacggaactgtaattttccctactccaaaaaaaggcaaaacctatgaaattgagaagcattatgtccccccctctcattttgaggtcttttatagttaacaggatgaggtacagtgtggaaggatgattagggtaaatggctcatgccagtcaggaatgaaactcattcaatgcaactaagcatctctagaatatctccacccccaccccactccccaaagtgttaatgacatcacatcagttaattgttaaccacatttcattactcaatttcaaagcccatttttgtttctacagatgctatcttcaaagcaattttcctattgatgaaaactgaaataacccatatgagaagaatgttacttgatactctgccacccccaaacatattttctcttcaaaactgcatgtaaagtcaagggaatcttaaaattatctttcccagataaaatagtcaaagaaatgccttaccctgttctatgagagttcccatacaaaataaaactaataacatcagagaaatcttgggggtggaatgtattacttggtgctttactcatgtgacttcttaatgctaaagaaatttcttgaatttctgtgtgattgttattgctgtagacagaaaataaagttgttgttatgcaaaatattttagcttaaaaggttagcacctactgtaagtggattatttacttattaactcactggaggtaaaaatatagtaaaatagagactttaaaatggatacagagatgtgattacaactttagatcctttttttattcacctcagatgggtaatgtgccgacatcataagaggatttgagggaggcatatcaaacatgtgaacataaaaacccaatcattatgcttatgtattacaaaaggatcaagtttaggctcttaaaagctcccaaatcaacttgatcaaaaacaatgaaagattactgtttagtttttcaaatatctgagctactaagaaacatattttggcactacatgagttattctatactaattattgtgagcctataaagctcattaaaaatttttaattttcttgcagaactgcaaaatttgattatttgacatcacttcaatcactggcaagcagggccataaaagatgtgtcattaatgctctaataggtgatctgtcttctcctaaagtagacaaccagtagaggctgtaaatataacagaatgtctttgctccaaaacaactgttataccttaggacaacatctaaaggaattgatttcaacagttttccaaatgcttgtcgaatacgagttccacggtgcactagttgaacacggcaaacatcaacacatctatgaaagaacgaaatagacaaagcaggtgtgttaacatttccaggttattagggttaatgtcaaaagacatgatcttaatttcatacctctgtaaaagatcatctggcaaggaagaggacagagcgtgtagactgctgcatgcctgcagacagatattcacatcttcaacgagagctattaaacattaaaagacagttactttcagctggccaaaagaaattatatcccagtttgtcataattatctgaatccattcattcattcaacaaagagtgagtgcctactacagactaggcactgttcttgtccagaatccttattgactgtcacatttggaaaaatgacacattcaacaaaacccatgtaatgtaactgatgggtcatcacacaaacctttttctgagagaaaatgtaaaagtatatgcaaaatataaacattcacataagcttaaaaatgtgacaatcacttcaaaacatttttctaatactaagaatgaaaaaaatcaagactgtgtatctgtcattaaaatgaggattacacatcttcaggtcaggaaaagagctcgattgatgaccatctcccattaccaaagacccttttaaggactgataaacaaaatagaaaaaaaaaaaacagagtcttactgttggctaaaaggcctttgcaaaatttatggaaagacggaagacagaataaaggtgcatatgtttcggacttcttcattaaaacagctacttccaaagcccaagtcattaacagtttcctgaaacacaaaatatacagttgactgtacacaaaaaaaacaacaacaaaaacaaaaaaacgttaaaagcctagtcttcttacattggttttctcttggtttttcaaacatctcaaacaataaaaaataaaaataaaaaatgaaactatagaaattactgtcaaaattgttgtgtgccttttaagaaaacctcccaacgcagcataatagcaaagaggccgggcatggtggcttacctgaggtcaggagttcaagaccagcctggccaacaacatggtgaaacaccatctctactaaaaatacaaaaattagctgggtgtggtggcggtcacctgtaatcacggctacttgggaggctgaggcaggagaattgcttgaacctgggaggcagaggttgcagtgagcaaaactccgtctcaaaaaaaaaaaaagcatagaatattaaaaatctatatatattcttctatgaaacactgggggtgagggattgaggtttttcatgtatttcttttcagaaagaataagaaagcctagattaaataataaaaccaaattataaggtgtttgacaataaagaagctgctctacctcacctctataatccacatttttttaaatgttttgtaatccacatttcttattctcaaattataaaggcaaattaacaaagttaggaatagttaatactatataatatctgttacctcgtgtcctggttaaggttatctttcttaagtaatattcccagaagatttaacataattgagaaatgtttctttgtggccgtagttacagtgctaatcacagctccatcaaacaaaggaggagaggaagaactgaggctactagagataaagtgatcatgcctgaaagacaaagcatagattatcttttcatctttaatcaaagaaagcaagcaagcccaaagttaaatcaacatacatctttaaaatctatccattaaaaaaataaaatgttttgtggggttcttttgttaagaaaaatttgtgaatacagtacctggtacaatgagaatacaaagtgtagagcacagcatactgaatggtagggaagtgaacagccaggtcactgtgcacaatcatcagattcttactcagaagtgcaaagacagttggagatagcgcccacatctgatcatgtacaaaacaaagtaagtttatggcttctccaaaataagcacaagcatacagagtttatccttcaaaacaggggtatttggacatttttaaattaaaattacagactggaagggatctagtacactacacctgggacaaatactcttttgtgaagtcagtaaagcctttgcgtgcaatatagcatctctatgcaatgcagcaactcctcgtctatcgctacagtaagaaaacagccacaggtcaggtgttgtggctcacacctgtaatcctagcactttgggaggctaaggtgggcagatcacttgagcccaggagtttgaaaccagcctgggcaacacagcgggaccgcatctctactaaaattacaaaaattagctgggcatggtggcgcacacttgtaatcccagctactcaggaggctgaggcaggagaattgcttgaacttgggaggcagaggttgcagtgacccgatatcataccaatgcactccagcctagatgacaaagttaagactctctctctcaaaacaaaacaaaacaccagccacatacaaaacacaggaatgagagtacctgtgttccaagaaaactttcttgagtcggagtctctcgctctgttgcccaggctggagtgcaatggggtgatctcagctcactgcaacctctacctctggggttcaagcaattctccctgcctcagtctcccaagtagctgggattacaggtgcccatcaccacgccctgctaacttttgtatttttttagtagagatagggtttcaccatgtgggccaggctggtcttgaactcctgagctcgggtgatctgcctgtctcagtctcctgagggattacaggcgtgaaccactgcgcccagcccgagaactttctttacaaaaacaggcactagtgttgtgatggttgtacacttctgtgaatatactaaaaatcagtgaattatacacttaaaataacaaacaaaaaacaggtgctgggctgtatttggcccacggaccatagtttgctgatctctgatctaaacagagccctttgtatgtgccttttgtggaagtagactgtatttcctcaattttccatatactgcaaatggcaaggtgccctgttcaataaggaaacaaaggcacaccctgccactctacaccttttccatccatctttttcctttacactgccaagacactccattccacctgactgccccatccccacccactttctccttatttctagagtacaggacataaacatctttgaatctgtaaataatgtgaataattttcctcaaaaatcaagctttcatgtttgaagaagagtttattgtgacttcaaacataagctgtaactggtaataagcgaagcagctatggaattatacaaggcaatccaatcaaacaacacggagcacattgaagcgcaaacatcaaattttaccttcttcctcctaaaaactttattccctaattacatccattactttctttctttgtttctttctttttttttttttttcttttgagacagagtctggttctgtagcccaggctggagtgcggtggtgtgatctcagctcactgcaacctccacttcctgggttcaagcaattctcctacctcagcctccaaagtagctaggattacagctgtgcaccaccacccctggctaatttttctatttttagtagaggtgagctttcaccatgttggccaggttggtctcaaactcctgaccacaagtgatcagcccgacttggccttccagagtgctgggtttacaggtgtcagcaaccatgcccagcctacacctattattttctattaaaaataatgtttttcaactctgtgtggtccaataggaagaagaaatacacaaaccataaacaataaatacaaatcaagagcagggccacgtcaaattacttaaaaaaaaaacacacacaggctgggcgcggtggctcatgcctgtaattccagcactttgggaggctgaagcgggtggatcacctgaggtcaggagtttgagaccagcctggccaacatggtgaaatcaagtctctactaaaaatacaaaaattagcccgtcatagtggcaggtgtctgtatctcagctactcgggaggctgaggcaggagaattgctggaacccgggaggcagaggtggcagtgagccgagattgcaccactgcactccagcccaggtgacaacagcatgactctgtctccaaaaaaaaaaaaaaaaattcccccccccccaaaagaaagactaaaggttgagtatcccttattcaaaatgcttgggaccagaagtctttcagactttgtatatgtttggatttgagaatacctgcatatatataaaatgagatatgtgggggatgggacccaagtctaaacacgaaattcacttatgtttcatagacaccttctattcatagcctgaagatcattttatgcaatattttaaataattttgtgcatacaacagtttggactcatcacatgaggtcgggtttggggttttccacttggggcatcatactggtgctcaaaaagtttcaaattttggagcattttagatttaggattttcagattagggatgctcaccagtaagtgttatgaaaatattccaaaatccggctgggcatggtggtgctcacctgtaatcccagcatttttggaggccaaggcaggtggatcacctgaggtcaggagttcacaaccagcctggctaacatggtgaaaacccatctctattaaatacaaaaaaattagccaggcgtggtggcgcatgcctgtaatccgagctacttgggaggctgaaacaggagaatcgcttgtacctgggaggcggaggttgcagcgagccaagatcgcaccattgcacttcagcctgggcaacaagagtaaaacactatctccaaaaaaaaaaaagtattccaaaatccaaaatcaaaaacacttccagtcccaagtatttcagataaggaatattcaacctgtatgaatgtttctagggaaaaagagacagccaaaatataagaccatgtataagaactaacttcagtagacagaaagaaaaaagtaccaggggaagaagaaagagaccgcattttaaaacaactatacaaatttgagctgtaagaaacactgacattttctataagcatgctagagcaaacaggagaaattcataagacattttctagaaaataaaactaatataaaaaaacttatcaagatttgtcaaggaaaaagaagaaaagttaaatataatggcaagaaaacattcctaccaattttatttatccaggcatgtcttaaatatggctgtttgttacatggagaaaccttaaatgcatactggtaagtgaaagaagccaattgaaaaggctacatactatatgactccaactacatggcattctggaaaaagcaaaatgatggagacagtaaaaagatcaggggttgccatgggcttaagatggagggagggaggagtggggagagggaatgaggaaggagtgggtagaacataaaagatttttagggaagtgaaactatcctgtatgatactggtaataggggatacatgtcattacacatgttaaagtccatagaatacataacacaaagtaaactatgaaattagttaataataatatatcaatattcactcctttgtaataaatgtaccacactaacacaatatgttaatgagggggaaactgttgggatgaagaaggtatatgggaactcattgttttctgctcaattttctgtatatctaaaaaataaagtcttttaatttagaaaaatatatctaagctatattttaaggccttaatactgtgacattaaagtgtttagacacctaaataggacacacttattttacagttatcatgggcattttttcacattagcaaagagaggtgtaattctggcagaaatgctcagcagaatgtcatctagaatttgctttaaaataagccagttagagatgaaaggatagcaaagaggcctagatgaaaccagatgggccgtttgcttctaattatagaagctgagtgttaaatatgtacaaatttattatactatgctccctatttttatgtgcttcagaatgtccataataaaagtggggggaggatatttatggttaagaaattaaaggaggccagccgggcacggtggctcacgcctgtaatcccagcactttgggaggccaaggcaggcagatcacgaggtcaggagatcgagaccatcctggctaacatggtgaaaccccgtctctactaaaaatacaattgtgccactgcactccagcctgggcgaaagagtgagactccgtctcaaaaaaaaaaaaaaaaaaaaagaaattaaaggagaccaggcatgactgctcacacctgtaatcccagcactttgggagggcaaggcaggaggattacttgagaccaagaattcaagtccagcctagacaatgcagtgagaccccttctctccaaaaaatacaaaggttagccaggcatggtggcatgcatctgtagtcccagatagtcgggaggctgagtgggaggatcacttgagcccaggagtttgaggctgcagtgagctctgattgtaccgctgcactccagccaggggaatatagcaagatcctgtgaccaaaaaaaaaaaaaaaagaaaagaaagaaaagaaaagcaaaaaacaaagaatctggtgcgtagagcaatgtttcctcagaaaaaacgagtaaagctacactgagactagctatcaaccactaaaaatagaggcctggcagagtggctcatgcctataatcccagtactttgggaggccaaggcaggtggatttcttgagcccaagaattcaagaccagcctgggcaacatggcaaaactccatctctacaaaataatataaaaaattagccaggtgtggtggtgcacgcctgtagtcctagctacctggggggctgaggtgggaggatcacctgaacccaagaggtcaaggctacagtgagccaaaatcatgccactgcacttcatcttgtgcaacagagtgagaccctgtctcaaaaaaaaattgcattaaaaataaaagtaaatagacactaaaatgaaggcatagattataagactgatgaatgtactctaaaaaaataatataataaagcaaagcccttatgttttttcttttttggagacagggccttttttgtcaccttggctgagtgcagtggcacaatcagagctcacttcaacctcaagttcctgggcttaatcgatcctcctccctcagcctcccgagtagctaggactgcaggtgcacaccactacaccaagctaatttttgactttttgtacagatggggtctcactacattgcccaagctgtgccagaattcctggatgccagcaatccttctgctttggcctcccaaagtgctgggattacaagcataagccaccatacccagacaaagcccttaatttcttacatatcgatttaagggcctgaataaaccaacacattaaaaaggaaaagaataattcacataccagcatgagtaaattcaagactgagatgatataatcggtaccacaagtctggcaattctccagttggtctaatccatatgtaatgaccatgtcacaatgtatagtcatgctaggatccaagctgccgagcaaaacaccaacacactcattagcagctgtcaacacagcctcagaaaaaaacacctggtttgcagccgtcacacatctcattactctgtacagaatctgtaaatggggaaaacaagcagctttttaaaaaaattcacgtgcttccacaaagcaaggaaatactttttatttaatgcaatttcaactgaaaattaactgcttgccttgccagcagtctcttaatattctagttctcagtagctgaataatgatacctttactacaatatgtaaacatgatcttggctaaaaaatcctaaagtgctactatgacaggaaatggaatctgccatcctctatttcccatatacccaacttcgtttctcccaatgtcactaaatggctgaagctcagaatctttatcatgaaatacaccacgacagtaatggtattgacagcatgggaatagcctgcccacacatactacaagctagctcttgggcttttgggaatcaatctttcaaaactgaacatacaagtcactttaagcttattaaactttctatctactgatggtctcttttgaaagataagcactctcatgcttaccacatagtatcttcaaaaatcatatgatttccaatacacacacaaacaaaatcccccacttaactataatggccaataattgtgtactaaatttctaataaaataggggagaaaacagagcaaatgttaaaaaatacttctataatatttaacaaccaatacatacaggattttatttagtctacccataattttcattaaaagtatccttggaggttgggcatagtgactcacatctatcatcctagcactttgagaggattagctggaaggttctcttgagtccaggagtttaagaccagccatgtcaacataacaacacctcatctctaccaaatttgtttttaaattggttgggcgtggtggctcacaccagtagtcccaccaactacttgagaggctgaggtgggaggatcacttaagcctgggaagtcaaggctgcagtgagccaagatcgtgccactgcactccagcctgggcaacagagaccagtggctcatgtctataatcccaacactttgggaggctgaggtgggaagactgcttgaggccaaaagttcaagaccagcctgggaaacactgagacgccatctctacaaaaataaaaaattagcaggagctatggtgggaggatcacttgagcccaagagatagaggctgcactgagtcgtgatggcaccaccccactttaaaaagaaaaaaaaaagagctgggtatggtgacacccgcttgtagggctgagtgaggtgggaagttcacctgggcccaagagttcaagactacagtgagctatgattgcactactacactccagcctgggtgagagagtgaggctccagctccaaaaataaataaaaataaaataaaaaaataaaaaccccaccattctaccattctcaaaggcctaaaagatcctcataaatcaatatacacctatcctataaattatgtcccttttattttatgtctgaattaacagctttttatttcaactctgtacagtcttcaaacaaccaccttttagacattaaaaatgaagcaaagatattaaaccattttgaaaccatattggtttaaaataccgatatgctggtttcatttatctttaagttctgacatttctgctcaagtacacaacttactatataatcaatatcctattttatttagcaacatgttcagcaaaagtatatgctcctaaaagcaagttttatcctaacggtaaaattttcatcagttagattaaattttttatgactgtatcacacatgcttctttctccttattcacagccgagtacaatgcctggggttcatttcttgtgtcttttccactgaaccctcattggatgtgctatatacagtgcagctaatgtttgaggctgctgaagtgtggcaatctatctacctcatttttaatttgtttatgttctttgatatcaggctatcaaagaatataaagatatacaagttttcatatgagttccatcttatgctcagagaagattactttctgaggcttctcctatagtgtgctattcgtaatatgttgaaaaactaaaaggaaacccaataatttaaaagtaaaattataagaaatattatttaaaaatgaaagaataagatttaaaaattcagagtggccttttgtcatgggagggtagggaagttggatgaaaggaggatgagatataaaaggattccctgcttttctggttatttaagaaagcagtcagacaatatatacatatacacatacatacatacatgctaaacaaatgaaggattaataacagttcacctggtaaagagaagcatttacaatgtaaaacaattttatttttgaatgacacttcaaatgcccaaaagcacttacatctgttacgtatgcctcagtaatcggaggacccgaattgggctgaagcgttccccaatgctcctcaccacagtactaaatacccggagaagcgcagtcagctttggtaatgacactgatggaggagggacgtcttcatccactgattccccagaggccacatggctgaggtcctagatgtgaattcacagcattcttaataagtagtacattgtttaaaaaaaaaaaaactctaaaatatttcaatcaattcattttagaatagatttttaggcttttagaaagagaactgtggcccatgagaatattcatgactctgaatataaaaatgggttttacctaattatttcaaaaagccaacattaaacccaatagacaacaaattaaggaaataatctcttaaatcaactcagaaagctgttggggaaaaataaattctagcacatatgctctagttatatgtaggtataaatgaagacggaagcttttgccactcctgaattagtttttggctaaaaatctcattctaggtattctttgagccactcagctcaacagtaagtcctccaaaccaagagcatgcacatgaagagcaaagggagattacaagacctggtctacagatgtgtaactgaagaagtacgatatatgaaaaggacaagattcgcaaaaactaggatactagaaccaatctatacatttacctaaaattaagcaccaaaataacagaagagaatgagatcttaaggataacaaggggaagcatctctacaaactagaatgtgtggcttatgagaggtagatcagctttaaacgtgggctgtgaaaaaagacattctaggtgtgggggcaaagaaaaaacaacacagaagcaaaacatttccttgcttttctaggaaagagtaaacacatcagtacagctaaaggtactgaattcctgttgactacaagcagcaaagatgataaaaacaagatgaggccaaaatctttatgggagccttgattggttgatctgaataggggagaaacacaaagagattcagataagagatagcacagagttaagccatgacagtggggccagaaaagccaagtaccagtaacagaggcttcagcagtgctcttaaagctcctatgctatattcgtacagccacaaaagctggctgaagccaaggcctgtcctccaaagtacgattcagatctcccgtacatatgtaagaggaaaatctttaggagcttttggtgttttgtgtttttttataacacaacatcaatttgctttaagactctgaagactgggaacaaaaaataaaaataaataacaaaaaatgtctttagaaaaataccagctaccaagagtatgtaaagctttgcgaaatacgaagcttgcaacgtttcttttagtctctccagtaattctcctggtaacttaaatacatctgaaataaatgtttaaaatactgactgagcacgggggctcatgcctataatcccagcatttgggaggccgacgcgggtggatcaccagtggtcaggagtttgagaccagcctggccaacatggtgaaaccccgtctctactaaaaatacaaaaattagctgggcatagtggcgggcacctgtaattccagctactcaggaggctgaggcaggagaatcatttgaacccaggaggtggaggttgcagtgagctgagatcgtgccattgcactccagcctgagtgacagagtgagactccgtctcaaaaaaaaatttttttttcaaaatattgcaatgggcttgtaatttctgcttaaatgtcaggaggtctgagccattttaaaataaatctagcacaatttaagattttttcttaaccaaaattttaagaaacagctttctatatactcacctcagcatatgcttccatgtcttctagaaaatgaccaagaagagtcgtagaaaatgcaagatcagctacccaaaatggctccaaactctgcaaccacccttggaatcgtataagaaattgtgaaagggtggggggagaaaaaacaccaaaaaatccaaattaaaaaaatataagaggcttgttttaaaaagtatccggttttcaagcagcataccctaaaacatgtcctatatcataaaattaagactgctaaacatgctgatcacgattaaccaatacctctttaattaatacctctttaatttctgcaaaaattaacatgtaaatgttatttccttactttttcagtaaatttcctatctatattgtcactacacatgacttaacactaaaatgccacaatctaccattggcctggctaatcccagggccacatctaaccattaaaggtgtatacttatctcctcagtgaaaatgaaacagaccactatcacctgaatatcctattttcaaaagtttattacaccaagtaagttacgagaaactatgacacttgaaacaagctgaaatgtgcaaatgagccatgctagtcattcacttaactccaaaaaaatgggaaacaaaaccatttctcatttatgacaattctccaaattaaccctatttccttttttaaaaaaataaccagaaaaacaataaaatgttacaaataacttggatcttccattgtccacttcagggtattgccactgcaatatattcttaccatatactttttcctaccagtacaaactacaaataacttgggtaagtcctgtctgtacttattctacccacctactagtaatttcttctgaaaatatatatttagctaacaagtaatgttcatttacaatataacatttctctgaattagttttcttgcattattaaagaaatgttattgatagatggtcactgggggaccactgctcctccccgacagtatttaaataactggtataggctgcaagacttaccagatacctgctgcgtgagcgaaggtttctgagtatgatctatatgccatccaactaatatatcaactgtatccttgatggaaacaaagagagagggggccaatcattttaagatattactgccattcacctgtggaccattccacagcaaaagatcctaaaaggagcatctatgttctacctactcaacattctagaaacttagaaaggggagaggggcaggaaaataaaagaactacatttctgacaacaatgaaatagtttattttcttcaaatattttaaggtacgaacgtcagaaataaaaatgcagcatttaaccctggaacctcaaatatcactgattatactcaaaggagcagaggcattgttttccatctgattcctcagttcctcacacacacaaccatccccctcaccccatgatctgaaaagcgaaatgag

SEQ ID NO: 424 - DNA, 6909 bp, Homo sapiens
agcctgatgatcagttataaatctaaagatcagtcaagtgacctctgatgtaagacaaggaaaagatgagagcttgaactaggcaatgattggcatggagctttaaaagggggatcaactacgaggtaaattcgatatgatttagatgtaagattgagagttaaagccttggggatgatctccagctttctgatttgaataaagccattagtgtcattcattgagacaggagattaacactttttttttttaacagaaaaaaaagtgagaatgaaaaaagtagtattttcattttctcacacaaacgagagatattgaaaaatgtagatcagccatgtttttctaggaaagaaggtgaagttgtgggaaagcaggacaaataaaacatgactgttggacctactagtaccggttatgaggttaccccaatttatttatgttgtcttttttcaaagctttcttttcgttttgttttcaatttcattttactgctgctattattgttgatatcagaaatcaactagcaaactaggaaataagagaacttcctccatggcataaaggacatctgtgaaaatctgatagctaatgtcatactttgaatagtcaaggatataactgctttccctttaagttcaggataaaggcaagaatgtctgctctcactactcctattcaatctattactcatggtcctagcacatgtaataagtcaaggagaggaattcaaggcatttattaagttgcagcaaaagttaatcaacctgattttaatggcaaatcaggttgccattaaaagaagtggcaaaaactgcaattacttttgcaccaaccttaagtgagaatgaatgaaataaaatgtctgtttacaggtaacatgactttctaggtagaaaatctcaaattatatttttaaaaagtgagtttagcaaagtcacaggattcaaggtcaatattcaaaagtgaattatatattttttattattatactttaagttctagggtacatgtgcacaatgtgcaggtttgttacatacgtatacatgtgccatgttggtgtgctgcacccattaactcgtcatttacattaggtatatctcctaatgctatccctcccccttccccccaccccacaacaggccccggtgtgtgatgttccccttcctgtgtccaagtgttctgattgtttaattcccacctatgagtgagaacatgtgatgtttggttttttgtctttgcgatagtttgctgagaatgatggtttccaaaagtaaattgtatttctatatgctaatgataaaaaattataaatgatattttaaaagtaccatttttatactagcaccaacaacataaaatattttggtgtaaatataacaaattattaagaaaaaattaagaaaattatatttaaaaatttatgaattaaaagatttgataagatgtcaatttttcccaaatttatatatagactgaaaactatcccaattaaaatccagcaatctcttttttgggaggggagtagaaattggaaagcttatctttaaatgtatattgaaatgcaaagaaagtagaatagcaaaaatgttttgaaaaatataaacaaagtttgagatacactactagattataagacttactgtaaaactaacagatattcaaggaagtgtgatattgacattacaatagacaaatacatgaatggaatagaatagagagcccaaaaatagacccatgtatacatggttgcttgactttttacaaagctaccaggggaactcaatgatgaaaggatagaatttttcaagaaacagatctggaacaattcgaatccaattgaaaaagaaaagcagaatgaaaaaaaaaagagtgtcaattcatacttcaaagcagatacaaaaattaactcaagattaatcataaacttaaatctaaaaccacaaactataacactgctctaagaaaatacaagggaaaatcttagtggccttgggttgggcatagatttcttagatacaacactaaaagtacaattcatagaataaaaataataataaattgggtttcactaaaaagcttctgcctttaaaatgacactgtcgagaaattgaaaagaaaagctacagactgggtgaaaatctttgcaaaatacatgttttatagaggctaatacccagaatataaaagtaactctctcgtggtgcaataatatttgaaaaatcaatttacaaatgggcaaaagatttgcacatacacatcacagaaaaaatatggatttaaataaacacagtaaagatccttagcatcattagttattaggagaatgcaaactcgtaccacaatgtgataccaatatgtaactgttaacatttaacaaataataataacaaaaaaaccccaaaatataacaagtgctagtaaggatttagagcaactagaactctggtacattgcactacagatgcaaaatggtacatactgctttggaaaagaatttggtttcttataatgttaaacccacatttaccatatgacccagcaatccccatcttaggattttatccaagaaaagaggaaaatctatatgcatatagtcagttttttgttattattattggctttattccatagtcccctaaaaatgaaaaccactcaaatgtttatcaactagtgaaaggatacacgttccattttactgtggtgtacccacaatacacagtggaatactactaaacaattaaaaaatagactattgataacgtgcaacaacatagatgaatctcaactgcattactctaagtgaaagaagccagactaaaaagcctacatgctttgaatgattcaatttctaagatattctggaaaagtcaaaaccataggaacagaaaaaggatctctgctgcaagaactttgaggtgagaggaattttacacaggggtacaagaaaactttgtcaggtgaacaaaatgttccatatcttgagggtggtggtgtttttatggtttcaggtccttttcaacttctagagctacacacaaaaacaggctgagttgtactctatataaattaccataacattaatatattttaataagtaataaatgatgtcttattcaacacatctgactgaaaaacaaaacaaaaacgttaataacagtttgcatagctatacttgcttaattttaagaattggaggctgagtgcagtggctcaaacctataatcccagggctataggaggtcaaggtgggaggattgcttgagactgggagctcgaggctgcagtgagctatgattgcaccactgcactacagcctgagcagcagagtgagaccttgtctcttacaaaacaaaattgggtcatcaaaacaaacagagaaacaaccgaccactagaagtaaattcatggaacagtaaagatttcagtaatatggatattctccaattctccagcacatttctggaatcgtgctgaatatgtttctaacttatattgactttagaaactttagaaaaagagtcaaaggaaagaatcaaggggaaacatctgggtttatcagttagtagaaaagtcatgagtaggaggagtcacctatatatttcctacgtaatcagcctgccaagagcagtgggaacgtatttatttttgaggaaccatccaaagtcttttagaccaacagttcctccactttagcatgtataaaaattacttggagagcttgttgtagcacagatttccactccttatcccagagactgtgattcagggggtgtgggggtaggagaatctttccttatctccctccctcccttcctcccttcctcatttccttctttccttctttcctcccttcctcccttccttcctcccttcccttcccttcccttcttccctccccttccgcttctcttccgttccttttttttttttttttttttttttgacagaattgccctctgttgccccggctggaatgcagttggctcattgcaaactccgcctcctgggttcaagtgattctcctgcctcagcctcccaagtagctcggattacaggcgtgtgccaccaggaccagttaatttttgtgtttttagtagagacagggtttcatcatgttggccaggctggtgtcgaaccccagacctcaaatgatctgcccacctcggcctcccacagtgctaggactacaggcatgagccaccccacctgcctgggtatgagaattgctaacaggcttccacatgctgctgccggtccatggaccactccatgtagtgctgcccccagccagtgaggttcacaggctggtactggtctgcacattctttgctaccattctgtgaggaggctagtacaaaaatatagagtatttcagaatgacttctgccatttggacagagtaatttatgtctgttggacataatagtaataaaaaatggactggagatagtattttgtatacctttgcttttcccattcatttttctagcaatttacatttttaatttttaattttaaaaatgtaaaattttcgtgggtacataatagatgtatatatttatgggatacatgagacattttgtcacaggcatgcaatgtgtaataatcacatcatggaaaattgggtattcacccctttaagcatttatcctttgtgttacaaataatctaattatactatttttgttattttaaaatgtacaattacattattattgactgtagtcaccatgttttgtcgtcaaatacaaggtcttattctttctaactatttttctgtacccattaaccatccccacctcctactggcctcccattctctttgccagcctctggtaatcatccttctactctttgtctccatgagttaaattgttttcatttttagacctcacaaataaattaaaacttgcaatgtttgtctttctgtacctggcttatttcactttacataatgacctccagttccatccatattgttgcaaatgatggattctcattttatatggctgaaataaaaagaggaaaaaaaagcacatttttctatataggtagtttaagactcacagctctaggtcaaaggttgggtatgaagtggaccaatggtgctgacatagggcctgcccaagtgttctaactgtagttgcagtatgttcagaaccagaaacagagtttcagagtagaagcctaggcattcatacacagggttaaacctactttcttgacacacagcaagaagaagtctacagagactttgtgctacttcagtgaatcttgcaacacaaagggagttcctggaccacgatggcatctggctctacgtccttgtcactcactctcccttatctgcaaaatctccctaattcttttaccaaaccctttcacactcagattaaaactcttccaccatgatttctagatgacctagtcattctgcgttctcaaaacatgtttagcatattacaaagatatctttctcatactggcttttaattatttttgagcccctcaagagcagggtacattcctcatttattcttgtgttcctgataactaatgtattacctattgcacaaaagataatcaatgaataacagttcatgaaataaagagaatgatttaatatatgcatgtaaagaaacctacagcttatgaattattagtaagagacatgaatacatttttggttctataagcaattaagtaaatatatacttttactaaaaggagtttagactctattgagttattgattctgatataaaaatcacatagtagaagaatgtctagttccatctaagccatttctcatcaatatgcctgaagttgtaatagtgaaagtactttcaaataagaatataattttagttaatattaattttttttaacttttcactcaatacagtgcctttattaaactgaaatgattgccccttcttggaaaatagattattttatggtctattttgctttttttttttgttcacttttttattaccaaccaataatttatatgcaagaaacttgatcaatgtgagggaacaaaaattgtttttagtactttcaaaaggttttcactttggaaccctgatagttgtcaggaccatggtatccttttgggggaattttatacatatgcatacctttagttaattgtcttaaatattaatgactgacttgatacaaaatcataactttttttttttttttttgagatggagtctcactgtgtcgcccaggctggagtgcagtggcacgatctcggctcactgcaagctccgcctcctgggttcacgccattctcctgcctcagcctcccgagtagctgggactacaggcaaccaccaccacgcctggctaatttttctaattttagtagagacgtggtttcaccatgttagccaggatggtctcgatctcctgaccttgtgatccacccgccttggcctcccaaagtgctgggattacaggcgtgagccaccgtgcctggccaaaatcataactttttaaagctatatagaaataccaaaaaagcaagtaaaaaagacaccaagaatcacataactcagaaataatgattaatatcaattgaatatcattccaaatgttggtagatatctctagtgcagggcttcccagtctcaccacttttgacatgtgggctggataattcctcatggtggttgaggaccgtcctgtgcattgttggagctaagcagtatccctggttcctacccaagagatgccagtagcatccttcctccaaatgtgacgaccaaaaatgtctccaaacattgccaaatgtcccctgggtaaagaattgccctaggtggagaatcaccactttagacaaaataattttaaaaagaggttgagaaatgaatttataaaactttattcattaaaatt

SEQ ID NO: 425 - DNA, 5612 bp, Homo sapiens
agaaacataaagaaaattttaataaacatgatttttttctcagtataattcaagaaagcatgaatcagttattggggtttttcctatagagttgtagaaattccttacatattttggctattaactccttattagatatatggtctgcaaatattttcttccattccacaggttgccttttcattctgttgattgttttcttagctgtacagaagctttttagttaatataattccacttatctatttttgcttttttttttttttttttgcctgtgctctcttggtgtcttatagaagaaattattgcccaggccaacatctagaagcttttcccccatgttttattttaatattttatttatcatgtcttacatttaagtctttaatccattttagtggatttttatatgtgtcatgagatagtgctctgatttcattcttttccatgtgaatatctcattttcccaacacaatatattaaagagattcttttttccatagtatattcttggcacccttggtaaatataagttgaccatatatgcctgggttccgttctgggttctgtattctatcccatttgtctatatatctgttttgatgtcagtaccacactgttttgattactgcaggctttgagggtctttagtgtttccaaatgaataataggattttttttctatttctgcaaaaatgccattgggattttgttggagattgcattgaatctattgattgatttgggaagtaagaacattttcttttcttaattttttaagctatctcctacaggaaggaagaacattttaacaatattaattcctccaatcaatgaacatgaaaaatatttccatttgcgtcttaaaaaaattttgttcatgttttgtagtttcgagtgtacaagtctttcactgtcttggttaagtttattcctaagtgttttgggttttttgatgcgtttgtaaatggagttgtttcttaatttctttttcagtctgtataaatgaaactaattttttgtatgttgattttatattcttccacttcactgaatatgtctataagttaacaatttctctctctctctctgtgtgtgtgtgtgtgtgtgtgtgtactttagggtgtatatatatatatatatatgactatgtcatctgcaaacagaaatcattttacttctgcctttccagtttggatgacttttattttttttttcttggctaattcgctggtaaagacttctagtactatgtaattgaacggaagtggcaagagtggttatcctggccttgttccagatcttagagtgaaagacattagctttttacccttgaatatgctgtcctggccttgttccagatcttagagtgaaagacattagctttttacccttgaatatgctgtcagctgtgagcttgtcatatgtggcctttcttgtgcgcaggtaagttcctcctatatgtaacttattaagagtttttatcacgaagtgttcaattgtgtcaaatacttttttctgcgtctattgagatgatcatgcgatttttatccttcgttctgttaacgtggtatatcacattgatttatttgcataagtagagccatttttacatccatgggataaatcttacttggttgtgatgtataatttttttaatgtgctgttatattcaatttgattgtattctgttgaggggttttgtgtctgttatcagggatattggcctatagtttgtttgtttgtttgttttttcttgaggtgccttcatctagctttgatatcagagtaatgctggcttcctagaataactttaaaagtgttcccttttcttctatttttggaatagtttaagaagcaatagtattaattcttctttctttctttggtaaaattcacctgcaaagcttactgcaaagcttactggtcttggacttttctttgttgacagtttattatcattattattattccttcaatctccttgttattttgttttgttttgttttttgagatggagtctcgctctgtcgcccaggctggagtgcagtggcgcaatctcggctcactgcaagctccgcctcccgggttcacaccattctcctgcctcagcctcccaagtcactgggactacaggcgcccgccaccatgctcggctaattttttgtatttttagtagagatggggtttcaccgttttagccgggatggtctcgatctcctgacctcgtgatccgcccgcctcggcctcccaaagtgctgggattacaagcgtgagccaccacgcccggcgaatctccttgttttttattggactgtttaggttttctatttgttctttattcactcttggaaaagtgtatgtttctaggaatttctccgtttcttttcggttgtccaattggttagcatataattttgtataatggtttcttatgattcttttctatgaaatcttttgtaatgtttcctctttcgtttctgatattttaagtctttttttctttagtcaatctagttaaaattttattagttttatttattttttcaaaataccagctcatagttttgtcagttttttaaaaatgttttctattttctatttcatttatttctgctctgatctttatttacttatttatttatttttgctaattttgtatttagtttgttcttatattctggttcttcagatataattaggttacttacttgggatctttctttgttataatgtaggtgtttattgctggaaacttccctcttagaactgtttttgttgcatctcataagttttgttttgttgtgttctcatttttgttgtctcaaaatattttctaattttcttttgacttcttttttgacccaatagttgtttgagagtgtgttgtttaattttcatgtatttgtaaatttttctgtttttattctatttttttatttctcgtttcattccattgtgattggaaaagagacttgaaataatttcaatcttaaattcttaagacttgttttgtagcctagcatgtgatctattttgaagaatgtttcctgaacacttgagaagaatgagtattctatttctgttgcactggtctagaaccagacccacaatatctctgatgtatgtctgaatacttatcttgaataattcctctacatagattgagaacctcattagacagtgttacagctttgtgcttcaactgtcaacatatagaaaactcaagaggagaaagtctattgtccttatttatatttttgctcatgtataatttcttcctttctaatgtactgagtctttcttttattctgttctttatgtttagagaactttcttgagtcattttttagggtaggtctgtgggttttaaattctcttagttctcttctatcttatgtctttattttatctctattcctgaagaatattttctctggatataggattctgggctgataggttgtttttttttttttttctttcaacatttgaaaaatattgcagcactttcttctgggctctgtgattattgaagagaaatctactgttatccaaactgtttttcccatataaccaatatgtcatttctctctcaatgctttcaaaaatttttctttgtatttagtttttagaagtttcactatgatgtgttttgatgtagatttcttacatccattttttttttcttttttggtcaatttgggatattttaagccattatttcttcaaatactttttcggctccactgtctttcttctccctttctggaactcaaataatactaatgttacatctttattatagagccatatacccttgaggttgtgttcttattttgttttcaatctattctctctttgttgtttagagtggataatttttattgttatgtcttcaagttctctgattctttcttctattctcagttctgttgttcagtccatttgttcagttgtctattttggttattatatattttagttctaaaattcccatttggttctttttatcttatatttctttgttgaaatgttctattattattatctttttttttttttttttttttttgagactgagtcttactctgttgcccaggctggagtgcagtggcacgatctcagctcactgcaagctctgcctaccaggttctagtgattctccctgcctcagcctcccgagtagctgggattacaggagcccaccaccacgcccagctaattcttgtgctttttagtagaaacggggtttcactatgttggtcaggctggtcttgaactcttgacctcgggtgatccacctgccttggcctctcaaagtgctgggattataggcatgagccgtgcctcacctgaaatgttctattattttgctaaaaagttctttgctcttggtttgataagtgattttttttattgaaaccagtatattttgtgcatcatgatacaaaacactggatcttttttaaatcctattttagcaggtcttctctgacaccactctagtgaatgaaaggggaggctgcctcatttctgcgggtaggcttgaaaggtctggcttctcttctgttgacacgttgcggccaagggagaggattcctcataacttctggatggggatgggagtcgaggctcccactaggaattctctgacactatcccagcaaggagggcacctcattactattttttttttttttttgagacagagttttgctcttgttgcccaggctggagtgcaatagcacaaactcggctcaccacaacctctgcctcccaggttcaagcgattctcctgcctcagcctccagagtagctggaattacaggcatgcgccaccatgtccggctaattttgtatttttagtagagacggggtttcttcatgttggtcaggctggtctcaaactgtcgaccttaggtgatccacccgcctcagccttccaaagtactgggattacaggcgtgagtcactgtgcccagccctcatgactagtctttacatggcctccactgacaccatggagaggggagtaggtggccttgtacccagtgagtgggatgaaagtcctgaatctgtattaagcttcttttgataccagctgacaggggtattttaacctggcaacacactctgggctcttcagttggtctttattgcagagtatagggtataattacagttttttctgtgacatttcgctggagtgggaagttatcgtctgaaagttttctgtcttgtaaggttgactcttttctggtccattggctaatgagaacaggctttcattatgatcgcgcgcacgcgcgcgcgtgtgtgtgtgcttattggtggtttctgggttgctggcttcttcacttccaagtttaggatacatgaggcaaaaaaaaacaaaaaacaaaaaacaaaaataaaacctgagggactcacctctgcgtcattcattgggtctctgcatctttagccagtccctcctctccatccttgagacttttattttgtttcttttgtacagaatatccagaatttttagttgcacctagcaggaagaaaagggaagactatgtctactccatcttttcaaaagtggatgcccaagctgtaataat

SEQ ID NO: 426 - DNA, 5736 bp, Homo sapiens
aggatactcgccaattatatgaatgcaagacacggataaaactctcctttaaaggtgaatagagagaaaatagccagctggggcctgtggaacgactctgaaacataaatgaagataaactataagaaacataaagaaaattttaataaacatgatttttttctcagtataattcaagaaagcatgaatcagttattggggtttttcctatagagttgtagaaattccttacatattttggctattaactccttattagatatatggtctgcaaatattttcttccattccacaggttgccttttcattctgttgattgttttcttagctgtacagaagctttttagttaatataattccacttatctatttttgcttttttttttttttttttgcctgtgctctcttggtgtcttatagaagaaattattgcccaggccaacatctagaagcttttcccccatgttttattttaatattttatttatcatgtcttacatttaagtctttaatccattttagtggatttttatatgtgtcatgagatagtgctctgatttcattcttttccatgtgaatatctcattttcccaacacaatatattaaagagattcttttttccatagtatattcttggcacccttggtaaatataagttgaccatatatgcctgggttccgttctgggttctgtattctatcccatttgtctatatatctgttttgatgtcagtaccacactgttttgattactgcaggctttgagggtctttagtgtttccaaatgaataataggattttttttctatttctgcaaaaatgccattgggattttgttggagattgcattgaatctattgattgatttgggaagtaagaacattttcttttcttaattttttaagctatctcctacaggaaggaagaacattttaacaatattaattcctccaatcaatgaacatgaaaaatatttccatttgcgtcttaaaaaaattttgttcatgttttgtagtttcgagtgtacaagtctttcactgtcttggttaagtttattcctaagtgttttgggttttttgatgcgtttgtaaatggagttgtttcttaatttctttttcagtctgtataaatgaaactaattttttgtatgttgattttatattcttccacttcactgaatatgtctataagttaacaatttctctctctctctctgtgtgtgtgtgtgtgtgtgtgtgtactttagggtgtatatatatatatatatatgactatgtcatctgcaaacagaaatcattttacttctgcctttccagtttggatgacttttattttttttttcttggctaattcgctggtaaagacttctagtactatgtaattgaacggaagtggcaagagtggttatcctggccttgttccagatcttagagtgaaagacattagctttttacccttgaatatgctgtcctggccttgttccagatcttagagtgaaagacattagctttttacccttgaatatgctgtcagctgtgagcttgtcatatgtggcctttcttgtgcgcaggtaagttcctcctatatgtaacttattaagagtttttatcacgaagtgttcaattgtgtcaaatacttttttctgcgtctattgagatgatcatgcgatttttatccttcgttctgttaacgtggtatatcacattgatttatttgcataagtagagccatttttacatccatgggataaatcttacttggttgtgatgtataatttttttaatgtgctgttatattcaatttgattgtattctgttgaggggttttgtgtctgttatcagggatattggcctatagtttgtttgtttgtttgttttttcttgaggtgccttcatctagctttgatatcagagtaatgctggcttcctagaataactttaaaagtgttcccttttcttctatttttggaatagtttaagaagcaatagtattaattcttctttctttctttggtaaaattcacctgcaaagcttactgcaaagcttactggtcttggacttttctttgttgacagtttattatcattattattattccttcaatctccttgttattttgttttgttttgttttttgagatggagtctcgctctgtcgcccaggctggagtgcagtggcgcaatctcggctcactgcaagctccgcctcccgggttcacaccattctcctgcctcagcctcccaagtcactgggactacaggcgcccgccaccatgctcggctaattttttgtatttttagtagagatggggtttcaccgttttagccgggatggtctcgatctcctgacctcgtgatccgcccgcctcggcctcccaaagtgctgggattacaagcgtgagccaccacgcccggcgaatctccttgttttttattggactgtttaggttttctatttgttctttattcactcttggaaaagtgtatgtttctaggaatttctccgtttcttttcggttgtccaattggttagcatataattttgtataatggtttcttatgattcttttctatgaaatcttttgtaatgtttcctctttcgtttctgatattttaagtctttttttctttagtcaatctagttaaaattttattagttttatttattttttcaaaataccagctcatagttttgtcagttttttaaaaatgttttctattttctatttcatttatttctgctctgatctttatttacttatttatttatttttgctaattttgtatttagtttgttcttatattctggttcttcagatataattaggttacttacttgggatctttctttgttataatgtaggtgtttattgctggaaacttccctcttagaactgtttttgttgcatctcataagttttgttttgttgtgttctcatttttgttgtctcaaaatattttctaattttcttttgacttcttttttgacccaatagttgtttgagagtgtgttgtttaattttcatgtatttgtaaatttttctgtttttattctatttttttatttctcgtttcattccattgtgattggaaaagagacttgaaataatttcaatcttaaattcttaagacttgttttgtagcctagcatgtgatctattttgaagaatgtttcctgaacacttgagaagaatgagtattctatttctgttgcactggtctagaaccagacccacaatatctctgatgtatgtctgaatacttatcttgaataattcctctacatagattgagaacctcattagacagtgttacagctttgtgcttcaactgtcaacatatagaaaactcaagaggagaaagtctattgtccttatttatatttttgctcatgtataatttcttcctttctaatgtactgagtctttcttttattctgttctttatgtttagagaactttcttgagtcattttttagggtaggtctgtgggttttaaattctcttagttctcttctatcttatgtctttattttatctctattcctgaagaatattttctctggatataggattctgggctgataggttgtttttttttttttttctttcaacatttgaaaaatattgcagcactttcttctgggctctgtgattattgaagagaaatctactgttatccaaactgtttttcccatataaccaatatgtcatttctctctcaatgctttcaaaaatttttctttgtatttagtttttagaagtttcactatgatgtgttttgatgtagatttcttacatccattttttttttcttttttggtcaatttgggatattttaagccattatttcttcaaatactttttcggctccactgtctttcttctccctttctggaactcaaataatactaatgttacatctttattatagagccatatacccttgaggttgtgttcttattttgttttcaatctattctctctttgttgtttagagtggataatttttattgttatgtcttcaagttctctgattctttcttctattctcagttctgttgttcagtccatttgttcagttgtctattttggttattatatattttagttctaaaattcccatttggttctttttatcttatatttctttgttgaaatgttctattattattatctttttttttttttttttttttttgagactgagtcttactctgttgcccaggctggagtgcagtggcacgatctcagctcactgcaagctctgcctaccaggttctagtgattctccctgcctcagcctcccgagtagctgggattacaggagcccaccaccacgcccagctaattcttgtgctttttagtagaaacggggtttcactatgttggtcaggctggtcttgaactcttgacctcgggtgatccacctgccttggcctctcaaagtgctgggattataggcatgagccgtgcctcacctgaaatgttctattattttgctaaaaagttctttgctcttggtttgataagtgattttttttattgaaaccagtatattttgtgcatcatgatacaaaacactggatcttttttaaatcctattttagcaggtcttctctgacaccactctagtgaatgaaaggggaggctgcctcatttctgcgggtaggcttgaaaggtctggcttctcttctgttgacacgttgcggccaagggagaggattcctcataacttctggatggggatgggagtcgaggctcccactaggaattctctgacactatcccagcaaggagggcacctcattactattttttttttttttttgagacagagttttgctcttgttgcccaggctggagtgcaatagcacaaactcggctcaccacaacctctgcctcccaggttcaagcgattctcctgcctcagcctccagagtagctggaattacaggcatgcgccaccatgtccggctaattttgtatttttagtagagacggggtttcttcatgttggtcaggctggtctcaaactgtcgaccttaggtgatccacccgcctcagccttccaaagtactgggattacaggcgtgagtcactgtgcccagccctcatgactagtctttacatggcctccactgacaccatggagaggggagtaggtggccttgtacccagtgagtgggatgaaagtcctgaatctgtattaagcttcttttgataccagctgacaggggtattttaacctggcaacacactctgggctcttcagttggtctttattgcagagtatagggtataattacagttttttctgtgacatttcgctggagtgggaagttatcgtctgaaagttttctgtcttgtaaggttgactcttttctggtccattggctaatgagaacaggctttcattatgatcgcgcgcacgcgcgcgcgtgtgtgtgtgcttattggtggtttctgggttgctggcttcttcacttccaagtttaggatacatgaggcaaaaaaaaacaaaaaacaaaaaacaaaaataaaacctgagggactcacctctgcgtcattcattgggtctctgcatctttagccagtccctcctctccatccttgagacttttattttgtttcttttgtacagaatatccagaatttttagttgcacctagcaggaagaaaagggaagactatgtctactccatcttttcaaaagtggatgcccaagctgtaataat

SEQ ID NO: 427 - DNA, 10074 bp, Homo sapiens
actggtcctttattaatcttaggcatgagtttatgccttccatgaatatatactgagccatgaagggaatacattgtgccagaagctgtttgacatacaaagttttaccttccacaaccatgcactctcacaggagaaatgaaacttctatatgctgatttacaaaaacagaagagtatgataatggtcatgtttgtggcaaatagagcataggagaatggaacctgtaggcattacaatgaacaggaaagcttgatttgccaaacaattccttccttgaaaactctgtattgataggaaaaagtaatcaatttggccagatgtcaggatacctggaaagcacaaagaaagagagctatctgtgacagactctgtctcataaataagtaaataaataattttaaaaagaaagggagttgacaagtagttgtgagtccctagagcttagtttgagtaaaaagaagtggaagttagtctgaaaaggcagaatggagatggtgtggatggccttgtgtgtgggatttaggcagttagaatttacctgctagacaactggatgctctcaaaggtgccatgaaattacaaaagcattagtatgattatttttattgtggtttatagaacagtttggagaagaagagaaggattaaataggaaaccaacttagcaaacttaacaataatttagtattatgccaaactttaagctacttcgcttttctgcctgaccgacccattttgtaagcaggaataatgatattgcctgccttgatggatttgggtgtggcttaaactatgttaatgtttgtaagtcactttacaatggtgggaaacagaagaaattaagatgttagttattattactgaaagtcaagattgttgctgctaccctatgaaagtgatgaccaaaatgttgacccaagagaaaaagataagttaagccataaaattaaaataatattaaaacaaatctagaacccctccaagtccagttacgtagcgctacacgaaaagctggtacattttacacagcagctaacattaaatttaggagaacaataaaaatgaaaatataaagtaggaaagaaacaccatgtactttttgcagtttcagagattgatttttttttctgagtaaaaacgcttgcttaagacgtttcatttcaagggagctttgtacatttgaaatcagtcattcttgaagttatttcttccatgggctttcgagcctctgaagctttcatgactcgttcatgcaatgaggtgaaaagcttctgttcatacaccgagcgtggattagttcctaaggctgcaaggtgccatggtctcaaacatcatttagttgagatcttgacatttcttttacttttgattttaaaacatacttattattgcagtcgatttgtcttcttctaatgaaaggatagaaagattgtccaaaggggtattttcaaaggagtctgctttgggacaaaaatctattgataactaagtacatgaagtagagggttcttcactggtttaatcccaagcagaccccgtaatggccttagattccttaggtcttagaaggaggaaagtaagttgtaaaccctttttctttctttacactcctttcaatttacttttattttcggctgtcacttgggctttcagacatgaaaaattgcaactgtgctgaaattttcagtgtgccagaataaatggtgattctccttcatgactggtttccagtttgagaacaaggactttcttttagggagtttggatacacttcactctcaggcaggtgaacagagaacaagtgagaagcgataagtatgaggaaagatagagaagacctttcccacacaaaggtgacttcacaaagaaacaaggatgaaggaaacagacaaacatatacaacctctcatttcaactacatctctattttctccattctttttttcccccaagtccaagttctcattcttgaagaaagccaacctgttttccttggtggtgtaagttttcccaacttttaaaccaatacattaatatcttgcttaaggctcaagtgtataatgtatgagggagtataattttgtaattctaaatccaagccctgaagctagactttcagggcttgatttttgtatctccgttactaccttttaaaaaaatatttctgcaccttgatttcttcatgtgaaacaaaatgataataatgtagcctaattatgttgttttgtggatgagattaatttcaaagacaacaaagaacaaatgataagggaaaacattataaagcatgtacatttttaaaataagggaatttcaggtaagaaataatgcaagcaaagaaatggaagcaaatatattgaaggggtaatgatgactaaaccagtccaatttgaggaaaggatttaatagagaaagggacaaatgttccacatgattttggggttagttcatgacagttcttgcggggctgaggtgggtggatcaggaggtcaggagtttgagaccagcctggccaacatagtgaaaccctgtctctactaaaaaaaaaaaaaatcagccaggtgtggtggcgtgcatctgtaatcacagctatgtgggaggctgaggcaggagaatcacttgaaccctggaggtaaaggttgcagtgagctgagatcgagccattgcactccagcctgggtgacagggcaagactccatctcagaaaaacaaaacaaaacaaaaaaacttgtccagaaactcagtgctgtagatatcaatgttatattatccatgcgttagtgatgctttcatacatttttcaagggagaaactgtacacaaggaataaaaggtaatgaggaatgatcaaatttaggaaaacgaagttaaaaagaggagtgaatgaagaaaataatgggaaagcagtcagtaaaggaggagaaccacataatgaaaacactcaacaaatgtaaaacaaaaatactgtggtcatgaatgtcacaagttccaaaattagcaggaagtgcctatcagaagcattgagaagttttaaagagaatatagttgtgctcaggccacagtttcaaaccatacagttagaaccttcaggaactgggtcttggcatgatcaaaccctatgctaactggatccataaaataaaaacaaactgaactgctcgtacatagaaatacggtttttatatattactgactttcacctctatggctgattgattaaaataaaacatgaatttcagaagcataactttatatagaggcaaaaatattttgatttaaaaaaaaattacaacccgccaggtgcgatggcacacgcctgtaatcctagcactttaggaggctgaggcgggcggatcactaggtcaggagctcgagaccatcctggctaacatggtgaaaccccatctctacaaaaaattagctgggtgtagtggtgcacgtctgtaatcccagctactcaggaggctgaggcaggagaatcacttgaacccgggggtggaggttgcagtgagccgagattgcgccactgcactccagcctgggtgacagagcgagacaccataaaaaaaaaaaaattacaacccatgatatcagaaaacatggctttttcctagagttcttgagcaaaaacaaaggactatttattccgcatcatttcagttttgagctctctgaaagctgggaacttgaagggtgtaattttaagtatccttccagtgttgtgattgtttccaaaaatttccttctgcttggggtactgctgggcaggtgtactctacaactagttttcattcttattgtaatgatgacagtttcacactgttgacctaaaacttgctgctgtttaggaaacttcatttctgtctgtaaatttaagccatgtgtgtattttctcctggtatttcattgatgatctggtaacaaaatcagcagagatcactatttctcttcagtgaaataccaaaaaaaaaaaaaaaaagaaaagaaaaaacacttgacctcctcaaaaattgccactacttagaattttagaaccatcatttgcccattatgaattttacagttgttttcctggattattaatatgaagagaaagctaaataatagaactggaaaagactactacattcattttggtcttttccactatacgaaataagataaattgagatatacatattgctctttaagcatttttttctagtatttcagtatactgtaaatagatggcagtattcacattttggattatataattgcaaatgatgaaatttttaagctacaaagttggtaagtacattctcttataaaaatgagcttatgctctaaaagaaactaaacctagaattttaaaaagtgttggtcctatgatttatatttaaataggtgttttatacctggatagatgcatatattcatgtatattatttatataaatatgtaaactacgtggtggcttatgcctgtaatcctagtactttgggaggccaaggcgggcggatcacttaaggttgggagttcgagaccaggctagccaacatcgagaaaacccatctctaataaaaatacaaaattagccaggcatggtggcgcatgcctgtaatcccagctacttgggaggctgaggcagaagaatcgcttgaacctgggaggtcgaggttgcggtgacccgagatctcaccattgcactccagcttggacaacaagagcaaaactccgtctcaaaaaaaaaaaaaagtgtaaactaaaattgagaaaaatagatatacatacatatacctgtatgcataaatataaatggctagcaccatatacatacaatgatagcatgtgtctgcgtcctctcttcctgaacctctcactttctacctctgctgttttcagtcatagattccataaccaggaatggctaactttttaaaacacttaaataaaaccaacccttcgagcagagatatgagttcttacagtttgtggggtactacctataaaataaatatatttagatttgtaaatatttaagaaaatacaatcgtatttcacagtccaagttatatgctctttgccttttatcactatggactgcttggtgcctcttaaaacagaggctgcttttttattggtacataatattttgcatattcttggggtacctgtgatattttgttacatgcatggcatgagtaatgatcaagtcagggtatttggagtagccatcaccttgagtatttatcattcctatttgttgggaacattttaagtcctctcttctagctgttttgaactatatcatatgttgctgtgttaagctgttcttacattactataaagaaatatccgagactgggtaattcataagaaggaggtttaatttgctcacggttcttcaggctgtacagaaagcatgacagcatctgcttctggggaggtgtcagggagctttgattcatggtggaaggtgaagtgggagcagacatgttttcacgtggaaaaagcaggaacaagagagatagttgggtcagggaacgtacccttttttgttgtttgtttgtttgttagttttttgagacggagtctcactctgttgccaggctggagtgcagtggtgtgatcttggctcactgcaacctctgcctcctgtgttcaagcaattctcttgcttcagcctcctgagtagctgggattacagacgcgcaccaccacgcccagctaatttttgtatttttagtagagactgggtttgaccatgttggccagactggtctcgaactcctgacctcgtgatctgtctgtctcggcctcccaaaatgctgggattacaggcattagccactgcaccctgccgggcacacacttttaaacaacaggatctcaggagaattcattcactatcacaaggctagcaccaagaggatgttactaaaccattcatgacaaatccacccccatgatccaatcacctcccagcaggcctcacctccaacagtgcggattacattttaacatgagatttggagtggacagttatcccaactatattaattgctattaactacagtcaccctactctgctatctaacgttagaacttattccttctatctaactatatgtttgtactcattacaaccaatgtctcttcatccaccctcatccatacacccttcttagcctctggtaaccatcattctactctctctccatgagatccacttttctagctcccacatagaagtgagaatgtgcaatatttgtctttctgttcctggcttatttcactcaataggataacctccagttgcatccttgttgctgtaaatgacatgattttatttttatggctaaataatattccattgtatctatatataatatataatatatatataatatatataaaatatatatatatgtatttttgagacagagtctcgctgtcacccaggctggagtgcagtggcgcaatctcagctcactgcaaactccacctcccaggttcactccattctcctgcctcagcctcccgagtagctgggactacaggtgcctgctaccacacccggctaattttttgtatttttagtagagacggggtttcacggtgttagccaggatggtctcgatctcctgacctcatgatccacccgccttggcctcccaaagtgctgggattacaggcgtgagccaccgcgcctgccctcatatatatatttttttaatccagttgtccattgacggacacttaggttgattctacatcttgctattgtgaacagggggcacctttttatagttgacttgtctttttcagttgctcttatatttttaggtatttctaataaactcacaggtggagaaaaacattttgggctttacattatcagagagccactgcatttatttcagagaattcagcaggctgtgaaccatatcctgacttacaattttgtacaaaggacggcccataatggatgtatgtattgtagcagcatacagtctgtttggctaagcatataaaagctacagaactgtagatattttaatgacagctgcagatcttacagcttagagacttgtagcttgaaaaaccgagtcattgaatacaagtcgacctgaaatacacggtcactcaaccagtctggtatattcctggacctatatggctgcttttaaaatttgattttatttatgaccttaagcattttgtttaagaatttttaattgtaagagcttcagtttacttaagaatttctaccttggccgggcgcggtggctcacgcctgtaatcccagcactttgggaggccgaggcgggcggatcacgaggtcaggagatcaagaccatcctggctaacatggtgaaaccccgtctctactaaaaatacaaaaaaaattagctgggcgaggtggcgggcgcctgtagttccagctactcgggaggctgaggcaggagaatggcgtgaaccccgggtgacggagcctgcagtgagccaagatcgcgccactgcacatcagcctgggtgaaagagtgagactccgtctcaaaaaaaaaaaaacaacaacaaaaaatttctaccttaacgtgccttaagttaagttgatgctgcttggagttctgaatctgatttaaatgttagtgaatgacttgcttcttagatgcatttagctatttgccaaaatgcatgaaattttttttagaaaaaatgctgtctaatgtggaatatcattattgtagccacagtacttcttatgggagctgccatatttaaaggaagttgtatgataggcctatgcaaattaaccatgctttttttattaaattagtagttgtaggatgaggcattcttactatcataatgatacaatcagagtgagaaaatgcatgagatgggttgttgcagattccctgctccctctacaaattcttatcgtgaaagttaacattttaaagttcataatccattaccccatttgtccagtcctttcctagttcttgattaggcatttaatttaaaaaaattgaatggcttaatttgggcatagtagttgtatacacactttttggtggcaatttccataaagcagtttgtatctcaactcatcaagtggtttgttaatgaagtgagagtttgttaaagatctttacttgaggatccttaaggaaaattgatgcctatgcaagatagacactcattttaccctcagggaatcagatctggaagcacttatagtctgtagagcttaatgaaacaaagtacattttttatttgaaagaatttattagatttatctaagaaaacgtggggaagagtttttaattttttttttttttgcctatctaggataggaaattaatgctaatagctactatttcttagataaagatatattaaataagagtacaacaatagctatatccagttttaatatacttcctacatgccaagatactttagaaatgttaattttattaagtttataaagtgtaatcatcttgcattttcagaatattagaacatagccaatccaaaattttacaaacatttttgacaaaaaataatcatggattacctaagattacttatttatttaataatacataaagttttaaaattcaacctcttctgcgtctacaaaattctattactaagaagcaaagccatcatttttaggtatatctaaacaacaaccttccatacattttcaggcacaacaaaatgcctgtatgaaaatgttcctggaaagtagcactgatgaaattttctgattctttccaataccaaacaactctggataagataaaagcacccatgggaaaaaaaataaagcaaaactaaaacaaaacagaataaaaacaaagatgctgtattaattaatttgagaaacaatatatttttttcctccttctcaatgcattttaaatgctttgagattccctgggtaaacaacaacttaactttgtttaatccagcattttgcagaatcatttacacatggaaccttggcttctttgctcagcatatacatcagtatcggatggtgttaagcacagtttgagaaagcttcttgagaaaaatatgaggaaaattatgaagtgtatggagagctaagagttattttacttcatgtatatgagaacaagttacatcattttgttttccctaatatatattgacagtttcttaagtttttttatttgtttgttttgttgttgttgtttctttctttttttttttttttttttttattttgagacggtcttactccctcacccagtctggagtgcagaggcacgatcttggctcactgaaaccgctgcctctggggttcaagcgattcttctgcctcagcctcctgagtcgctgggattatgggcatgtgccaccatgcccggctaatttttgtgtttttagtagagacaggatttcatcatgttgcccaggctggagtttttttttaatcttaacttatttacaggaagtaacatttactgtactttaaaaaatatactaatttaatcaaagcagtagaaaggaaaaaaacattagtgaaaggatgaagttgaatttttgaagaaagctttccttcttttataaagatatagtgataagtgtatggacaccaaatgattcctttgagaatgagttgaaatcataaattcatttgtccgagaaaataacacagttacattaaaaaatatgtgtaacatttcaagtactttttaggcatcgtgaagcttgtgcctgggctatctaataatcactgacttaatatttttgtattagaattccacagtttgaagaaaacagtgctgtgtatttttgaaatgtggtgttctgcaatcaacaagatataggggttttaattttcaacaactaccttttattcaataaatatcttgattatcatgtagtcataaatcattgacttaaaagtagggcaggtaatatttatactgtctatcagatatttgaaatacaaacaataattagaaaaagaatggacccatatggtataaaatactaaggttcctctgctcaggaaatccaggaggatatgtcaataaaaaaggtaa

SEQ ID NO: 428 - DNA, 12429 bp, Homo sapiens
aaaaaacaacacctcacatacctctgtcaagcatttaatctgtcgttcatcaaatttagtatttattaccagataggcaaatcactagcacatgattcgtgaattgcgaagtttgtctcctttcattttggtagattctgcccctgaattctgtagtggaaacttatttttcttaaattcatttttttgtagttctagagtttttttgtgaagataaaaaaaagtgaccatacatttttaattatttttctttctcatacaaaaacagctttttttttttttttccacatatagtgatcctcctgccttagcctccaaagtagctgggactacaggcacagggactccaggatatacgtatatatcctccaggagatacatatgtatcctggatagattgtcatgtcagcatatagaaagctttcttattccagtaagtgcatgtaccattgtttatttaataaattcattattaatggctaattttattttgcaggttttgctatatgaacaattctataatacagaacttatgcacgtaacattgttatggatgcagatgtatctaagatgtacattttagaatgtgggaatgatggttcaaagtcacatgtatgcaattttgatatatatatttttcaaatgaaatatgtattagtttgttctctcagtactataaataaatacccgggactgggaaagaggtataattgacacaattctgcatggctggggagacctcaggaaatttacaatcatggcagtaggtgaaggggaaggaggcagcatctttcacaaggcggcaggagggagaaagaatgcatgtgttggaggaactgtcaaatgctgtcaaatgcttataaaaccatcatgtctcctgagaacagcatgggggaaactgcccccaggatccaatcacctcccaccagggcctgccatcaacatgtggggattatggggattacagttcaagatgagatttgggtgggaacacagaacctaaccatatcaatgtttgttatacttcctgcattgattagagatgccacctttatcatcatatcctctttctagattttctttgctttcctattctgattactcatctgccattgccatactgttttaattattgaggcattatgttttaatatatatttggtctcccccaccattgtatttatttttctgagttttactggctatttcttattttaccacaagttaaataatgtgtctagttcccagggactgatttactattcattgcaatcaaaatttaactaatatgggagaatttaccatttgtccacaatcttggtggatccttgtattaagtcataatctatttcctccataaatgccttctaatgaccctttggtgggtttcaacattctcttaagtgtatttctcgacgtcttcacatttatgtggccattgtaaatgaagttttttcttccatcatagtttttcaatgattacggtatgtatattcaaaattatagacttttgataattaattttattaacacttatcttagtgaaattaattaccttatgctttgttatagattcaagttgattctattgggcttttaaatatataggcatttcacctaaagttattttagctcttactttgtaatatttctctctttcatttctttctcttttgtaattgcattggttaacatttctactaccacacaaatcatagttctgttaaagaatctttgttgttttcctcattggcagaaattcgccattaagtttaatgctaattcttgcactaatttgagtgggggaggaagaaaagagtgtgtatgttatcctactagcatatattataatacataaaatgcatatcataacacttttctgaacctacttactagtatgtttaattgttcctttgtttccccaaactgtttgctccttgaaggcaactatgagttttattttacccaaatataactatgatgttcccccattgtcaacatgtacttactgtataattagaattgtaagttaagccactaaaattgcagactactgtaatttgctctcatgctctggaataattcctaagtagaaatatgtacttgcttgtgatggggaaattgatgccttattcataatggcttaatatataagccttaaagcaaggaagcagcagtgggtgggatctgtgcattgatgatgtatgtatattatccacaaagactgagtgcattattatatattttaaaaacccaaccatttccaatcatttatgagagatattttattggagataggtatgaaagtgttattaatgtatataattgcatgtatctaggtttgaaataatcgatactggtcctttattaatcttaggcatgagtttatgccttccatgaatatatactgagccatgaagggaatacattgtgccagaagctgtttgacatacaaagttttaccttccacaaccatgcactctcacaggagaaatgaaacttctatatgctgatttacaaaaacagaagagtatgataatggtcatgtttgtggcaaatagagcataggagaatggaacctgtaggcattacaatgaacaggaaagcttgatttgccaaacaattccttccttgaaaactctgtattgataggaaaaagtaatcaatttggccagatgtcaggatacctggaaagcacaaagaaagagagctatctgtgacagactctgtctcataaataagtaaataaataattttaaaaagaaagggagttgacaagtagttgtgagtccctagagcttagtttgagtaaaaagaagtggaagttagtctgaaaaggcagaatggagatggtgtggatggccttgtgtgtgggatttaggcagttagaatttacctgctagacaactggatgctctcaaaggtgccatgaaattacaaaagcattagtatgattatttttattgtggtttatagaacagtttggagaagaagagaaggattaaataggaaaccaacttagcaaacttaacaataatttagtattatgccaaactttaagctacttcgcttttctgcctgaccgacccattttgtaagcaggaataatgatattgcctgccttgatggatttgggtgtggcttaaactatgttaatgtttgtaagtcactttacaatggtgggaaacagaagaaattaagatgttagttattattactgaaagtcaagattgttgctgctaccctatgaaagtgatgaccaaaatgttgacccaagagaaaaagataagttaagccataaaattaaaataatattaaaacaaatctagaacccctccaagtccagttacgtagcgctacacgaaaagctggtacattttacacagcagctaacattaaatttaggagaacaataaaaatgaaaatataaagtaggaaagaaacaccatgtactttttgcagtttcagagattgatttttttttctgagtaaaaacgcttgcttaagacgtttcatttcaagggagctttgtacatttgaaatcagtcattcttgaagttatttcttccatgggctttcgagcctctgaagctttcatgactcgttcatgcaatgaggtgaaaagcttctgttcatacaccgagcgtggattagttcctaaggctgcaaggtgccatggtctcaaacatcatttagttgagatcttgacatttcttttacttttgattttaaaacatacttattattgcagtcgatttgtcttcttctaatgaaaggatagaaagattgtccaaaggggtattttcaaaggagtctgctttgggacaaaaatctattgataactaagtacatgaagtagagggttcttcactggtttaatcccaagcagaccccgtaatggccttagattccttaggtcttagaaggaggaaagtaagttgtaaaccctttttctttctttacactcctttcaatttacttttattttcggctgtcacttgggctttcagacatgaaaaattgcaactgtgctgaaattttcagtgtgccagaataaatggtgattctccttcatgactggtttccagtttgagaacaaggactttcttttagggagtttggatacacttcactctcaggcaggtgaacagagaacaagtgagaagcgataagtatgaggaaagatagagaagacctttcccacacaaaggtgacttcacaaagaaacaaggatgaaggaaacagacaaacatatacaacctctcatttcaactacatctctattttctccattctttttttcccccaagtccaagttctcattcttgaagaaagccaacctgttttccttggtggtgtaagttttcccaacttttaaaccaatacattaatatcttgcttaaggctcaagtgtataatgtatgagggagtataattttgtaattctaaatccaagccctgaagctagactttcagggcttgatttttgtatctccgttactaccttttaaaaaaatatttctgcaccttgatttcttcatgtgaaacaaaatgataataatgtagcctaattatgttgttttgtggatgagattaatttcaaagacaacaaagaacaaatgataagggaaaacattataaagcatgtacatttttaaaataagggaatttcaggtaagaaataatgcaagcaaagaaatggaagcaaatatattgaaggggtaatgatgactaaaccagtccaatttgaggaaaggatttaatagagaaagggacaaatgttccacatgattttggggttagttcatgacagttcttgcggggctgaggtgggtggatcaggaggtcaggagtttgagaccagcctggccaacatagtgaaaccctgtctctactaaaaaaaaaaaaaatcagccaggtgtggtggcgtgcatctgtaatcacagctatgtgggaggctgaggcaggagaatcacttgaaccctggaggtaaaggttgcagtgagctgagatcgagccattgcactccagcctgggtgacagggcaagactccatctcagaaaaacaaaacaaaacaaaaaaacttgtccagaaactcagtgctgtagatatcaatgttatattatccatgcgttagtgatgctttcatacatttttcaagggagaaactgtacacaaggaataaaaggtaatgaggaatgatcaaatttaggaaaacgaagttaaaaagaggagtgaatgaagaaaataatgggaaagcagtcagtaaaggaggagaaccacataatgaaaacactcaacaaatgtaaaacaaaaatactgtggtcatgaatgtcacaagttccaaaattagcaggaagtgcctatcagaagcattgagaagttttaaagagaatatagttgtgctcaggccacagtttcaaaccatacagttagaaccttcaggaactgggtcttggcatgatcaaaccctatgctaactggatccataaaataaaaacaaactgaactgctcgtacatagaaatacggtttttatatattactgactttcacctctatggctgattgattaaaataaaacatgaatttcagaagcataactttatatagaggcaaaaatattttgatttaaaaaaaaattacaacccgccaggtgcgatggcacacgcctgtaatcctagcactttaggaggctgaggcgggcggatcactaggtcaggagctcgagaccatcctggctaacatggtgaaaccccatctctacaaaaaattagctgggtgtagtggtgcacgtctgtaatcccagctactcaggaggctgaggcaggagaatcacttgaacccgggggtggaggttgcagtgagccgagattgcgccactgcactccagcctgggtgacagagcgagacaccataaaaaaaaaaaaattacaacccatgatatcagaaaacatggctttttcctagagttcttgagcaaaaacaaaggactatttattccgcatcatttcagttttgagctctctgaaagctgggaacttgaagggtgtaattttaagtatccttccagtgttgtgattgtttccaaaaatttccttctgcttggggtactgctgggcaggtgtactctacaactagttttcattcttattgtaatgatgacagtttcacactgttgacctaaaacttgctgctgtttaggaaacttcatttctgtctgtaaatttaagccatgtgtgtattttctcctggtatttcattgatgatctggtaacaaaatcagcagagatcactatttctcttcagtgaaataccaaaaaaaaaaaaaaaaagaaaagaaaaaacacttgacctcctcaaaaattgccactacttagaattttagaaccatcatttgcccattatgaattttacagttgttttcctggattattaatatgaagagaaagctaaataatagaactggaaaagactactacattcattttggtcttttccactatacgaaataagataaattgagatatacatattgctctttaagcatttttttctagtatttcagtatactgtaaatagatggcagtattcacattttggattatataattgcaaatgatgaaatttttaagctacaaagttggtaagtacattctcttataaaaatgagcttatgctctaaaagaaactaaacctagaattttaaaaagtgttggtcctatgatttatatttaaataggtgttttatacctggatagatgcatatattcatgtatattatttatataaatatgtaaactacgtggtggcttatgcctgtaatcctagtactttgggaggccaaggcgggcggatcacttaaggttgggagttcgagaccaggctagccaacatcgagaaaacccatctctaataaaaatacaaaattagccaggcatggtggcgcatgcctgtaatcccagctacttgggaggctgaggcagaagaatcgcttgaacctgggaggtcgaggttgcggtgacccgagatctcaccattgcactccagcttggacaacaagagcaaaactccgtctcaaaaaaaaaaaaaagtgtaaactaaaattgagaaaaatagatatacatacatatacctgtatgcataaatataaatggctagcaccatatacatacaatgatagcatgtgtctgcgtcctctcttcctgaacctctcactttctacctctgctgttttcagtcatagattccataaccaggaatggctaactttttaaaacacttaaataaaaccaacccttcgagcagagatatgagttcttacagtttgtggggtactacctataaaataaatatatttagatttgtaaatatttaagaaaatacaatcgtatttcacagtccaagttatatgctctttgccttttatcactatggactgcttggtgcctcttaaaacagaggctgcttttttattggtacataatattttgcatattcttggggtacctgtgatattttgttacatgcatggcatgagtaatgatcaagtcagggtatttggagtagccatcaccttgagtatttatcattcctatttgttgggaacattttaagtcctctcttctagctgttttgaactatatcatatgttgctgtgttaagctgttcttacattactataaagaaatatccgagactgggtaattcataagaaggaggtttaatttgctcacggttcttcaggctgtacagaaagcatgacagcatctgcttctggggaggtgtcagggagctttgattcatggtggaaggtgaagtgggagcagacatgttttcacgtggaaaaagcaggaacaagagagatagttgggtcagggaacgtacccttttttgttgtttgtttgtttgttagttttttgagacggagtctcactctgttgccaggctggagtgcagtggtgtgatcttggctcactgcaacctctgcctcctgtgttcaagcaattctcttgcttcagcctcctgagtagctgggattacagacgcgcaccaccacgcccagctaatttttgtatttttagtagagactgggtttgaccatgttggccagactggtctcgaactcctgacctcgtgatctgtctgtctcggcctcccaaaatgctgggattacaggcattagccactgcaccctgccgggcacacacttttaaacaacaggatctcaggagaattcattcactatcacaaggctagcaccaagaggatgttactaaaccattcatgacaaatccacccccatgatccaatcacctcccagcaggcctcacctccaacagtgcggattacattttaacatgagatttggagtggacagttatcccaactatattaattgctattaactacagtcaccctactctgctatctaacgttagaacttattccttctatctaactatatgtttgtactcattacaaccaatgtctcttcatccaccctcatccatacacccttcttagcctctggtaaccatcattctactctctctccatgagatccacttttctagctcccacatagaagtgagaatgtgcaatatttgtctttctgttcctggcttatttcactcaataggataacctccagttgcatccttgttgctgtaaatgacatgattttatttttatggctaaataatattccattgtatctatatataatatataatatatatataatatatataaaatatatatatatgtatttttgagacagagtctcgctgtcacccaggctggagtgcagtggcgcaatctcagctcactgcaaactccacctcccaggttcactccattctcctgcctcagcctcccgagtagctgggactacaggtgcctgctaccacacccggctaattttttgtatttttagtagagacggggtttcacggtgttagccaggatggtctcgatctcctgacctcatgatccacccgccttggcctcccaaagtgctgggattacaggcgtgagccaccgcgcctgccctcatatatatatttttttaatccagttgtccattgacggacacttaggttgattctacatcttgctattgtgaacagggggcacctttttatagttgacttgtctttttcagttgctcttatatttttaggtatttctaataaactcacaggtggagaaaaacattttgggctttacattatcagagagccactgcatttatttcagagaattcagcaggctgtgaaccatatcctgacttacaattttgtacaaaggacggcccataatggatgtatgtattgtagcagcatacagtctgtttggctaagcatataaaagctacagaactgtagatattttaatgacagctgcagatcttacagcttagagacttgtagcttgaaaaaccgagtcattgaatacaagtcgacctgaaatacacggtcactcaaccagtctggtatattcctggacctatatggctgcttttaaaatttgattttatttatgaccttaagcattttgtttaagaatttttaattgtaagagcttcagtttacttaagaatttctaccttggccgggcgcggtggctcacgcctgtaatcccagcactttgggaggccgaggcgggcggatcacgaggtcaggagatcaagaccatcctggctaacatggtgaaaccccgtctctactaaaaatacaaaaaaaattagctgggcgaggtggcgggcgcctgtagttccagctactcgggaggctgaggcaggagaatggcgtgaaccccgggtgacggagcctgcagtgagccaagatcgcgccactgcacatcagcctgggtgaaagagtgagactccgtctcaaaaaaaaaaaaacaacaacaaaaaatttctaccttaacgtgccttaagttaagttgatgctgcttggagttctgaatctgatttaaatgttagtgaatgacttgcttcttagatgcatttagctatttgccaaaatgcatgaaattttttttagaaaaaatgctgtctaatgtggaatatcattattgtagccacagtacttcttatgggagctgccatatttaaaggaagttgtatgataggcctatgcaaattaaccatgctttttttattaaattagtagttgtaggatgaggcattcttactatcataatgatacaatcagagtgagaaaatgcatgagatgggttgttgcagattccctgctccctctacaaattcttatcgtgaaagttaacattttaaagttcataatccattaccccatttgtccagtcctttcctagttcttgattaggcatttaatttaaaaaaattgaatggcttaatttgggcatagtagttgtatacacactttttggtggcaatttccataaagcagtttgtatctcaactcatcaagtggtttgttaatgaagtgagagtttgttaaagatctttacttgaggatccttaaggaaaattgatgcctatgcaagatagacactcattttaccctcagggaatcagatctggaagcacttatagtctgtagagcttaatgaaacaaagtacattttttatttgaaagaatttattagatttatctaagaaaacgtggggaagagtttttaattttttttttttttgcctatctaggataggaaattaatgctaatagctactatttcttagataaagatatattaaataagagtacaacaatagctatatccagttttaatatacttcctacatgccaagatactttagaaatgttaattttattaagtttataaagtgtaatcatcttgcattttcagaatattagaacatagccaatccaaaattttacaaacatttttgacaaaaaataatcatggattacctaagattacttatttatttaataatacataaagttttaaaattcaacctcttctgcgtctacaaaattctattactaagaagcaaagccatcatttttaggtatatctaaacaacaaccttccatacattttcaggcacaacaaaatgcctgtatgaaaatgttcctggaaagtagcactgatgaaattttctgattctttccaataccaaacaactctggataagataaaagcacccatgggaaaaaaaataaagcaaaactaaaacaaaacagaataaaaacaaagatgctgtattaattaatttgagaaacaatatatttttttcctccttctcaatgcattttaaatgctttgagattccctgggtaaacaacaacttaactttgtttaatccagcattttgcagaatcatttacacatggaaccttggcttctttgctcagcatatacatcagtatcggatggtgttaagcacagtttgagaaagcttcttgagaaaaatatgaggaaaattatgaagtgtatggagagctaagagttattttacttcatgtatatgagaacaagttacatcattttgttttccctaatatatattgacagtttcttaagtttttttatttgtttgttttgttgttgttgtttctttctttttttttttttttttttttattttgagacggtcttactccctcacccagtctggagtgcagaggcacgatcttggctcactgaaaccgctgcctctggggttcaagcgattcttctgcctcagcctcctgagtcgctgggattatgggcatgtgccaccatgcccggctaatttttgtgtttttagtagagacaggatttcatcatgttgcccaggctggagtttttttttaatcttaacttatttacaggaagtaacatttactgtactttaaaaaatatactaatttaatcaaagcagtagaaaggaaaaaaacattagtgaaaggatgaagttgaatttttgaagaaagctttccttcttttataaagatatagtgataagtgtatggacaccaaatgattcctttgagaatgagttgaaatcataaattcatttgtccgagaaaataacacagttacattaaaaaatatgtgtaacatttcaagtactttttaggcatcgtgaagcttgtgcctgggctatctaataatcactgacttaatatttttgtattagaattccacagtttgaagaaaacagtgctgtgtatttttgaaatgtggtgttctgcaatcaacaagatataggggttttaattttcaacaactaccttttattcaataaatatcttgattatcatgtagtcataaatcattgacttaaaagtagggcaggtaatatttatactgtctatcagatatttgaaatacaaacaataattagaaaaagaatggacccatatggtataaaatactaaggttcctctgctcaggaaatccaggaggatatgtcaataaaaaaggtaa

SEQ ID NO: 429 - DNA, 6046 bp, Homo sapiens
ccagcacttaattctcacctcctattttacagacctcaatttccatttactgcattttcttctcctcaaatcctggtttctggttctgcaacctcagccgggtgcctggactctgacccattctcctcatttgctagatcctctagtctggcatgtttgccctggattattcctccacgctgtacacatacctcctaccacctgtattgtgaattaccagccctgctccttagcagtgtcatttgtgtgttgggaggacaggggagtgtacctttttttttttttttctcaaagagtgggcattctgaatgttctcattcacattagtgtcagtgtgtttaactagaccagcattcccacctgagggcagccccatcccttggatggataggggggcgcattagaaactaggggtggggccaggcatggtggctcacgccagtaatcccagcactttgggaggctgaggtggcagatcacttgaggtcagggcttcgagaccagcctggccaacatggtgaaaccccgtctctactaataatacaaaaattagatgggtgtggcagcgggtgcctgtaatcccagctactcaggaggctgaggcacgagaatcactcgaacccaggaggcaatggtcgcggtgagccgagatcgcgccactgcacttcagcctgggtgatggagcaagactcagtctcaaaaaaaaaaaaagaaagaaaagaaaaaaagaaactgggggtgggtgggaggcagagattgcattgagccaaaatcacaccacttcactccagcctgggtgacacagttgagactctgtctcaaaagaaaaaaaaaagaaagaaactgggggttggggtagttggttgtcacatgaagggaaagcactgtttgcttttagaggccgggccagcaataccactcaacccaatatgttggacagtcttgtacaaagtggaattgtcccacccaaatgcccaccacactgagtccctgagagatgtcagtcagctgagcagtatttatggatgccttgtgcacagcatgatccaggtttcatgtggtttgctcttaattaaaatacaaaacaaaacaaaacaaaaaaccactttgttaaatgtatggctttttcttactcgtgttttaggggaaaaatgaccagtacatcaaaccagtgatgtcataggtaatgatgcccaggatgaagcgtaggtttgtgaaagagcatcagtgtaaagataaatgaggaggccaagcgcagtggctcatgcctgtaatcctagcacttttggaggctgaggcgggaggatcacttgagcacaggagtttgagaccagcctgggcaacatgacaaaaccccatatcttcaaaaaatacaaaaaaaaacaaaacaaaattagccgggcatggtgatgagtgcctatagtcccagctacttgggaggctgaggtagaggatcaattgagcctgggaggttgaagctgcagtgagctagctgtgatcacaccattgcacttcagcctgggtgacagagcaagaatatctcagaaaaaaaaaagactgagaagttagtgaaagtggggactcctctatggctaaatccgtgaaggtgcgacatgaaggagcatggctgtatccgggtgagtgccatccactaagaggcctggcaccgtggaaggaatgggatactatttgggatcagaggacctaagttccaattctgaccttgattcttctgagctctaagaccttgaaggaggtatttaacttggctgactttccacttcttcgtctgaaccagatctcaataataactgacatttactgagcactcactacataccaggcactgttctagctggcttgtatgtttcactttatttaatcctattatgatccccattatactagtctgctcagtctgtcctaataaaataccatggagcgggtggcttacacgacagaaattttctttctcccagttctgcaggctggaagtccatgatccaggtgctggcaaagttggtttctggtgagggccctcttcttggcttgcagatggctgcatttttgctgtgtcttcacccggcctttcctcaatgcatgtacatggagagagagccagagagagaaaacagctgtctggtgtctcctctaacaaggacaccaatcccattgggttagggccccaccctgtgacctcacttaaacttaattacttccttagaggccctacctctaaatacagccacatagggaggttagattttcaacatatgaattttgggaggagacacaaacgttcagttcataacatccattttacaaatgaggaaactgaggcagagagtggctaagtgaacagcccaagtcacatagttggcagtggcaatattcagacccaggtggcctggctccagagaccctgcccttacccatggtgctgtgttgcccctgccagggacagtgatgtccgtctggtttgagaaaaaggattcccagtaagaatttaggagctcgtgcagtgccgcagacagtggactcaaaggaagaaaagaaagtgcaagggaggctggagtcactgagaagtgtggtggcggaaagccaagatctgacaccaggaggaggaggaagtcccaatgttcatggagaaaacaaatatttttcatctctttgggtttttctgattttgtttttgtttattttgttttgtgtgtgtgtgtgtgtgtgtgtgtgtgtgtgtgtgtgtgttttgagatggagcctcgctctgtctctcaggctggagtgcagtgctgcgatctcagctcactgcaaccttcacctccctggttcaagcaattctcatgcctcagcctcccgagtagttgggaccaccagctgatagctcctaaagccaccacacctggctaattcttgtatttttagtagagacagggtttcaccatgttggtcaggctggtctcaaactcccgacctcaagtgatccacccacttcagcctcccaaagtgctgggattacaggcgtgagccgccgcacctggccaagatttttcatgtctttgtaagatgaaaaatcgaattattagattcctctgctgtgagtttgcatagcaccttatgcaaagtaaaactcacacaaatagcaacaagcaaccacatgaacacgacagcatccttcactccccgctgaggggatgaatcgcctggaggtgatcaaagcaatgtgcaagggatctgaatgcaccttctagaaaagacatgttactcccacatgctgagtgcacatgtgggagtaacaagcacaatcccgatgggagctagtgtgtcctgcatgcgactgtgtgcctggcagtgactgaagggcttgtctgtacccattcattaacccttacaacaaccacagagggcaggtactgttatgtatccccatgttagagatggggaaactgaggcacagagcggttcacttgtgcgacagctgacgcatatcaagctcttcttttgcaccaggcattgcgcatgaaccatctcaccgcatcctcacagcagccctgcaaaggagatggttttttcaatctccattttacagatgaggaaactgaggcccagaaagatccctttcccagggtcacacagctagtaagaagaatgtggagatttgatcccaggccaaatgacttctctgctaatgtctatctttcatggagaatagagtttgagatgaactaggaagtggagaacatgcatcaactgaatggatggaagaaaagagtctttcagggggccagccatggtggctcatgcctgtaatcccagcactttgggagaccaaggtgggcaggtcacttgaggtcaggagttcaagaccagcccagccaatgtggcgaaatcccgtctctacttaaatatatatatatatacatacacacacacacacacatatatatacatacacacacacacacatatatatacatacacacacacacacacacacacacacacacacacacacatatatatatatatatatatatatatatatatatatatatatatatatatatatatattagccgggcatggtggtgcatgcctgtagtcccagctactcgggaggctaaggcaggagaattgcctgagcccgggagacagaggttgcagtgagccaagatagcaccactgcactccagcctgggcaacagagcaagactccatctcaaaaaataaaaaaataaggaaagagcctttcaggagaaacaaggtaacgctaaagatctttggcaaaaggtatccctagcctgacgcaggaatggccaggcattcgggcaggctggaaggggagcatttcaagatgcagccagggctttaggaaagaccatgccggagagactcagaagttgctgaaatcagggcagccatggctgcttgcctgacacatgagcctggttgctaaacgtgtgatttatcctgatagctttaggagccatcaggaaaataatatgtcactgtgttaacactgaactctctccaaagcatcctgcccaatggtcattaatacaattcaggccacagcctctttagcgctcttaagataagttaaacacttagcacaagagatgtggcccaggtttccctcccagggagtagactcctctctggctagtctggaggcagcattaagcaatctcacttgaaaaatatacctgcctcagaggagaaggagcagccaggaagttcatcggggccctgatgagcatcatttttctaacgcaaatttgtcaacaatttctgcattcatgtctccaagcagccaaagacaaaaagtaatggaatcaaaccacagcaggagagtttgagaaaccccagctgtcaccagctcaatcagaacaggttttgataagtatttgtcactgagtttactgatcagcaacgtgcaacaacagtaatactaagtatcggctggggatggtggctcatgcctgtaattccagcattttgggaagctgaggagggcagatcacttgaggtcaggagttcgagaccagactggccaagatggtgaaacctcatctctactaaaaatacaaaaattagccaggcatagtggtgcacgctgtagtcccagctactcaggaggctgaggcagaacaatcacttgaacccaggaggcggaggttgcagtgagccgagattgcacaactgcactccagccttggtgacagagcaagactccgtctcaaaaaaaaaaaaaaaaaaaaaaaaaaagagtactaagtatcatacctgtgggatgcagaagggcagtccagattggcatttacagtcctaaatgacatttgttagaaaaacaggaaaattcataagaataattggaaagaccgttaaaatagataaggctttagcaagcttaatcaaaggggaaaagagagagatcaataaacaacatccagaatgaaagggtggacattactaaaatccaggggaggttgtttcttttaattacaagaatgccaggcacactgttttaccaatgaatttgaaaatctaggtgagattgacacttttcaggaagacacaaattactgaaattagcccaagtggaaataaaaataaatacaacaaaccaaagatcatgaaaatttgttaaatcattaaagagaaagtgcgtttttggtgcccccaccaaaaaaggcaccaggtcccactggttttaaacaagagttccaacaaaacttcaaggaaaggataaatctcatccagcataaactacagagcaaagaaaaagatggaatgctctcccacacattttataagactaacatcaccctaaagctgacactggagttacagcgcatatgacaaatggacaaattgcggtcgtcgctgctgaagttggaaggcccctgcgatcccagcacctaccttcatccatgccctgtgactctttacagaagttttctgcagatcctgtctgagctttagtttccacactggtgaaaagaggggtctggactataattggtatcatttatttgacacctgc

SEQ ID NO: 430 - DNA, 118942 bp, Homo sapiens
tcggttggaatctgttgaatgattggataaagtaaaagataagtatagggaattattaggtagcattaaatgtgtaataaatgtaaagagagggagcaagtgcatacaaggaagtgtgcgctactgggtttctgttgaattgttcatggaagaccatcagcagttcaaatccaaaagcctgtcttaaaattagctgagtgtggtggcgtgtgcctgtaattccagctacttgggaggctgaggcaggagaatcacttgaacccaggaagcggcgattgcagtgagccaagatcgcaccactgtactccagcctggtgatagagcgatactccgactcaaaaaaaaaaaaaacttgtcttgagggactatgccaggctttacagctacaaacatcatggaggaagctgtctgcccattagaagcccagagcccggagggacagactagagcaaatcctctccctcgttggagctagatgggaacacaaatctatctgataactaacatgcaattttacatctcttaccttgtttaatcctcacaaccaccctgatgagtagtagtattatccccattttgtagatgaagaaacaagttcttcaaggggaagggatcctcagagtagcatatgaatgagaggcagaaccagagtcaggacctatatcttgtcttctccttcctaaaactagaaaagtacccacaaccaggcaatgcttttggtgcagaaaaagcagtagtgaacaaaataggcaaaaatgtctgcctttagtgctcacattgttgtggagaaagacaaacaataagcacagtagagaagtaaaaattagaatgttttgctaaaaagtccataaaattgaatattattcagccataagaagggatgaagtaccgttatatgctacaacatggatgaaccttgacaccattatgctaaatgaaagaagccagtcataaaaggtcacatatttcattattccatttgaatgaaatctccagaataggcagctacttcctatccacagaggtagaaagtagatgaatggtaaccaggggctaggggaagaggggaatggggagtgactctttattgggtacagagtttcttttttgggtgatgaaaatgatctagaattagataactgtgatggtgacaaaactttgttaatatactaaaaaccactgaattggctttaaaccaattgaattttaaagtatactttgaaagggtggatattatggtatgggaattatatctgataatgaaaatatgattacattgttcaaaagcatagggaagcagctacaaaaaatatgaatcataaattgtggctctttttattctgaagtgtagaaattgaatattatagctcaaaatataaaacaaaaacaaagaaagctaaaagcccttccatttggccatcttggagtaagacctaccacagtccagtgccttttactcagccccacagcctagcctattgtttacatgaaaccctgtagcttccactcctgtttggtgggtgtaaagttatgagtgaccatattgggggaagggaggaaaactccccataaacgtgtatcctgggggcctaaggagagacgatggcccaggtatcagaacatgatatgcctacttgtccctatctccttgtccacacataaggcttggaaggcagccatgttgtatatcacgtgatctccaaccaatgagctgattggcttcttcaacaagagcccaggtagagattggtgtctagaggagcccatcagattctagagaatcaggcctttggcagtggaaactcccctgggaggatgtcatagggtcctcagggtcagacacagagagaaggagacattgggacagagagaagaggcaagaaaaaaacatatcttgcagtctgtgaggaacagagtggcccccaggggcctccacctcaggttctggatcaaagctcctcaaagtttaaggtgcatttggatcacctgaggatcttatgaaaataaactctgtctgattcagtaggtctgggtttgggggtgggagcctgttagtatatttctaacaagctcccaggcaaggctgctactgctgctgatctaatgaccacagtttgaggctggacagagtggctcacacctgtaatcccaacactttgggaggacaaggcaggagggtctcttgagggtagaactttgagaccagcctgggcaacacagcaggacctcgtctctaaaaaacaagagagaagaagaaaaaggaaacaacaagaagactcaactagagtaggaagcagttaggccacatatctcttcaatggagaaaagagctttttcttgagtaaattggagtgtacccatgttccttgtcaatgatggtaactttaaatgtcaagaatgtgagagaggccaggggtggtggatcacacctataatcccagcactgtggggggctgaggtgggaggatcacttgagccaaggaattcgggagcaccctgggaaacaaagtgcgaccccgtctctacaaagtcaaaaaattagcccagactggtggcatgcgcatgtggtctgagctacatgggagggtgaggcagaaggattgtttgagcccaggttgaggctgcagtaagctaagtttgtaccactgcactcattccagcctgggcaacagcaagaccctgtctcgaaaaaaaaaaaaaaaaaagaatagtagagcccaggggaaggtgtggccctggggtaggcgctgggagactggagaacaactgttagtggtcccatcactgcccagagcagacagtgccctgtccaccctcatgagatctttgaactccttggacaggactggctataaatgaaaatgtggggacccttatttttaacttgttaagaatgttaagatggcaacagcaaagctttaaaccaagtgcatggcccttctgcgttgtaggcccacaaggccgacactgctattcacatccttgtatggtcccctaccctggagcgtggctggggcctgtgctctactgcttggaagcaaggcttatccctaagccttattttcgggaaggtggatttgagagctactatcccacatccttgcttggtgccctgtgaataaatcttttctcttttgcaaaactcgtgtcatggtgattaatttactgtgcaatgccaggcactgttggaaacctctggataggcctcacagggcctcagccatctcggggaggcgttagctagagtgtaacaaatatgaccccagcaactggggagggacagctcattccttcatgaggtgtggggctggcagccccgcaggcagtcagccacccttcctctctggcctccgtcctgggcactgggcccaggcactgggcaaggaggctgctgcacctcctttctcctcttcctttttttttattttttgagacggagtatggctctgccgcccaggctggagtgcagtggcgtgagctcggctcactgcaagctccgcctcccgggttcacgccattctcctgccccagcctcccgagtagctgggactacaggcgcccgccaccccgcccggctaattttttgtatttttagtagagacgggtttcaccgttttagccagtatggtctcgatctcctgacctcgtgatccgcccccctcggtatcccaaagtgctgggattacaggcgtgagccaccgcgcccagcctctcctcttcccttttagtgggaaatatacctgcagcctagattcccagaaaggggtggtgagagagcagacacgccactgattgacccgaagttctaggagccaagggatgagtgaagagggcgtggccggactcggggctcctggtgaggtgcaccgctgcaggctcggtgacccagcagttcctgcccaaccctcacctacccccagccgttcctgtccgccgcccccaaccagccattcctgcccgcagttcctgttcccgggcctgtccccgggtttgtccccagggcccgtcccctgggtttaggtctgccctcccacgccccaccccattgcccccgccatgggtctgctgtcccagccctgccgttcagtctacatcttcgccaagaatggcatccccttcgagcttcgcacagtggagctgaccaaagctgggctgggcaggcaggcccaggggatattggccgcggatccctgcctgtccccgctgctttgcagttgggccaagaatgcagactaacacgaagaatcagactctccggtgtggaaactattacataattatctatgttattatttttactttttggagacagcatctaactctgtcactcaggctggagtgcagtggcacaatcatggctcactgcagcctcgaccttccaggcttaagcgatcctcccgcctcagcccctcaagtagctgggactacaggtgcccaccgacatgcctggccaatttattattattattattattgagaggaggtcttgctgtgtttccgaggctggcctagaactcctgggctcaagtgatcctcttgccttggcctcccaaagtgttgggattacaagcatgagccgccatgccccactggttgtctattttaatagaggcttgatctttgcttgtgaatacaaaacattcttcaaaatacaggtttagagagggcacagcaggcacagaacgagggtagggaaatggagtggggcaagaatatcttcaccccatgtgcttggaaaaaacaatgaaactgcctcgttgtttcctaagtaaaatagtccctgtctacccctgcctgtgtctcttccacttttgtattatttgtttgtttatttatttatttatttatttatttatttatttatttatttattacagtgtctcaatctgcagcccaggctagagggcagtggcatgatcccggctcactgcagccttgacctctcaggatcaagtgatcctcccaacttactcctcctaagtagaatagttgggactacaggcacgtccccgtgcccagctacttttttctttggtgtgtgtagacgcatgattttgccatgtagaccaggctgaccttgaactcctgagctcaagtgatcctcctgcctcctccttctaaagtgttgagatcacagacatgcaccaccatgtctggccctgggtctcttccacttttatgtatttcttggcattcttctgccttttccttttcctgcatctgacttgctctatcccatggggcttctcacccagctgaaggggctactcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagagggaggaccctgctcagctgactcttcccaactgctgcccttggtacaaccagcttgagtcacctgctacagaacaggggctggacacagaagcagtctgtggagggagaatgggcaggggtgtgtatgtccattcagtagaagggcaaagaggcccacatgtaggcctatgatcagactggagcctggcttgactgaggtcctctgatccaaacaccaggcacctaatgcggcctctagcactggcctagagtgctaaagtgagtcagacctgggaacccccactggggagggagccttgagagtttggcataagaaagcaagaagagctgagccaccggaggctaagtagctgaatggggcagggattcccagcaagaatgaggttggtctgagggttgggaacatgtttggctgggactctggggtattgacaggtcacccagcctggccagtagggcctaagtccccagctgggataggaagctgaatcagagggggcaagcctagagcccagggaggaggctggaggggtctgacctatggatggaactggctgggggtggggtgtgaattacagctccagggaattgtccttgagccatgcttcaaggagctggacacaggaaagatggccctctgatggggtcaaggtctgtgacccagtgactagcagagaggcttcctcttccctgatgcctcccagataggggcctcagaaagctgctgctgggattttggggtgggggtgggcagagacctcagagaactctgggttatccccactcacctctctgatctttcctgcaggccagcagcacagcgatgcctttgcccaggtgaaccccctgaggaaggtgccgggccttgaaggatggggacttcaccttggctgagaggtaaccggtccgtgggctgctgccgggccttgtggggccagtcggctgtctgttcactgttgatggcttggatcatggactgtgggccctgcaccagccccagggtgaagaatgggtggaggcaggcagaggtgcccagtgttgacaagggttatagaagtcccctcctgcattgtacaagtgaggaaactgaggctggaggaggggagggacttgcacaaggccacagggcccagtctgcttccgggcctcctcaccgccagccttcccctccgaaaaaaggagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctgcgtccttctcctcatggatctcacattccattaatagaagggggagctgacagtaacccatgtaaacatggaacatatcggatgttgatggatgccatggaaaaaataaacagggtaagagtgggggtgtgtgtcattatgagtaggatgctgagggaagactccctggaggaggtggcatctgagcagggagctgtaggaatgtgcaaggcatgaggagaagggtgttctcactggagggaagagtgagggcgaaggctccaggtgggacaatgcatggggttcagactggagagcaacgggccagggtgggtgcagtgagcaggaagagcaggaggtcacgacagaggggagcatgggacactgggaaggctttggctcttaccgcaggtggattgagttgttggagagttttgagcagaggagaactgtgatctgacttacgtcgtaaaggatccccctggcaggggtgagaaagccactgcagtcatctggcatgcagcgctggagccccagaccaaggtggtggtggtgcagggttgcgggggattgtggtcagttctgacttttattgaaatctaactgcagggtttgctgaagggttggaggtgggtgggaaaaatgaaagccaaaaccagcctccaggttggtggccgcatggtggcgtcctttaccgaggccacatagtgcctccttggtggagctggattcacattcagagcctgggatcactggatggtccaacacccataaaggcatgatgagctctgagggtcagactgcacaacccttcaccataggtgaacgggagttgggacagggtgggaagcaatgctgccatgtcacctggaaggctctgtccctgctggccttgctcctggccctgtccacactttggatatgttggggagatatccaacatgctctcgttcttcagactcacactgggtgccccttcctcctggaagccttccctgagcccctgctgaagttcatgacattttgtttcttccttgctgcccttagttgagatgacagtctggccccgtgtagggctgtgtgaccctgggtagttacctaacctctctgagcctcacatccctcctctgcatcatggggatagtgaaaatgccccagaaaacggttgaagagtgttcagggcatgtcttctgcccctgccatgtccccccagtgtggctagcttgctctatatgagctgcatgtacaaagcacctgaccactggtacctccaggacctgcaggcccgcgcccatggggatcagtacctgtcatggcagcacatggccctgcagagtagctgctgctgggccatgtggcagacggtgagccatggagggcagggacacctcccgggatgcccaagggatgctgctttcactttacaaaattctgtttagacctgagaccaaatcctggaatgccagagactgcctaattcacccaacttgtttcataggagggaaaccaaggaccagagccaaggaaggattcccctaatgtgccttaattccacagctaccacctgcacacttacactcacacactgttcgacacacagccacactcacacacacatccacccacgtccacccacagtcacacgatgtatcacattcacacgtatacacccacacacacaatcataacatttacacacagtcacacagttaactcctatacacacatatacacccacacaatcacacaactcactcatattcaacaaagtcacacaactcactcacattgacacacatacacaccaaccccacacacaattcacatacatacacacacatatacacccacatacacaaccacaccattcactgacattaatacaaagtcatcacacagttcactcccacacacacacatacacctcacacacacaggcacacaattcacaccaacaaaatcacacagttcactcattcacacacatacacccacatacacaaattcacactgctcagtcacatttacacaccattcaaattcacacacatatacacctacatacacacagttcactcacatcacacacatatacacccacatacacacagttcactcacatcacacacatatacacccacacataaacacagtcacacaattcactcacgttcacacacacagttcactgacattcgcacacatacacacacaccacacacaggcaattcagtcacatggccgaaagccagtccttaccttcctatagttcctttcccagtgtcacctcagcctttggccctcagcgtccccttcccatgcctggactgcggaagagccctgaacacaccccatcttcatgcctccagcgctagcccgagcccttccctctgccaagagcactaagtgcaactcaagatcacttctagggacccttccctgcccctgctgccaggtgacctgaggatcctgctggtcccgcttgacaatgatgcacagcatggttagttcagctgaggtcgctctcccagacttactgccacctacacagcactaggactgactgtttaactttattctttatttcgtgtactttattggagtgtctgttgaaagcaaaaccatccaataaggaacaatcccaaggcagccagcatggatcaagaaggcacaggctgtggccgccatccccagtgcctgatggggagagggggtggtaatggaaaaggcccaggaaagcaggccagagtgtccctcaaaatatgagaaatcactggaagagagagccagaatgggacctaagacagaagccaccaccaggcacccttaaggcaggacagttgcaatggttacttggaatacttccggctaggagtggtgttgcgggaagtcagggaccccaaacagagggaccggctgaagccatgacagaaaaacgtggattgtgaagattttatggacatttattagttccccaaattaatacttttataatttcttatacctgtctttactgcaatctctaaacataaattgtaaagatttcatggacacttatcacttccccaatcaataccgttgtgatttcctatgcctgtctttactttaatctcttaatcctgtcaaccaaggaggatgtatatggcctcaggaccctgtaataattgcattaactgcacacattgtacaggatgtgtgtttgagcaatatgaaatgtgggcaccttgaaaaaagaacaggataacagcaattgttcagggaataagagagataaccttaaactctgactgctggtgagccaggcggaacagagccacatttctcttctttcaaaagcaaataggagaaatatcgctgaattctttttctcagcatggaacgtccctgagaaagagaatacgcaccaggaggtatcagcttataaacagcacccctgggcgtggcctgtctcttatggtcgagactgcagagatgaaatatactccagtctcccatagcactcccaggcttattaggaagaggaaattcccacctaataaattttggtcagaccagttggtctcaaaaccctgtctcctgataagatgttatcaatgacaatggtgcccgaaacttcattagcaattttaattttgcctcggtcctgtggtcctgtgatcttgccctgcctccacttgccttgtgatattctattaccctcttaagtacttgatgtctgtcactcacacctgttcgcacactccctccccttttgaaaatccctaataaaaacttgctggtttttgtggcttgtggggcatcacggatcctaccaacgtgtgacgtctcccccggatgcccagctttacaatttctctcttttgtactctctccctttatttctcaagccggctgacggttaggaaaaataggaaagaacctacgtgattattggggcaggtcccccgatagagtggcacatgatgggcacagggcaggcttgggaaatggggggccgtaaggccacaagacatgtgggcaggtagcccagagtgtgtctggaacatcctgtttattggtcggcagtgacatctactgtcacatttgagaactgcatccacagccacatgacctcctgtgaagacctcagggcaaactggggaaacctgcccttcttggaaggtgatactaggggggatgagcaacacctttcttggaggtttgaattcttcagggcccctccagcatcttggtcttcctaattcctcccttgatcccccagccctaggggtggtagcttcttgcagtgtttacctccgtgttaatctggattctctctgtcttcggagttctctaatgcctggttaccaattctttatatcaagttctctccgttaaaatcattgtggtggggtccatcccatggatatacatggaggtctgtgtgacaatgtataatcttactatttgcagttattacaaaactgtcctagaagacatgaatgcttgttaaaagaaatcttttaagtttcctagacttcaaagaccgttgctatgccctgtgaaacatcgcctatatcctttaacagtttgcaattcgaattggttacttacttaacattttgttgccctggtgatacaattatgttgactcgttattgtgaggttactttgttattaaccatgatgaggattactagcacatacttttactccatatgtataacacaacaatgtagtaaaaccaataactcttggttctctattcaaagtgtttggaatctttattctgtttaaaacactgatgacatttgccaatttttgagtgttcttcatgttactgatttgtaggagctctttatatattgcagatttagtctcttactggttatgtatgctgcacctgaggagtagcagcactgccaaggacactgagtgtcttgtctgtgcagagcttcacatgaagctggagagaagggactggggcaagagggaaagataaaaaggggcaagtaagtaacagaatgaatccttgttgctaatctcctggcccccatcccagacccttcaggggatcctggcgattcgaagcagcatagcctgataggcctctggtgagggtgttgggagggttttcttggccgcctgttccaggatgctcaagatgatgctgtgggcctcctggcatagctcagcacccaggaaagcctccactcgtccacgccatgctgccagtcgtggccgtccctcaaacagttcatagccgagagccaccggctgtagggacaaggatgaaaaagttgtgggcatacaactttcccagttgtcactgccgacccgaatgctggaaccatgggcagaagtatcagagacatggtccattccccagcccctaagtgaatggaccacaggggcccaggcagtatgttcagccttagagcccaagagcagccagggtgagaccccacacccaggcaggaggcagaagttcagggttctggccccagatcatccagagacttgctctatgattctgggcaaagttctggctttctccaggcctcagtgtttctgtctgcctcatgggtgtgacacgaagagggacactgcccacaggctgagctcacacctgcatcagctcctccagggccatgagatcagccagtgtcacctgctggccagcgaggaagggcctgtcccccaggaacttgtcctccagccattgcagggcctggtccatggcagtcctgttgcgttccaccttctcctcgggcacctggaccccaatgaggggccccaacacctgatgggggcagagagtgggtcagtctatggccccggcctactgccaactactccctgatggccaatcactctccagatggctctcctcacctggacccacaggggtataccaaaggtgccacggatgcagtcggcatgccagcccaggtactcatgaacacgggcacgagcctgcaggtcagatggataccagtggtccggcgtctggtacttacagctcaggtaaatcaggatggccgagctgggaacaaatgggcagtggctataaggacactggcaccaggcatttacccctaactgctcccatctgccagtggggcccgggggcttctctgcatttgaaggactgccctccagcctcgccctccatctccagctccccaacaccaccccctcctcctacgagtctcctcctgtctttgttgccttgggcaccgactcttggctggaccttctgctttgcattttgagaacctcatctctgtgatatgccagcagccgccctgtgaggtagacactcctgttagccttttagcacaagagaaaactcaaggtcagaatggtcaagtgacttgtccgaggcggtgcagctcagaataggctccctggacccctggaaccctgcatggggctggcacacagtggatgctccgtggagtcccttgcatgtccacgcgcttgggtcagggatcacgaggggaggaatgtctttggcccccgtctgacaggcccccagccatcacttctgcagccacctgacctcttgtccttttcctgcccagcagctggacctcaccatgagctgtgcccttgggccatggcattggcctctaggcccggcctgggtagattgggtagtctgcgacaagtcactagaggctcttttcagctagcatttgttgaacaaatgcgcaacagtggaaaaatgttcccttgtcttctcttctaatacccttcagtctgggagtggagaggccctgcggctcagaaaaggctggaagatgagaggtggggggacatgttctgtcagcccctgctcatcccggtcacaccccaagctgtaccttctccccagatacctctcctttctttctttcctttttttttgagacggagtctccctctgtcgcccaggctggagtgggctccctctgtcacccaggctggagtgcagtggtgctatctctgctcattgcaagctccgcctcctgggttcacgccattctcctgcctcagcctccccagtagctgggactacaggcggccgccaccacgccctgctaatgttttgtatttttagtagagacagggtttcaccgtgttacccaggatggtctcgatctcctgacctcgtgatccgcccacctcggcctcccaaagtgctgggattacaggcgtaaaccaccgcgcccggcctttttgagacggagtctagctctgtcgcccaggctggagtgcagtggcgcgatctcagcacactgcaagctccgcctcctgggttcacaccattctcctgcctcagcctccagagtagctgggactacaggcgcccgccaccacgcccggttaactttttttccatttttagtagagacggtgtttcacggtgttagccaggatggtctcggtctcctgacctcgtgatccgcccgccttggcctcccgaagtgccgggatgacaggcgtgagccaccgcgcccggccagatccctcgcctttcccctccctcgctgccccatggggtatgggagggccactggggcccggggccagtggggagagccaaggtcacatgggctccggatgcggtgaggggtgagggaaggagggcacctttcagtcaagatgaaatcaccatccttgagcgtcggcagtttccccaggctgttgatctgcaagaactccttgctcttgtgctgccctgaagaggaagaagtcagaaaaggtcttcagaataaaaacgctgcacctctacaccctccctcctcctccccaagcggagccccacagccctgagaaacagcaaggtctgggactagaggcctggatcagcctcactccctggctgggcctccctgccctgccacattccggggcagctggggggttttggtgggtggggccaggtgcagcaggtggataaagagaagttttctagccggactctggtgggccaggggaggggaggcaaactggggtggctcatctcttcccatctcttaattctcacaacagtatgtccttcttcccgaggtcttctgggctttgtgaatttatatgcgtgcattccacgcaagaactctgtcaactccattcagtattttctttccatccctacagagcagaaggtaacgttatcctccttttcagaaggcaagctaaggttcagagaggctgtgatcccttcaaggccactcagtccacagcattctctggtggcagacgctgcaggaggaggtgagggggctgtgcgggcggcgagacgctcagggcagagcagggcgggggcctgggggtgcactgggtttgtggacacgcggggaaacgggctgggcccacctttgaccaaatccacggtgcgcagctctaaggggatgccattcttcttggcgaagatgtagacggcgcggctgggctgggacaccaggtcaagaaacagctctaggcccatggcgggggcggcaaggacagcggggatggcagtgaaggcgctgagcgcggtgtgggcagcagctgtggcaggatcccggcgcgccgggaaataggggatcaggccccaccccctggggacagcacccaattggagcgcaccacccccggacccgcctcgccccttcggttcctgtccagtcctgccggccaagactccaccaccagatccgtgcgtccctacagggagggcggtcgctatgaacgcacagctgggagggtggagttggagctggggaccctcgactggcagggaggacgcggatgcagggggccgactgcaaggggaaggggaaccggctggacagggagaagcaggtctgcttttcgggatcccggtgccagggaccctgcccagttccaggcgtcgccctgacccagaaacgactgggcgccgccgtcctggaaaggccccagcgcacggacatctgagggttcgttcagagctctgtttctcggcgctgcatggtggcggaagggagggagcgaatgggatcccctaaaagggatcttagagtttcacccagtgggatgtgacacttgcaggtgtcccaaactggtgggaaccttgactggaaggctggggttaaggatgaactttctgccgtccagactgtcccctgcagagcagctgctgccagacagcgggagctgccagacagcgggagctcccacttcgtgcacaggatgggggcagggagcccgcagccgcgggaggcaggaatgactgtccgggaacctcctttcttctccctgaatcccagccctggcatctcaccagggggcacagtgatggtccagggctgggcccgggactctagctgaatctttcagagtatcccatccctctggccagtggcccaagcgagtgaaccagaatgcttccttgggagttttgaaactggaactggagagaggagctccctatggggaggtaaacgggagctggggccacctgtagtgacatttcctgagttcgaggagtagacgagactgagagagaaaagctgactcagagaaagggagtgataacagggcatgctggcccacacctgcaatcccagttactctcacgggatctgtttctctgatgtctgggtatgaaaggactttctaagcctcagaacagtgggagaactcaacaaagaaaaaaccaatacatatacaaggttactttgtggaggaaaaaatggattaaccttaagcaaaaaactgggaaggatctcggtaaaagatacgtcagaaggaagtaatgtcctttaagatgttcttagaaacccatcagacaggtggggtgtggtggttcacgcctgtaatccctgtactttgggaggcagagatgggcggatcagttgaggtcaggagtttgagaccagcctgggcaacacggtgaagccccgtctctactaaaaatacaaaaattagctgggtgcggtggcacactcgggaggctgagacaggagaatcacttgaaccttggaggcagaggtttcagtgagctgagatcataccactgcactccagccgggccactgagcgagactgtctcaaaacaaacaaacgaacaaacaaaaagaagagaaactcatcagacgaagacacaggaaaaaaatgagcgaaggaaatcagcagaggtttcattgaaggacaaagagaaatggtcaatacatggatgaaaacatgtttaacttcagtaataatcaaggaagcacacaccaacacaacatgcacatactgtttttatttatcaaaggcacacatatttttgaaatgagtactcctaattaatatgtacagagcacttacccagtgcccagcacaggggtggcaccctgtgtgtgagacagcatgaaacaggtagacacgcgccctgctgaaagtaagggaccgcctctctggaggatccatcgggcaataaggaggtttccacaccttaactgtgtctgccttgacctctggggcctgggagcagagccccctccagctggtggggaaggaagcgtggtgtgtttgaggacagaatggagagaagttgagtagagcaagtgtagactcttcctatccaaagtgtggtcaatggactgggagtatcagcatcaccagggagcttgttggaaatgcagaggctcaggccccactctgaccttactgattgggagcataaactgtaaccagattccagggaggattcatacacacattcccgtttgataagtggggggtagtaggaggtgaggtgaaaagtggggaggggatggctaccgcactggagaaggctggctttgtgttgaggcctttctcatgagggcagtggggagccatggaaggctttatgcaagagagggtacgggcagattgagattacagaaggatcccactggttgccttgtgtgaggacccagggagaagggggaggctgtccctgtttgagtaggagatgagagctactggtggctatgagtggaaagaagtgagcagaggtgagcagaaatcccaaggactggtgatgataggatgatggtgggaaccaggatgggctttgggcagaccctgacccctctctctgcctgtcggcccaccagataataatccctgtgttcctgggcgagtcagtgccacccgagatgttggcggccactttggctgagctggacggatgcctgcagctgctcgaggacaagttcctgcgggaccaggccttccttactgggccccgtatctctgtggctggcttggtggcaatcacggagctgaggcatgagagtgccatggggtgcggtggcccgctgggcagtggtgtatccgggaagggagctgacatcccagctcatgttgtcttttctggctgtgggaccctgtgtgagtcacttctccttctgagcctcagtgtcctcatctataaaatggggctttacaaacccctcaccgcagctatattaagaggcttccaagtgtccccagggagggggacatcctagcccatcacacacatggtggaggagggaaaatccaatcagagaacccctaaagcaggtcatgctgccttacacttggctatgcccagcccctccgctgactctgtcttcccctagcccatcagtgctggctgctgagtctttgaaagcggacccacggtggcagcatggtgcccaacacgtggaggctgcagtgcgggaggacctcttccaggaggccctcccagctgtcctgaaggccaaggacctgcctccagtagaacctgctgttaaagagaatctgaagaccttaatgcagcttttcttgctgtgagtgcgtgtcccacacttgctgagccactgaggggatgctgtgttggtagaataaagacatggagctgtccgtctccttggttgaagagaagacatatctgcaaaggctctggtccacagttcctccagatatcatgcctgcattccttttgtctcctaccccattccattctagcttccatgtgacctctgaaaagagcttgggcaaacgcttacttgaccctgaccttctgtgtggaactttgtatggttcctcactgcccagaagctaaagtacaagtcattgaactttgcattcaaggccttgctcccactcctccaggtggccccttctgcctgcacactcctaacccctctctgggctcccaccttggcctcttggcctccgctcatgctgttccctcctcatcttcgcctggtgcccttcctggtcttttggcatttggcaccctgtctcttctccagggagacttccctgacctccccagccccagtccaggtcaggcgacctctctgggctcctcagccccagtgtttccttgcgggggatacccccggactgagcatgtatcatcgatgaggggtgacctggtggaaagatgtctgaatcaggatcagccttggtctcctcggtctctctcctcactgtggggcgatgttgtgttccacaagtggggtgcagggctggttcatgaacctccttgcaggaagggaagtccctggttatttcctggccctctcccatgcctcctcataaccttgaccacagtcttctctacaccccactcccggaccactggcttgtccatgccccacacctggtcccagacttgccacctgtccctgccctctccccttaggactgtcatatttacctgtcgtgtgtctcagaccttctgatatctgagtcatctaataaacaaactgctaataggacaagatcatgacagacagagactctgtcggcctttcagtggaggctcctttaagtatgcacacttatagagaattttatacacgtagttgaaattgtacatataaacttgcaaattttttctttcttttttgtgggggaggggggagcctgggtctcactctgtcatctagggtggagtgcagtggcacagtcatagctccctgcagcctagatctcctgcgctcaagcaatcctcctgcctcagccgcccaggtagctaggactacaggcacacaccacagcacccagatttctttctttttttttttttttttgtagaaaataaagaagagaatcttgctatgttgcctagcctgatctttaactcctgggctcaagcaatcctcccttcttagcctcccaaagtgctgagattacaggtgtgagccacattgctcgaccacaacttcagtcatatttgtaatgtacaattcaagtgattttgccacactgaccacactcatgtttaagccacgccaacagagttccatgttttctgatgttttttcgagatggagtctcgctctgtcacccaggctggagtgcaatggcgcgatctcggctcactgcaacctccacctccccggttcaagcgattctcctgcctcagcctcccgagcagctgggattacaacgtctgccaccacgcccggctaatttttgtatctttagtagagacggggtttcgtcatgttggccaggctggtctcaaactcctgacctcaggtgatccgcccgcctggacctcgcaaagtgctgggattacaggcgtgagctaccgtgcccggcctttccatgttttaaagaacatattttgccaccccctggtggacagtggctcaccaccggcacaagaggctacacaggcagatgtcaatggggaccaggcagggacaggtattgtcgtgagcctagccctacccgcgcccccgcgagtaaccacatctcctgactgcccaagcgcagatttccatactgaacatgaaattgcctgacttcgaaatggtggcaaatcattcaaaaaaactttaagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggacgtaagcgtgggccgggcagcacggggcgaggggaggttggtgggccaggggtccggccctgtccctgctccgcctccccgacagtgaccccgaatcttttccccagggaccactccccactcctttcctcacgccaagctctgactttccgtgctccacgatcccgcggctccccctccgcacgtctttcccttgtcgccctccccagtcatgacccgggcgtgaccttcagggaccgcggcccgtatcgggatccctgccccgcgaacactgcgcgtttcggctttcgcgcgctcgggtcccgtccccagaggtagcccggccggctccaacttcgggcaaaacttttcatgtccccctcagcgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggtgcgtaggggtagtaggggatccatgtgggactgccgcagactggagccactgatcctgcctcagggggaaaaacccatttcttgccctgcccagtaaggacacatcagggtctggagctttggggccccctgaccccttaggttcctgctgttaggaccatcttcaaagtgcgagcaggattgaatgaatttctggctctgctcctcagtgtgtaagtctgtgaaccgggaaggctctcttttaacacccccggggcagtgcaagggtcatgtgggattgtctgtgtgctgtacctgccttggcacctgacagggtaggtacacgtggctgaagtgtgattttctagaacttttccaggctggtcagaaggaattctgggtatgttctgaagttacgtattttggacctgtgtcccagccaggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaagaagcgtctgcaacccaaacctggcgttctgtgaccgagttaaagtttcctcttgggtaaaagatattcttgagccacatccatgtctaggaggaagtaagggcatgagaagcttgaaaggacactgtccaggcacggtggctcatgcctgtaatcccagcactttgggagaccaaggcgggaggttcatttgacccaggagttgtagaccagtctgggtaacatagtgagatgccatcccccaaaacagttttaaaaattaaccggacatggtggtgtgcacatgtagtctcacttagttggcaggctgaagtgggaggatggtttcagcccaggaggttgaggctgcagtgagctatgattgcgcattgcactccatcctgtgtgacagtgagaccttggctcacaaaaaaagaccttctgaaatggagcctttgttagtccatgaaggtcgatgaggaatggctgatcctgctgggtcctccctcaagctacagaggaataatacagtcagccccctgtatcactgggttacgcatctgttgattcaaacaaccatggattgaaatattagaggaaaaaaaattgataattgcatctatactgaaaatacgtatagactttattccttgtcattattccctaaacaatacaactatttacatagtacgtacattatattaggtattataagtaacccagagattatttaaagtatatgagaggatgtgtgtaggttacatgcaaatattacaccattttatgtaagggacttgagcaaatgtagattctggtttcctctggggattctagaacaaatctcccacggatactcagggaaaactgttactctaacaacaagtgttatacacttaccatgtgctaggtcctctacaggtactttacactcatgatcccatttgatccttacaatccctatccactctccctttgctcagacaagacatgctatccccatgaggtagataatctccattatgccaattttatgatgagaagactaaggctcttcatactcccccgccctcagccaggctgtcccaagctgtggcgctcctcactgaaaactgctgtcacctctgagaggggcatgttggcttatggcacagacattagtggtgggggggccaccctgtgcccaacctttgagaaaacaggtgtctgaggtactgtgtccttagggagtctgcaattaggaggaggcagattgcccctcagcccacagactgacagagatgatggagtgtgcagcacacacgatgaggctactgtgttgagtgtctgtcctaggtgggtcatgctgatgtgcagccaccattccacacctgagtgtcccactgccctgctgggggttggggaatgctcattaccgggatgagcacttttgcaaaatgggctgaggtgggaggatcacttaagcccaggaattcaagaccaccctgggaaacaaagtgcgaccccatctctacaaagtcatacaattagcccagcatggtggcatgagcctgtgatccaaactacatgggaggctgaggcagaaggtttgtttaggcccaggaggtcgaggctgcaataatctgagtttccaccactgcactcactccatgctggctgcctttggattgttcctaattggatggttttgctttcaacagacactccaataaagtacacgaaataaagaataaagttaaacagtcagtcccagtgctgtgtaggtggcagtaagtctgggagagcgacctcggctgaactaactgtggtgtgcatcattgttaagcagggccagcaggatcctcatgtcacctggcaggaggagggacagggaagggtccctagaagtgaccttgagttgcacttagtgctcttggcagagggaagggcttgggctagtgctggaggcatgaagatggggtgtgttcagggctctccagcagtccaggcatgggaaggggacgctgagggccaaaggcggaggtgacactgggaagggaactagcaaggtgaggactggcttttggccatgtgactgaattgcctgtgtggtgcgtgtgtatgtgtgcgaatgtcagtgaactgtgtgtgagtgaattgtgtgtttatgtgtgggtgtatatgtgtgtgatgtgagtgaactgtgtacatgggtgtatacgtgaattttagtgaattgtgtgtaaatgtgagcagtgtgaatttgagtatgtgggtggataagtgaattgtgattttgttggtgtgaattgtgtgcctgtgtgtgacggggagtatgtgtgtgtgtgagtgaactgtgtgatgactatgaatgtcagtgaatgctgtgattgtgtgtgtgtgtgtacgtgtgtggggatttggtctatatgtgtgaatttgagttgtgtgactttgttggatgtgagtgaattatgtgactgggtgtatatgtgtgtgtacacgagttaactgtgtgtaaatggtatgattgtatatgtgtgtgaatgtgatgaatcgtgactagatgcgggtggatgtgtgtatgtgcatggtgtgtccatgagtgtgtaagtgtgcaggtggcacagttgcaacaggagagaagacacaggaagccttacctgccattcatccccccagctgtcctcccagcctggggacccctgggctggaaaggttatgaaaagtggtgctactgccaggaaggggtgatggggcagctgggaggacggtttgagtcttgccaaagggagggagtcgaagcttgcaaccctggggaggaggaggggcagactggggaccctgcttctggaaaaccagcgaccaacccccaaagggacacaggcaacccctgcctccactctacagtggggaaaaggggagagtggcgtggcaggctgcccagccagtcatggagggagtagacttcaggaggagtacagaggtctggtcccattttggggctgaggacaggagcctcaggtcagcagtctgcaggaaggccccagctggaccagctgctcacaccttcccacaggcctgcagatgggtgtggagagcagagcctccaggctgagtctcccagccccagatctgagcagtctaaatcatccccctccaggttccctacggtcttatccaccagccctgctgcccatggtggccccagatgcccaggagagataatagaaggtaagaagtcatgtttgaatgaggaagctctcttcatttatttcatatgaggatgaagaagaggattatgtgatcacaggaatgttgcatgcgggataatccaaagctggttatctccaggccctcactctgccaagagatctctctggaagaagcagccagttcacagatgccctggatccctccgtgcccaatcataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggaggtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacagggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatgcaattatcaattttttttcctctaatatttcaatccatggttgtttgaatcaacagatgcgtaacccagtgatacagggggctgactgtattattcctctgtagcttgagggaggacccagcaggatcagccattcctcatcgaccttcatggactaacaaaggctccatttcagaaggtctttttttgtgagccaaggtctcactgtcacacaggatggagtgcaatgcgcaatcatagctcactgcagcctcaacctcctgggctgaaaccatcctcccacttcagcctgccaactaagtgagactacatgtgcacaccaccatgtccggttaatttttaaaactgttttgggggatggcatctcactatgttacccagactggtctacaactcctgggtcaaatgaacctcccgccttggtctcccaaagtgctgggattacaggcatgagccaccgtgcctggacagtgtcctttcaagcttctcatgcccttacttcctcctagacatggatgtggctcaagaatatcttttacccaagaggaaactttaactcggtcacagaacgccaggtttgggttgcagacgcttcttgtgggggagggaggtcttttcccctgtattcacagaagaggaggttgccaactggagatggttcatttccaagtttgtctggggtcccccagctatgcaggacccagaaagcagatgtctagacatccaggccaatggtctttcactactctgtgagtctcccgtgaacttcacctggaacctggctgggacacaggtccaaaatacgtaacttcagaacatacccagaattccttctgaccagcctggaaaagttctagaaaatcacacttcagccacgtgtacctaccctgtcaggtgccaaggcaggtacagcacacagacaatcccacatgacccttgcactgccccgggggtgttaaaagagagccttcccggttcacagacttacacactgaggagcagagccagaaattcattcaatcctgctcgcactttgaagatggtcctaacagcaggaacctaaggggtcagggggccccaaagctccagaccctgatgtgtccttactgggcagggcaagaaatgggtttttccccctgaggcaggatcagtggctccagtctgcggcagtcccacatggatcccctactacccctacgcaccggtcctggcccagggctagctccttggtgagaaactcaaagaagtgggcgctgtggctgcggttgtcctcggcggtgcccactacgccgatggaggagatggacagctgcgcgcagggctcggtggacccgctcagcgccatggccaggcccggccgtaccgtcacgttcacgcgctgagggggacatgaaaagttttgcccgaagttggagccggccgggctacctctggggacgggacccgagcgcgcgaaagccgaaacgcgcagtgttcgcggggcagggatcccgatacgggccgcggtccctgaaggtcacgcccgggtcatgactggggagggcgacaagggaaagacgtgcggagggggagccgcgggatcgtggagcacggaaagtcagagcttggcgtgaggaaaggagtggggagtggtccctggggaaaagattcggggtcactgtcggggaggcggagcagggacagggccggacccctggcccaccaacctcccctcgccccgtgctgcccggcccacgcttacgtccgcaggtttgcccaggatggaggcagcggcggcgcagagtcgtttctccagccccgcgggcactcggttggcgggcaaattcgtgtccagctccaggaacggcatggcgggcagaggaacggaaacagctctggcggaagaaaagctgggggtacccaaggctcgcggaccagggaggaggggcgaggcgccacagcaacctggcttctcattggctggacagagactcggcgctccccgattggctgcctagggtacctcccgcttctgcaaacaaaagtcacgtgtgccggctgatttccggaagtcccatcgtctccgccctacgtgtagccccacccactacaggtctttaacccggtagtggacccaccctgtctcccccgaccctcctgcctggcgccaggtgggtttccctctcaagcttccgcgctgtggtcgcccggttcctagccctattagaggtctgaacaccacacccccgacacacaaggacacacacacacctataggggtcttccccaggctcgaccctaataaccaatacaacgggagcttaaagtttttttgaatgatttgccaccatttcgaagtcaggcaatttcatgttcagtatggaaatctgcgcttgggcagtcaggagatgtggttactcgcgggggcgcgggtagggctaggctcacgacaatacctgtccctgcctggtccccattgacatctgcctgtgtagcctcttgtgccggtggtgagccactgtccaccagggggtggcaaaatatgttctttaaaacatggaaaggccgggcacggtagctcacgcctgtaatcccagcactttgcgaggtccaggcgggcggatcacctgaggtcaggagtttgagaccagcctggccaacatgacgaaaccccgtctctactaaagatacaaaaattagccgggcgtggtggcagacgttgtaatcccagctgctcgggaggctgaggcaggagaatcgcttgaaccggggaggtggaggttgcagtgagccgagatcgcgccattgcactccagcctgggtgacagagcgagactccatctcgaaaaaacatcagaaaacatggaactctgttggcgtggcttaaacatgagtgtggtcagtgtggcaaaatcacttgaattgtacattacaaatatgactgaagttgtggtcgagcaatgtggctcacacctgtaatctcagcactttgggaggctaagaagggaggattgcttgagcccaggagttaaagatcaggctaggcaacatagcaagattctcttctttattttctacaaaaaaaaaaaaaaaaaagaaagaaatctgggtgctgtggtgtgtgcctgtagtcctagctacctgggcggctgaggcaggaggattgcttgagcgcaggagatctaggctgcagggagctatgactgtgccactgcactccaccctagatgacagagtgagacccaggctcccccctcccccacaaaaaagaaagaaaaaatttgcaagtttatatgtacaatttcaactacgtgtataaaattctctataagtgtgcatacttaaaggagcctccactgaaaggccgacagagtctctgtctgtcatgatcttgtcctattagcagtttgtttattagatgactcagatatcagaaggtctgagacacacgacaggtaaatatgacagtcctaaggggagagggcagggacaggtggcaagtctgggaccaggtgtggggcatggacaagccagtggtccgggagtggggtgtagagaagactgtggtcaaggttatgaggaggcatgggagagggccaggaaataaccagggacttcccttcctgcaaggaggttcatgaaccagccctgcaccccacttgtggaacacaacatcgccccacagtgaggagagagaccgaggagaccaaggctgatcctgattcagacatctttccaccaggtcacccctcatcgatgatacatgctcagtccgggggtatcccccgcaaggaaacactggggctgaggagcccagagaggtcgcctgacctggactggggctggggaggtcagggaagtctccctggagaagagacagggtgccaaatgccaaaagaccaggaagggcaccaggcgaagatgaggagggaacagcatgagcggaggccaagaggccaaggtgggagcccagagaggggttaggagtgtgcaggcagaaggggccacctggaggagtgggagcaaggccttgaatgcaaagttcaatgacttgtactttagcttctgggcagtgaggaaccatacaaagttccacacagaaggtcagggtcaagtaagcgtttgcccaagctcttttcagaggtcacatggaagctagaatggaatggggtaggagacaaaaggaatgcaggcatgatatctggaggaactgtggaccagagcctttgcagatatgtcttctcttcaaccaaggagacggacagctccatgtctttattctaccaacacagcatcccctcagtggctcagcaagtgtgggacacgcactcacagcaagaaaagctgcattaaggtcttcagattctctttaacagcaggttctactggaggcaggtccttggccttcaggacagctgggagggcctcctggaagaggtcctcccgcactgcagcctccacgtgttgggcaccatgctgccaccgtgggtccgctttcaaagactcagcagccagcactgatgggctaggggaagacagagtcagcggaggggctgggcatagccaagtgtaaggcagcatgacctgctttaggggttctctgattggattttccctcctccaccatgtgtgtgatgggctaggatgtccccctccctggggacacttggaagcctcttaatatagctgcggtgaggggtttgtaaagccccattttatagatgaggacactgaggctcagaaggagaagtgactcacacagggtcccacagccagaaaagacaacatgagctgggatgtcagctcccttcccggatacaccactgcccagcgggccaccgcaccccatggcactctcatgcctcagctccgtgattgccaccaagccagccacagagatacggggcccagtaaggaaggcctggtcccgcaggaacttgtcctcgagcagctgcaggcatccgtccagctcagccaaagtggccgccaacatctcgggtggcactgactcgcccaggaacacagggattattatctggtgggccgacaggcagagagaggggtcagggtctgcccaaagcccatcctggttcccaccatcatcctatcatcaccagtccttgggatttctgctcacctctgctcacttctttccactcatagccaccagtagctctcatctcctactcaaacagggacagcctcccccttctccctgggtcctcacacaaggcaaccagtgggatccttctgtaatctcaatctgcccgtaccctctcttgcataaagccttccatggctccccactgccctcatgagaaaggcctcaacacaaagccagccttctccagtgcggtagccatcccctccccacttttcacctcacctcctactaccccccacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggcggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcatgttgtgttggtgtgtgcttccttgattattactgaagttaaacatgttttcatccatgtattgaccatttctctttgtccttcaatgaaacctctgctgatttccttcgctcatttttttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttaaccccagccttccagtcaaggttcccaccagtttgggacacctgcaagtgtcacatcccactgggtgaaactctaagatcccttttaggggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatcccgaaaagcagacctgcttctccctgtccagccggttccccttccccttgcagtcggccccctgcatccgcgtcctccctgccagtcgagggtccccagctccaactccaccctcccagctgtgcgttcatagcgaccgccctccctgtagggacgcacggatctggtggtggagtcttggccggcaggactggacaggaaccgaaggggcgaggcgggtccgggggtggtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaaggtgggcccagcccgtttccccgcgtgtccacaaacccagtgcacccccaggcccccgccctgctctgccctgagcgtctcgccgcccgcacagccccctcacctcctcctgcagcgtctgccaccagagaatgctgtggactgagtggccttgaagggatcacagcctctctgaaccttagcttgccttctgaaaaggaggataacgttaccttctgctctgtagggatggaaagaaaatactgaatggagttgacagagttcttgcgtggaatgcacgcatataaattcacaaagcccagaagacctcgggaagaaggacatactgttgtgagaattaagagatgggaagagatgagccaccccagtttgcctcccctcccctggcccaccagagtccggctagaaaacttctctttatccacctgctgcacctggccccacccaccaaaaccccccagctgccccggaatgtggcagggcagggaggcccagccagggagtgaggctgatccaggcctctagtcccagaccttgctgtttctcagggctgtggggctccgcttggggaggaggagggagggtgtagaggtgcagcgtttttactctgaagaccttttctgacttcttcctcttcagggcagcacaagagcaaggagttcttgcagatcaacagcctggggaaactgccgacgctcaaggatggtgatttcatcttgaccgaaaggtgccctccttccctcacccctcaccgcatccggagcccatgtgaccttggctctccccactggccccgggccccagtggccctcccataccccatggggcagcgagggaggggaaaggcgagggatctggccgggcgcggtggctcacgcctgtcatcccggcacttcgggaggccaaggcgggcggatcacgaggtcaggagaccgagaccatcctggctaacaccgtgaaacaccgtctctactaaaaatggaaaaaaaagttaaccgggcgtggtggcgggcgcctgtagtcccagctactctggaggctgaggcaggagaatggtgtgaacccaggaggcggagcttgcagtgtgctgagatcgcgccactgcactccagcctgggcgacagagctagactccgtctcaaaaaggccgggcgcggtggctcacgcctgtaatcccagcactttgggaggccgaggtgggcggatcacgaggtcaggagatcgagaccatcctggctaacacggtgaaaccctgtctctactaaaaatacaaaacattagcagggcgtggtggcggccgcctgtagtcccagctactggggaggctgaggcaggagaatggcgtgaactcaggaggcggagcttgcaatgagcagaggtcgcgccactgcactccagcctgggtgacagagggagcccactccagcctgggcgacagagggagactccgtctcaaaaaaaaaggaaagaaagaaaggagaggtatctggggagaaggtacagcttggggtgtgtccgggatgagcaggggctgacagaacatgtccccccacctctcatcttcagccttttctgagccgcagggcctctccactcccagactgaagggtattagaagagaagacaagggaacatttttccactgttgcgcatttgttcaacaaatgctagctgaaaagagcctctagtgacttgtcgcagactacccaatctacccaggccgggcctagaggccaatgccatggcccaagggcacagctcatggtgaggtccagctgctgggcaggaaaaggacaagaggtcaggtggctgcagaggtgatggctgggggcctgtcagacgggggccaaagacattcctcccctcgtgatccctgacccaagcgcgtggacatgcaagggactccacggagcatccactgtgtgccagccccatgcagggttccaggggtccagggagcctattctgagctgcaccgcctcggacaagtcacttgaccattctgaccttgagttttctcttgtgctaaaaggctaacaggagtgtctacctcacagggcggctgctggcatatcacagagatgaggttctcaaaatgcaaagcagaaggtccagccaagagtcggtgcccaaggcaacaaagacaggaggagactcgtaggaggagggggtggtgttggggagctggagatggagggcgaggctggagggcagtccttcaaatgcagagaagcccccgggccccactggcagatgggagcagttaggggtaaatgcctggtgccagtgtccttatagccactgcccatttgttcccagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgaggagagccatctggagagtgattggccatcagggagtagttggcagtaggccggggccatagactgacccactctctgcccccatcaggtgttggggccactcattggggtccaggtgcccaaggagaaggtggaacgcaacaggactgccatggaccaggccctgcaatggctggaggacaagttcctgggggacaggcccttcctcgctggccagcaggtgacactggctgatctcatggccctggaggagctgatgcaggtgtgagctcagcctgtgggcagtgtccctcttcgtgtcacacccatgaggcagacagaaacactgaggactggagaaagccagaactttgcccagaatcatagagcaagtctctggatgatctggggccagaaccctgaacttctgcctcctgcctgggtgtggggtctcaccctggctgctcttgggctctaaggctgaacatactgcctgggcccctgtggtccattcacttaggggctggggaatggaccatgtctctgatacttctgcccatggttccagcattcgggtcggcagtgacaactgggaaagttgtatgcccacaactttttcatccttgtccctacagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaaccaagagttattggttttactacattgttgtgttatacatatggagtaaaagtatgtgctagtaatcctcatcatggttaataacaaagtaacctcacaataacgagtcaacataattgtatcaccagggcaacaaaatgttaagtaagtaaccaattcgaattgcaaactgttaaaggatataggcgatgtttcacagggcatagcaacggtctttgaagtctaggaaacttaaaagatttcttttaacaagcattcatgtcttctaggacagttttgtaataactgcaaatagtaagattatacattgtcacacagacctccatgtatatccatgggatggaccccaccacaatgattttaacggagagaacttgatataaagaattggtaaccaggcattagagaactccgaagacagagagaatccagattaacacggaggtaaacactgcaagaagctaccacccctagggctgggggatcaagggaggaattaggaagaccaagatgctggaggggccctgaagaattcaaacctccaagaaaggtgttgctcatcccccctagcatcaccttccaagaagggcaggtttccccagtttgccctgaggtcttcacaggaggccatgtggctgtggatgcagttctcaaatgtgacagtagatgtcactgctgaccaataaacaggatgttccagacacactctgcgctacctgcccacatgtcttgtggctttggggcctatttcccatgcctgacctgtgcccaccatgtgccactctattgggggacctgccccaataatcacgtagattgtttcctatttttcctaagtgtcggccggcttgagaaataaagggacagagtacaaaagagagaaattgtaaagctgtgcatccgggggagacgtcacacgttagtaggatctgtgatgccccacaagccacaaaaaccagcaagtttttattagggattttcaaaaggggagggagtgtgcaaataggtgtgagtgacagacatcaagtacttaacagggtaatagaatatcacaaggcaagtggaggcagggcgagatcacaggatcacaggaccgaggcaaaattaaaattgctaatgaagtttcgggcaccattgtcattgataacatcttatcaggagacagggttttgagaccaaccggtctcaccaaaatttattaggcgggaatttcctcttcctaataagcctgggagcactatgggagactggagtctatctcacctctgcagtctcgaccataagagagaggccacgcccggggggctgtttataagccgatacctccaggtgcgtattctctttctcagggacattccatgctgagaaaaagaattcagcgatatttctcccatttgcttttgaaagaagagaaatatggctgtgttctgcccggctcaccggtggtcagagtttaaggttatctctcttattccctgaacaattgctgttatcctcttcttttttcaaggtgctcagatttcatattgctcaaacacacatcctgtacaatttgtgcagttaatgcaattattaaagggtcctgaggcgacatacatcttcctcagctgacaggattaagagattaaagacaggtataggaaatcataagggtgttgattggggaagtgataagtgtccatgaaatctttacaatttatgtttagagattgcagtaaagacaggcataagaaactataatagtattaatttggggaactaataaatgtccataaaatcttcacactccacgttcttctgtcatggcttcagccggtccctctgtttggggtcactgacttcctgtaacaccactcctagccggaagtattccaagtaaccattgcaactgtcctgccttaagggtgcctggtgatggcttctgtcttaggtcccattctggctctctcttccagtgatttctcatactttgggggacactctggcctgctttcctgggccttttccattaccaccccctctccccatcaggcactggggatggcggccacagcctatgccttcttgatccatgctggctgccttgggattgttccttattggatggttttgctttcaacagacactccaataaagtacacgaaataaagaataaagttaaacagtcagtccccgtgctgtgtaggtggcagtaagtctgggagagcgacctcagctgaactaaccatgctgtgcatcattgtcaagcgggaccagcaggatccttaggtcacctggcaggaggaggggcagggaagggtccctagaagtgatcttgagttgcacttagtgctcttggcagagggaagggcttgggctagtgctggaggcatgaagatggggtgtgttcagggctctccagcagtccaggcatgggaaggggacgctgagggccaaaggctaaggtgacactgggaagggaaccatagcaaggtgaggaatggctttcggccatgtgactgaattgcctgtgtgtggtgcgtgtgtacgtgtgtgaatgtcagtgaactgtgtgtgtgaacgtgagtgaattgtgtaactttgtttatgtgtgggtgtatatgtgtgtgatgtgagtgaactgtgtgtatgtgggtgtatatgtgtgtgatgtgagtgaactgtgtgtatgtgggtgtatatgtgtgtggtgtgagtgaactgtgtgtaagtaggtgtatatgtgtgtgaatttgaatggtgtgtaaatgtgactgagcagtgtgaatttgtgtatgtgggtgtatgtgtgtgagtgaactgtgtgattttgttggtgtgaattgtgtgcctgtgtgtgtgaggtgtgtgtgtgtgtgtgactgaactgtgtgatgactttgtattaatgtcagtgaatggtgtggttgtgtatgtgggtgtatatgtgtgtgtatgtatgtgaattgtgtgtggggttggtgtgtatgtgtgtcaatgtgagtgagttgtgtgactgttgaatatgagtgaattatgtgattgtgtgggtgtatatgtgtgtacaggagttaactgtgtgactgtgtgtaaatgttatgattgtgtgtgtgggtgtatatgtgtgaatgtgatacatcgtgtgactgtgggtggacgtgggtggatgtgtgtgtgagtgtgcgtggctgtgtgtcgaacagtgtgtgagtgtaagtgtgcaggtggtagctgtggaattaaggcacattaggggaatccttccttggctctggtccttggtttccctcctatgaaacaagttgggtgaattaggcagtctctggcattccaggatttggtctcaggtctaaacaggattttgtaaagtgaaagcagcatcccttgggcatcccgggaggtgtccctgccctccatggctcaccttctgccacatggcccagcagcagctactctgcagggccatgtgctgccatgacaggtactgatccccatgggcgcgggcctgcaggtcctggaggtaccagtggtcaggtgctttgtacatgcagctcatatagagcaagctagccacactggggggacatggcaggggcagaagacatgccctgaacactcttcagccattttctggggcattttcactatccccatgatgcagaggagggatgtgaggctcagagaggttaggtaactgcccagggtcacacagccctacacggggccagattatcatctcaactaatggcagcaaggaagaaacaaaatgtcatgaacttcagcaggggctcagggaaggcttccaggaggaaggggcacccagtgtgagtctgaagaatgagagcaagttgggtatctccccaacatatccaaagcatggacagggccaggagcaaggccagcagggagagagccttccaggtgacatggcagcattgctccccaccccgtcccatctcctgttcacctatggtgaagggttgtgcagtctgacccccagagctcatcatgcctctatgggtgttggaccatccagtgatcccaggctctgaatgtgaatccagctccaccaaggaggcactatgtggcctcggtaaaggacgccaccatgcggccaccaacctggaggctggttttggctttcatttttcccacccacctccaacccttcagcacaccctgcagttagagtttcaagaaaagtcagaaccgaccatcaccccaccaaccctgcaccaccaccaccttggtctggggctccagcgctgcatgccagatgactgcagtggctttctcacccctgccagggggatcctttatgacgtaagtcagatcacagttctcctctgctcaaaatactccagcgactcaatccccctgcggtaagagccaaagccttcccagtgtcccatgctcccctctgtcgtgacctcctgctcttcctgctcactacacccaccctggcccgttgctctccagtctgaaccccatgcattgtcccacctggagccttcgccctcactcttccctccagccagaacacccttctcctcatgccttgcacattcctacagctctctgctcagatgccacttcctccagggagtcttccctcaacatcctactcacacacccccaatcttaccctgtttattttttccatggcatccatcaacatccgatatgttccatgtttacatgggttactgtcagctcccccttctattaatggaatgtgagatccatgaggagaaggacgtagacacgttcactgctcaagccccagggcttaaatggggtctggccctggtggatgtttagcaaatagccactgaagctcgctgagtggtccctcgactctccagggaaacagcacttgccccacaggatttgtgggcaaaatggtagcactaagatgcctggtacagccgctcctcgaaacttagcactctccttttttcggaggggaaggctggcggtgaggaggcccggaagcagactgggccctgtggccttgtgcaagtccctcccctcctccagcctcagtttcctcacttgtacaatgcaggaggggacttctataacccttgtcaacactgggcaccactgcctgcctccacccattcttcaccctggggctggtgcagggcccacagtccatgatccaagccatcaacagtgaacagacagccgactggccccacaaggcccggcagcagcccacggaccggttacctctcagccaaggtgaagtccccatccttcaaggcccggcaccttcctcagggggttcacctgggcaaaggcatcgctgtgctgctggcctgcaggagagatcagagaggtgagtggggataacccagagttctctgaggtctctgcccacccccaccccaaaatcccagcagcagctttctgaggcccctatctgggaggcatcagggaagaggaagcctctctgctagtcactgggtcacagaccttgaccccatcagagggccatctttcctgtgtccagctccttgaagcatggctcaaggacaattccctggagctgtaattcacaccccacccccagccagttccatccataggtcagacccctccagcctcctccctgggctctaggcttgccccctctgattcagcttcctatcccagctggggacttaggccctactggccaggctgggtgacctgtcaataccccagagtcccagccaaacatgttcccaaccctcagaccaacctcattcttgctgggaatccctgccccattcagccactcagcccccggtggctcagctcttcttcctttcttatgccaaactctcaaggctccctccccactgggggttcccaggtctgactcactttagcattctaggccagtgctagaggccgcattaggtgcctggtgtttggatcagaggacctcagtcaagccaggctccagtctgatcataggcctacatgtgggcctctttgcccttctactgaatggacatgcacacccctgcccattctccctccacagactgcttctgtgtccagcccctgttctgtagcaggtgactcaagctggttgtaccaagggcagcagttgggaagagtcagctgagcagggtcctccctctggcctgcccagggggctctggctctgctctctgccctactgcttagttatagccctgcctcctccactgaattgtgctccagctgcatctctgtatgccagccagaccagcaaacgctggagctcagggtgagggtgctggcctcccccactgccctgccacagggccctccagcctctagcctctaggagtagccccttcagctgggtgagaagccccatgggatagagcaagtcagatgcaggaaaaagaaaagacagaagaatgccaagaaatacataaaagtggaagagacccagggccagacatggtggtgcatgtctgtgatctcaacactttagaaggaggaggcaggaggatcacttgagctcaggagctcaaggtcagcctggtctacatggcaaaatcacgcgtctacacacaccaaaaaaaaaaaaaaaaaaagtagctgggcacggggacgtgcctgtagtcccaactattctacttaggaggagtaagttgggaggatcacttgatcctgagaggtcaaggctgcagtgagccgggatcatgccactgccctctagcctgggctgcagattgagacactgtaataaataaataaataaataaataaataaataaataaacaaacaataaaaaagtggaagagacacaggcaggggtagacagggactattttacttaggaaacaacgaggcagtttgttttttccaagcacatggggtgaagatattcttgccccactccatttccctaccctcgttctgtgcctgctgtgccctctctaaacctgtattttgaagaatgttttgtattcacaagcaaagatcaagcctctattaaaatagacaaccagtggggcatggcggctcatgcctgtaatcccaacactttgggaggccaaggcaagaggatcacttgagcccaggagttctaggccagcctcggaaacacagcaagacctcctctcaataataataataataataataaattggccaggcatgtcggtgggcacctgtagtcccagctacttgaggggctgaggcgggaggatcgcttaagcctggaaggtcgaggctgcagtgagccatgattgtgccactgcactccagcctgagtgacagagttagatgctgtctccaaaaagtaaaaataataacatagataattatgtaatagtttccacaccggagagtctgattcttcgtgttagtctgcattcttggcccgactgcaaagcagcggggacaggcagggattcgtggccaatatcccctgggcctgcctgcccagcccagctttggtcagctccactgtgcgaagctcgaaggggatgccattcttggcgaagatgtagactgaacggcagggctgggacagcagacccatggcgggggcaatggggtggggcgtcggagggcagacctaaacccaggggacgggccctggggacaaacccggggacaggcccgggaacaggaactgcgggcaggaatggctggttgggggcggcggacaggaacggctgggggtaggtgagggatgggcaggaactgctgggtcaccgagcctgcagcggtgcacctcaccaggagccccgagtccggccacgccctcttcactcatcccttggctcctagaactttgggtcaatcagtggcgtgtctgctctctcaccacccctttctgggaatctaggctgcaggtatatttcccactaaaagggaagaggagaggctgggcgcggtggctcacgcctgtaatcccagcactttgggagaccgaggggggtggatcacgaggtcaggagatcgagaccatactggctaaaacggtgaaacccgtctctactaaaaatacaaaaaattagccgggcggggtggcgggcgcctgtagtcccagctacttgggaggctggggcaggagaatggcgtgaacccgggaggcggagcttgcagtgagccgagctcacgccactgcactccagcctgggcgacagagccatactccgtctcaaaaaaaaaaaaaaaaaaaaggaagaggagaaaggaggtgcagcagcctccttgcccagtgcctgggcccagtgcccaggacggaggccagagaggaagggtggctgactgcctgcggggctgccagccccacacctcatgaaggaatgagctgtccctccccagttgctggggtcatatttgttacactctagctaacgcctccccgagatggctgaggccctgtgaggcctatccagaggtttccaacagtgcctggcattgcacagtaaattaatcaccatgacacgagttttgcaaaagagaaaagatttattcacagggcaccaagcaaggatgtgggatagtagctctcaaatccaccttcccgaaaataaggcttagggataagccttgcttccaagcagtagagcacaggccccagccacgctccagggtaggggaccatacaaggatgtgaatagcagtgtcggccttgtgggcctacaacgcagaagggccatgcacttggtttaaagctttgctgttgccatcttaacattcttaacaagttaaaaataagggtccccacattttcatttatagccagtcctgtccaaggagttcaaagatctcatgagggtggacagggcactgtctgctctgggcagtgatgggaccactaacagttgttctccagtctcccagcgcctaccccagggacacaccttcccctggtctctactattctttttttttttcgagacagggtcttgctgttgcccaggctggaatgagtgcagtggtacaaacttagcttactgcagcctcgacctgggctcaaacaatccttctgcctcaccctcccatgtagctcagaccacatgcgcatgccaccaatctgggctaattttttgactttgtagagacggggtcgcactttgtttcccagggtgctcttgaattccttggctcaagtgatcctcccacctcagcctcccaaagtgctgggattataggtgtgatccaccacccctggcctctctcacattcttgacatttaaagttaccatcattgacaaggaacatgggtacactccaatttactcaagaaaaagctcttttctccattgaagacatatgtggcctagctgcttcatattctagttgaggtcttcttgttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagtagcagccttgcctgggagcttgttagaaatatactaacaggctcccacccccaaacccagacctactgaatcagacagagtttattttcataagatcctcaggtgatccaaatgcaccttaaactttgaggagctttgattcagaacctgggctggaggcccctaggggccaccttgttcctcacagactgcaaggtatgtttttttcttgcctcttctctctgtcccaatgtctccttctctctgtgtctgaccctgaggaccctgtgacatcctcccaggggagtttccactgccaaaggcctgattctctagaaactgatgggctcctctagacaccaatctctacctgggctcttgttgaagaagccaatcagctcattggttggcgatcacgtgatatacaacatggctgccttccaagccttatgtgtggacaaggagatagggacaagtaggcatatcatgttctgctacctggtccatcgtctctcctcaggcccccaggatacacgtttatggggagttttcctcccttcccccaatatggtcactcataactttacacccaacagtcaaacaggggtggaagctacagggtttcatgtaaacaataggctaggctgtggggctgagtaaaaggcactggactgtggtaggtcttactccaagatggccaaatggaagggcttttagctttctttgtttttgttttatattttgagatataatgttcaaatttacacttcagaataaaaaagagccacaatttatgcttcatattttttgtagcttcttccctatgcttttgaacaatgtaatcatattttcattatcagatataattcccataccataatatccaccctttcaaagtatactttaaaattcaattggtttaaagccaattcagtggtttttagtatattaacaaagttttgtcaccatcacagttatctaattctagatcattttcatcacccaaaaagaaactctgtacccaataaagagtcactccccattcccctcttcccctagcccctggttaccattcatctactttctacctctgtggataggaagtagctgcctattctggagatttcattcaaatgtaataatgaaatatgtggccttttatgactggcttctttcatttagcataatggtgtcaaggttcatccatgttgtagcatataacggtacttcatcccttcttatggctgaataatattcaattttatggactttttagcaaaacattctaatttttacttctctactgtgcttattgtttgtctttctccacaacaatgtgagcactaaaggcagacatttttgcctattttgttcactactgctttttctgcaccaaacgcattgcctggttgtgggtacttttctagttttaggaaggagaagacaagatataggtcctgactctggttctgcctctcattcatatgctacccttccccttgaagaacttgtttcttcatctacaaaatgggcataatactactactcatcagggtggttgtgaggattaaacaaggtaagagatgtaaaattgcatgttagttatcagatagatttgtgttcccatctagctccaatgagggagaggatttgctctagtctgtccctctgggctctgggcttctaatgggcagacagcttcctccatgatgtttgtagctgttaaggctggcgtagtccctcaagacaagttttttttttgtttgtttgttttttttttgagtcagagtatcgctctgtcaccaggctggagtacagtggtgcgatcttggctcactgcaatctctgcttcccggattcaagcgattctcctgcctcagcctcctgagtagctgggattacaggcatacgccaccacacccagctaattttaagacaagcttttggaattgaactgctgatggtcttccatgaacaattcaacagaaacccagtagcgtacacttccttgtatgcacttgcaccctctctttacatttattacacatttaatgctacctaataattccctatacttttactttatccaatcgttcaacagattccaaccgaaatacatagaagagtgatattccaacttcatcagaccctgagattctatttttaacatttcttccatggattgttgaatgtttccaatgattgatccaccttcccttggccttttctacattacagatttggtggcatgtccatgtctatgttgccaaacttgcctcatagacccagcttgaacacaagatgggtgcttgctgaagagcaggactcattctgttgaacctgcatgttttctcaggtcagattgcttggtggcgcttctttaatttctttcaacagcacattgtagtttgctgtgttgaaatgttgcttttctttggttaaatttattctattttattctttttgatggtattataaatggaagtgtggttttaattttgtttttcatcctttattgcaaatgtatactattgatttttgtgtattaatcttgtaccctgcaaccttgctgaacttattttattttattgagatggagtctcagtcagtcacccaggctggagtgcagtggcttgatcttggcacactgcaacctccacctcctgggctctggtgattctcctgcctttgcctcctgagtagctgggactacaggcatgcgccaccacgcccggctaatttttgtatttttagtagagacggggtttcaccatattggacaggctggtctcaaacttctgacctcatgatctgcccgccttggcctcccaaagtgctgggattacaggtgtgagccaccgtgcccagccttgaacttgtttattagctctaatggtttttaagtgagttaagaatttctgtaatgtcatctgtgaatagagatggttttacttctttctttctgatctagattccaccttgttcctttttcttgcctaattgccctaataagtagaagtagtgtgaatgaacattcttgtcctgttcctgatcttaggggggaaacgcttgatctttcacaatggatgaagtatggtgttagttataggtttttcatagatgctttttgtcaagttgaggaagttcctttctcgtcttcatctgctgagtaattttatcgtaaaaggatgttaggttttgtcaaatgccttctgtgcattaggatgatcatgtgactttctattaacatggtatgctacactgattgatttttgtatgttgaactgcatttgtactcctgggataaatcctacctggtcaaggtgtatgatccttttaatatgctgctggatttgatttgctaatattttgctgaggatttttacatctatatttataaggatattgctttgtaactttattttcttgtaatgtctttttctgtctttggtatcagagtaattctggcctcatagtatgagttgaaaaatatttcttcctgttttatttttttggaagagtttgtgaaggctttgtgttagttcttcaagcttttggttgaattcaccagggaagccatctggtcctgggcttttctttgtggaatttttaaaaataattaatattttaatctctttatttgttacaggcctattaaaattttatctttcttcttaagtcagttttggtagattgtgtgtttctaaaattttcccatttcatctaggttgtctaaattgtccacatatagttattcatagtatttctaaacttttgaatttctctatgaccaatgtgatgtctccattttctttctttctggtttccatttcattttttcatttttgtttttgtttgttttttgagataaggttcttctatgtgcccaggctggagtgcagtggtgcaatcatagctcggtgtaaccttgaactcttggactcgagtgatcctcccacctcggccacccagttagctaagactacaggcttgcaccaccacaccaagctaatttttttaaaaaatatattttttagaaaaaagtctcattgtgttacccaggctgttatcaatctcctggcctcaagtgatccttctgcctctgctttccaaagtgctgggattgcaggtgtgagccattgcacccagcctccactttctttcttggtgaataatttgacccttatttttttcacttggctattctaagtaaaggtttgccaattttgttgatctttgcaaagatccaatttttggttttattgattttattgcttttctattttctatttcatttatctccattctaatctttattatttcctgttttctagtggtgttgggttgagtttgctcttatttttctagttccttaaggtgtaaagttaggttattgattcaagatcattcttctttaacttatgtgtttacagctataaattttgctcttagaactgcttctgctgcatcctataaatctgggcatgttgtgttttcatttttatttgttcaggatactttttgatgtcccttgtgatttcttctttaacccatttgttgtttaagagtgtgctgtttaatttctatgtgcttgtgagttttctagttttccttctgttcttgatttttaactttattccactgtgtccagagaacatactttgtgtgatttcaatcatcttaaatttgagacttaggaccaaatatatgctctatactggagaatattccatgtgctctttagaagaatgcttattctgctcctgtcgggtggaacgttctgttcatgtctagtgtatgcgattggttaatcgtgcttttcaaattccctatttccttgatggtcttctgtagtttttctattactgaaagtggggtattgaagtcaccaactattattactcacaatgtaaccatatttaaccctttacttttaaaattctttttggaaactggaaggatctgtaaccaccacccactcccacatcagaccctatgcatatgccaactgtctgctgctcagcagctgtgatggttgttccagttctttattaggcaaagaacagttgtttttttgtttttttgtttttttttttttaacatttcctttaaggaaggtggctcagattgctaagccagccaggccctgcgggacaggctgcgcctagggtcacctgctcttcttcagcaactcagaaatattctccttgaccattgaatccaatgttgaaaagtcccagtcggccaactgcattagtcgatcatgggcctccctaaagaggccagagccaatattcagctccacctgcatacgccactcagctagcttggagctgttgaggaagacattatagttggctgccatgggctgtagatagacgaagacaaagacgtggtcagcctggggaccagccccacctgggtcctctcccacagcctcaggcccacgtccctaacatctacctatgcaaagaattaggctgctgacccccaaggcctgagcaaggggtcacagactatgtaatagatgtaggtggggatggaggatccagaatccctcagagtcctcagtcactggtcttcttgctccaagccttctgaaccatgctgagagggctcctggcccaggcacttcccacttctccagcctgcgacctcgcatgaatcctgccttcttccagggaaaccccttatcccaggtgtgtatatgtggatgagggagagaactcaggttttttcctccatgtttagcctcccactgtgatcaagctcaggggctaggatgggagacctggcgggcagtctaccctgcagtttcgctggcttactaagagtttggtttgcacccaagatctttgggaagcccaagaatgggtgtgtgtgggtgaaatgtaaggggtggggacgaagcatatggctgaacccttggggcaggccagaatgatttttcctggtgctggtctgccctgcaaacagaccaaggagactaattttcatatcagccagagatctctgggataaggaaaagaatactgcattttctggtcaatccaccaggaccccaggtccctcctctcgggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttcctcccctgttatctttgggatcagcaactggccagggttgggaagaggagggaagaggaggctgcactccagggccacctgccctgccaggtctctgtactcttgtctgctggatagatattgaacacttcccaggatataaagcagtttcacctcttttagcagttctgattggtggaagttgctgggaaccatgtgttcacaaggatttggggagctcagcaggcataagtcctgtgattgattagtgatgtctgtcacaggcatagaattcaaagtagagacacatgtactggttatttgtcatcttctaattttctataggccatactcttttttgtttttgttttttgagatggagtctcactctgtcgcccaggctggagtgcagtggcacaatcttggctcactgccaactccaactcctgggttcaagcaattgtcctgcctcagcgtcctgagtagctgggattacaggtgcccatcaccacacccagctaataattttgtatttttagtagagatggtgtttcacaatgttggcaaggtaggtcttgaactcctgacctcaagtgatctgcccgcctcggcctcccaaagtactgggattacagttgtgagccaccgtacccggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcaggtctggcgggcaccagtgcgatggtgcgctgtacttgcggcacaggtagtaaaggatggccgcgctgcagaaggggccggtcaggggcactgcccttgccttcctgagtgccactacgtcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacgtagggtagcccctggaggtgcagggaggttatggacttaatgcttaagattaggcattatataagccagggcatgaaaggatccatctctctggtgctggatggagggtgagcccgagggggcagaatggacaatgaggtggcgggccagcaactatcgggaaggttgtggtgtctggggatggtggaggccatggggacagagggaaggggacggaggggagacatgcttcggaggggatgtcctaggccttgctgattgatggctggtgtgggaacctccgcagcacaagggctcctttatcatcaccaacagcaaccatgccaaggtaaaaaggtcagggcatggagagagctatcggttaaaaagtggcaggagagacagcaactggctgcaagactcagaacttctttggatcctgatccaaacaaactgccaagaaaatatttaggagataatcagagagttttgaacaggagccacgtattagatgaaatccaggaattactgttaattttatgaggtatcttaatggtatcgtagtgatgctacgctctatcctagcccaggctggagtgcagtggcacaatcagagttcactgcagtcgtgaactcctggcctcaagcgatcctcccgtgtcagcctctcaaagtgctgggattacaggcatgagccaccgcgcccagcctgttgctttttttttttttttttttttttttttaaagaacgcttatctctaagaggtatgttcctgaacgtttattgatttatttacttacttatttttatttttgagatggggtctcactctgttgcccaggctgaagctcaatctttgctcactgcaacctctgcctcccgggctccagcaatccctccacctcagcctcctgagtagctgggactacaggtgcggaccaccatgctggctaacttttgtattttttgtagagatgggggttttgccatgttgtctaggctaggctggtcttgaacacgtgagctcaggccatcccctcacttcagcctctcaaagtgctagaattacaggcatgagctggcccctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgctcgcactgaacctcccaggaggagcagagacagatggtgcaagggccccagggaagacttacctttcacttaagataaatttcccatctttgaggctgggaagcttcctgagggggttgatgtcaatgtattctttgctgtggtggtgacctgggaggagcagggaaggtctgaggctgtgggactccaggggagagagaactgagactcccagagacacaaacgcctccctctctattttctcaagaagagaggactgaggcccggagggacatggcggctcaccccaggtcacagggcaaggcagttgcagaaccggactgggatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagttttggagtccctctgtgctcgggatggagttggagcccacccctctgaccctcactcgggagcagtggagccctgagcctttctgaacactggggaggatgggtgtagacggactgtgcacttctgccccctttgccaacctggtgggcaggtgctgagttcacaaggtcctagaatcccacaacgaagccagggtgcctggtgggagcccagggagtcccagctgctgttcattcccccttctcctcaaaaagcctgttcatctgtggcgtggggactatcattagtggggagtggctaaggtaggctaggcagggacgcagcctacaagccccgtggcatcttttccttccctgtggacctctggggtgattcccttgtctctgtccctgcttctcagaaatgcccctatcaatctgagcgtggtggctcacgcctgtaatcccagcactttggaggctgaggcggggcagatcacttttggtcaggggttcgagaccagcctggccaacatggtgaaactccatctcgactaaaaatacaaaaaatgagccgggcatggtggcgtttgcctataaacccagcaactcgggaggctgagctgggagaatcacttgaacccagtggagattgcagtgagccaagatagcaccactgcactccagcctgggtgacaaagtgaggctctaccaaaaagaaaaagaaaaaaaaagctccaatctgtgtgtcctgcctccccccaggaccaggcctgccaggcagcagtgggagctgacctttcagcagatccacaaactgaaagttgaactggatgtcatgcttcttcgagaagatgtagacggcacggcagggtgctgacagcaggtccatgtagagctccagggccatgttgagacacatgccaggccccacagctgcagctggccagccacagacctgggcctatgtctggccagagtccctggccctgtgccctctccgatctgggcccaggaccctgcattctggaacctcttgtttccctttgtgttgtcataaggccaggaagcctgcaattctcacagcatcaaggattctaaggaggcccaggagtaggctggcagaggcccgtggcaaaggtgtggcagccgtgaccctactctccccctctcacgtgtgtctgtgtcccgtggcgccacctcacagacaccctgtctgagaagggattatgcctgggaattcccagggccggactttgattgcagaacctgacgaaaggggctttgcagggtccagaatgaggaggaggcaatgagaattatccctggaggattctagaagtagaggctgggagcatccacaggtgaatggagcctgaactatgactagaaaggaattgggagaaagagacacaggaacctgggagcttcgggagcagtggggacaccaccaccaggaagtcagggggcactcggcaatgaaagtggcagatgcaataaaacttttaacatattgttgtataatgtacaataatgtaataaaaatacaccccctatacattattgttccaactctagctctatctattgccctcctcatatgaatccctctccccataccccattctctagttaatcttaactaggcctcctgtttatattagccacatcaagcctagctgtctactctatcctgtgatcaggatgagcatctaatttgaaatatgcactcatcggtgcactatgtacagtggcccaaacagtctcatatgaagtcactctagctattatcctcctatcagtcctattaataagtggttcatttaatttgtatatactcattggaacagaagaatttctctggctgctcctaccatcatgacctctggccataatatgacttatttccacactagcagaaaccagccgagcctctttagacctaacagagggggaatcagaattaatctcgggctttaacgtcgaatatgctgcaggcccatttgccctgttctttatagcagactatataaatatcattataataaatgccctgaaggccgcaagaggttcgtgggtgcagtgcacaggagaccatatctggggacagcagctgcagcagaccccaagctgggccatccctgccacttgccaggtggtgcttggcgaaggcaagcagctcccacccgcccggggaatacagcgcgacccccggcggcatgctcttcagcaccaccccaggaggtaccaggatcatctaccactggaaattcctgatggagtgttgaaacttacccgtgaccaaaacactcccaagggatctgcccaccattcccggggtcaccagccctgccagtgatgatccccccaacggaagccagccagagccacctgagcaatagtccagaagataagcagggcgggcagtgaagaagcacagttttgagatggacatttaaagcaccagccatcgcatggagcactgccaagggacccctcaggcccttcctggaggagtcccaccagccaggccttatgaaagtgatcatactaggcaggcattggtgtggggccagtcaccccagccctctctccctcactcgcggcacctgccccctcctctttgtgaacaccagcaggtacctccttgtgcctccgctgatgcaggagcagctgccccaaggggagtaacccctgccagcacaccctgcagctgagggccaggaagtggacaagaatgaaccctttcttccaaatgatcagctcttccagcccctgctgggggccccacgaccccttccttaggttgacgtgcctgggaaagctcacctccccctcttccctaagagaggaaataaaagccaccttcgccctagggcaaaaaataaataaataataaatcccgtaatcactattgtcttcctaggagcactgcataacatatatataccagaactctataccacaaatttcgtcacccaaactctcattttaacaagtctttttttatgaattcgaacatcatattcctgattccattatgatcagctcatatatctccttgaaaaaattttctaccactcacactagtactttcatatgacatatcttcatgccagtcctaacctccagcatcccaccccaaacataagaaatatgtctcacaaaagagttactttgatagaataaattacagaggtttaaacccttttgtttctagaattacaggaattgaacctacccatgagaatccaaaattctccgtgctacataatacaccacatcctatcacaccccacagtaaggacagctaagtaagctattgggcccataccctgaaaatgttggttatacccttcctatactaattaatcctccagtgtatgccatgcagaggagcccagaaacttcctggcctgggttggggctgcagtggccagactgtgcacctggtggcccaggaaggtaactagagccccacgtagaggactgagtgccactcactctatgctttgtgatttaataggtctaggctcagaaatgggactgatcccacttccagtgacagagtaagcctggagacaagcgaagagcatgcagtgtgtttattgcagacagcagggtgcagtgcagtgggctgtacccactcagtggagccactcctgcagcaactgcacctgcttctgggccagctgggggtcctgccgagcctcactgtggttcagaggctggagtatgagcttgtgggcctccaggaagagctcagtaccaagggcagccttcatatgggcctgtcacactgccagccagggccagtcttggaagaggtcgcagccaacggcagtgggctgggaagacagggcagctggggttggggctcagccccatgcccagagtccccccgagggcaggtgggtaggaaagcttcacctgcatcacctccgtcagcaccaagtcttccagggagatctgctccattgccaggaagggcctggccaccaggacccccccatccaggtgctgcagggctggcgtcagcctccccaacagccgctccagctgtgcagcatctgcaggctgtctggagaagtggggcaggagagactgggctgtgaggagaggagcaacttaacccagactcttggaagcctcttgggcctcctctccatcccttcccggctgccattcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtaccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatctgggtgacctacgtcctttccccatctgggcagctccagctggcttagactctagccaggttccagcctccagctttagcccaaaggtgcccctgggtccagcctctgcatcggagctacacaggctgaaatgaggaaggggccacagtgatttggaaagatctccaacccaaggaaagatctcccctctcgcctctgcctccccctacaactctgagccccagaacccaggcagatcctggctctgaccctgggtgggcaccaggtcaccattacctctctgctagtaggaagtcgccatctctgagggcaggcaccttccccagggggttcaccttcaggaactcaggcttcaggtgctcccctggtgggcagaaaggagagaaggctcagtgcagggcctggtccttggcacccactccatggggcccagcccagccacctggctcaccccaagccaactccactgtctgcagctgaaaagggatgtcattctgcctggcaaaagtggatagcatggcagggggctgagtgcatgtccaggaacagcttgggccccattgctgctcctcccacctgccctccccagaggtctgtacctccaggagttgctcagcccttctcggccagtgccttcccccaaaatggggccagaactctgtactcctcctgaagcctattccctccatgactggctgggaggcctgccaagcccctctccccttttctccacctctgtagagtggaggcaggggtggccagtgtccctttgggggtttcagatagaaactcaatgacaattggcttagcaaaaacaaacaaacaaaaaaaaaacaacaaaaaaaaaacaaagggagtggggtgggtggggagatttctcagaaaacttctccagtcataggaggggaggggtgtagaagccactaagagaactggaatcagaacctgtttctgtctccccacttttcctcccctctcctcctctcccctccttcccctcctgtcccctcccctcctctcccctcccctcccttccctttccttccttcccttcctcctttcctcccttctttctttgagacaggatctctgtctccctacacttttttcttttaattctctgtctctttcttgacatagaatcttgctctgtcacccagcctggagttcagtggcacgatcatggcttactgcaatctccaagtcctgtgctccagcagtcattccactacagcctctggagtacctaggactacaggtgcacatgaccataccccactagttaaaaaaaacaaaaacaaaaacaaaaaaacccttgggcctggcagggcggctcgtgcctacaatcccagccctttgggaggccaagatgggctgatcacatgagcccaggacatcaagacgagcctgggcaacgtgccgaaacccagtctctacaaaaaatacaaaaattagctgggcatggtggcgcatgcctgtagtcccagctactcaagagactgaggtggcaggatcacttgagcccaggaggcagaggttgcagtgagccaagatcacgccactgcgctccagcctaggcaacagagccagactctgtctcaaaaaaaaaaaaaagagagagagacagatagggtctcactatgttgtccaagctgatcacaaactcctggcctaaagtgatccttgggtctcagcctcccgagctgattagctgggattgcaggtgtgggctaccacgccctgttatcactccctttctctgagtcagcttttctctctcagactagcctactccatgaactcaggaaatgtcactacaggtggccccagctcccatttacctccccatagggagctcctctctccagttccaatttcaaaactcccaaggaagcattctggttcactcgcttgggccactggccagagggatgggatactctgaaagattcagctagagtcccgggcccagccctggaccatcactgtgcaccctggttagatgccagggctgggattcagggagaagaaaggaggttcccggacagtcattcctgcctcctgcggctgcgggctccctgcacagtcattcctgcctcctgcggctgcgggctccctgcccccatcctgtgcacgaagtgggagctcccgctgtctggcagcagctgctctgcaggggacagtctggacggcagaaagttcatccttaaccccagccttccagtcaaggttcccacaagtctgggacacctgcaagtgtcatatcccgctgggtgaaagtctgagatcccttttagaggatcccattcgctccctcccttctgccaccttccagctccgagaaacagagctctgaacgaaccctcagatgtccatgcgctggggcctttccaggacggcggggcgcagtcctttctgggttggggtgacacctggaaacatgtaaggtccctggcacagggacccctcccagtttcaagcgattctcctgcctcagtctcccgagtagctgggattacaggcgcccaccactgcacccagctaattttttgtgtttttagtagagatggggtttcaccgtgttagccaggatggtcgcgatctcctgacctcgtgactagcccgcctcagcctcccaaagtgctgggattacaggcgtgagccaccatgcagggccaatttttgtattttcagtagagacagggttttaccatattggacaggttggtctcgaactcctgacctcaggtgatctgcctgcattggcctcccaaagtgctgggattacaggcgtgagccaccaagcctggtggtaatttataaggggtggacatttgttggctcatggtcctgaaggctggaaagtccaagatcgaggggccagcatctggccagagctttcttgctgtatcatcccctggtgaaaggataaagagagggtaagagagagcaagaggctgaactcacagcctcaaagtccttttataatccacatcaatccatctgtaacggtggaggcctcatgagataaacacctctcattaggccccacctcccaacactgttgcattggggattacatttccaacacatgctttgtgggggacccattcaaaccacagcacagggacaccttctctttccttcctgtgatatgctgaataatgacccctaaggatatacaagtcctgatctctggaacctgtgaatattaccttctgtggcaaaagggactttgcagaattgattaagaatgttgagatggaggcattgtcttggattatctgagtgagccctaaatgcagtcacaagtatctgtgtaagaggagacagacggagatttgaaacagaagacaggagaagatggaagcagagagatttgaagatgctacattgtgggctttgaagatggaagaaggggctacatgacccaagacaggcagctccaaaagctggaaaaattgaggaaaccaattcccctctcagagcctctggagggtgtgcaaccctattggcacctgggttttggcccagagaaatagattataaagttctggtctccataactgtaagagaatagatttatgttgttttaagccaccaaggtggtggtaatttgttataccatccagaggagaggaacacagattttggtgccaggaagcagggtgctgctataaaaaagaaaatctaggctgggcacagtggctcatgtctgtaatttcaacattttcggatgccaaggtgggtggattacttgagccctggagtttgagactagcctgggcaacatggcaaaaccccgtctctactaaaaatatataaattagctggggatgggccgggagcagtggctcacgcctataatcccagcactttgggtggcaaaggcaggcggatcacgaggtcagaaggttgagaccatcctggcgaacatggtgaaacccagtctctactaaaaatacaaaaaattaaccaggcgtggtggcgggtgcctgttgtcccagctactcaggaggctgaggtagcagaatggcatgaacccaggaggcggagcttgcagagagccaagatcgtgccactgcactccagcctggggaacaaagcgcgactccgtctcaaaaaaaaaaaaaattagttggggatggtagtgcatgcttgtagtcccagctactggggagaccgaggtgggaggattgcttgaggctgggaagtctaggctgcagtgacctgtgactgtgacactgcactccagcctgggcaacagagtcagaccctgtctcaaacaaacaaacaaacaaaaatctaaaaatgtggaagtagctttaaatttgggtgatgtgcagaggccagaaaaattatgaggcccatgatagagaaaacctagattgccttgcacagattgttggtagaaatatggatgttaaagactatagggagggctcacgagtatcaactaaacatggtcagagcaagtctacattgccttacagcatacctaagtcatcataggcagctgtaggtagatatatagatattggctgggtgcagtggctcacgcctgtaatgccagcactttgggaggctgaggtgggtggatcacctgaggtcaggagttcaaaccagcctggccaacatagtgaaaccccgtctctactaaaaatacaaaaattagctaggcgtggtggcatcccagctactagggaggcggaagcaggagaattgctcgaacctgggagacggaggttgcagtgagccaagattgcgccactatactccatcctgggcgaccaagcgagaatctgcctcaaaaaaagaaaaaatagatattaaaaatcctgctgctgaggactctgaagaaatgaggaacgtgtttctggaaactggaggaaggaggatcatttcccagaaaaggagcccgtagggaggtagaaagcttagttgaattgtgtccgatagttatatggtgggtgaacttaaagcaacgaagttggatatttagctgaggagacttccaagcaaagcgttgaaggtgaagcctcatttcttcttgctgtttatggtgaaaagcaagaggaaagtgataaaatgaggaaaaagctgttaagcaaaaagaaaccaaggtttgatgatttgggaaattatcagcctgtgcagattgcaaaagatgctaaaattagaagattcgctgtttggaaaacacaactctatccctgtcctggggatcactcaagacttgtatccatagacaaccagatttctatgggcttgaactctgtgtgtgtgtgtgtgtgtgtgtgtgtgtgtgtgtgtgtgtgtgtgtgtgtgtgtgtagcaaggttgggggagcacagtggaaagaccttgaatttatttgtttattttttagacggagtcttgctctgtcgcccaggctggagtgcaatggcacgatctcagctcactgcaacctccacctccagggtggttcgagcgattctcctgcctcagcctcccgagtagctgggactacaggcgtataccactatgcccagctaatttttgtattgttagtagagatggggtttcaccatgttggtcaggctggcctcaaattcctgacctcaggtgatcaggctggtctcaaactcctgacatcaggagatccaccagcctcggccttccaaggtgctgggattacaggcatgagccaccatgcccagccttattatttatttatttatttttgagacaaagtctccctctgtcacccagactggagtgcagtggcgcaatctctgctcactgcaacctctgtctcccaggttcaagtgattctcccagctcaacctctcaagtagctgggactacaggtgcgcaccaccatgacctgctaatttttgtatttttatttatttatgtattattttattttatttttccataagttattggggtatgggtggtatttggttacatgagtaagttcttttgtagcaatttgtgagattttggtgcacctgtcaccccagcagtatacactgcaccatatttgtagtcttttatccctcaccctcctcccactcttcccctcaagtccccaaagtccattcttatgcctttgcgtcctcatagcttagctcccacatatcagtgaaaacataagatgtttggttttccattcctcagttacttcacttagaataatagtctccaaactcatccaggtcactgcaaatgctgttaattaattccttttcatgactgagtagtattccacatatacatattccatatatattcattccatatatatattccatatatgctcattccatatacatattccatatatgctcattccatatacatattccatatatactcattccatatacgtattccatacgtatgtactccatatacgtattccatacgtatgtactccatatacgtattccatgtatgtattccatacgtatgtattccatgtatgtattccatgtatattttccatatgtatatattccatgtatatattccatatgtatatattccatatatattccttatgtatatattctgtatgtatatactccatgtatatattccgtatatctatattccatatatgtattccgtatgtatatattccatatgtactccatatgtattccatatgttccatatatattccatatattccatataaattccatatattccatatatatcccatatacattccatatattccacatatattccatatacattccatatattccacatatattccgtatattccatatagattccatacatttattccatatatattccatatagattccatatatattcagatatattccatatttatattccatatatggaatatatatgtattccatatatatgtattccgtatatgtatgtattccacatatatattccatatatgtatgtattccacatatatattccatatacgtatattccagatatatactccatatgtatatcccagatatatatattccagatgtatatattccacatatatattccagatgtatatattccatgtgtgtatattccatatatgtatattccatgtgtgtatattccatgtgtattccatatatatattccatgtgtgtattccatatatatagtccatgtgtgtattccctatatatattccctatatatatattccctatatatattccccatgtacattccatatatatattccccatgtacattccatatatattccccatatatattccatatatattccccatatatattccatatatatattccccatatatattccatatatatattccccatatatattccatatatatattccccatatatattccatatatatattccctatatatatattccctatatatattccctatatattccatatatatatatatatatatatatatatatacaccctatatatatattccctatatattccatatatatatggagtctcgctctgttgcccaggctggagtgcagtggcgcgatctctgctcattgcaagctccacctcccaggttcacgccattctcctgcctcagcctcctgagtagctgggactacaggtgccagccaccatgcccagctaattttgttttcgtatttgtagtagagacggggtttcaccatgttagataggatggtctcgatctcccgacctcgtgatccgcccacctcggcctcccaaagtgctaggattacaggcttgagcctccgcgcccggcctctgaattctttttcaggtaaatcagggatttcttcttggtttggatccgttgctggtgaactagtgtgatatttgggggtgttgacgacccttgttttgtcatgttaccacagttggttttctggttccttctcattggggtaggctctgtcagagggaaggtatagggctgaaggttgttgttaagattttttttgtcccagggctattcccttgatgtagtctctcccccttttcctgtggatgtggcttcctgtgagccaaactgcagtgattgttgtttctcttctgggtctagctgcccagtgagtctagtcagctccaggctggtactgggggttgtctgcacagagtcctgtgatgtgaaccgtctatgggtctctcagccatggataccagcacctattctggtggaggcggcggacggtgcagtgcactccgtgagctttggtggtttaatgctctatttttgtgctggttggcctcctgccaggaggtggctctctccagaaagcatcaactgtagtagtgtggagaggggccagtggtgggtggggccctaggactcccaagattatgcgtcctttgtctaccactactagggtgggtaggaaaggaccctcaggtgaggacggtgctaggcatgtctgagatcagactcttcttgggcaggtgttgctgtagctgctgtggaggatgggggtgagatgcccaggtcattggagttgtgtgcctaggagaattatggctgcctctgctgagtcatgcaggttgtcagggaagtgggggaaagccggaagtcacaggcctcatccagctcccatgcaaactgaaggggcggtctcactcccaccatgtcctgcaaacagccctccatctggaaacagcaaacagtgtgtttccagatggagggccagacgaattgaaaacttgcctgaggctttccacctcccagctgccaaagaaaagggctttagttcttcctccgcctgtgaaatctgcaagccagattcacaccctcccctgggttctggcccagaggcttctcaccccattcaaattgttacaaagttcagctagagaattccttctccctgtggagctgtggagttttaccccttgctttctggccaccctcctgatggatccctgtggtgccaggcaggaatgggctgcttggggatccagtgagctcccagggcctttctgctgcttcctctgaccctgtattttgctcggctgagttttgtaacttgactcagctccaggaaaagtcggaaacttcttccacaaacaggccttcagcttctccagtgggggtgtgtgctcaggagaagcgggtctccctttcccacttccacagctggggcactcacagtatttggggtgtctcctgggccctacaggagcaagtctgcttccttcagagggtctgtggatcctctcaggattgctggtttgttctttcagtggatctgcagctaaaattcacaatgcaagcctccacatgctgctctgtccggagctgcaatctggctatgcctcccgtctgccatgatcccgaaatccctctccaatttttatatttttagtagagttggggttttgccatgttggccaggctggtattgaacttctgacctcaagttatctgcccatctcggcctcccaaagtgttggtgtaccaggacaagctgcagacaaaacctctgagacaccaagttaaagaaggaagggctttattcggccgggaacttcagcaagactcacgtctccaacaaccgagctccctgagtgagcaattcttgtcccttttaagggcttacaattctaaggggtctgtgtgagagggtcatgatcaattgagcaagcagggggtacacgactgggggctgcatgcaccagtaattagaatggaacagaacaggacagggattttcacaatgcttttccatacaatgtctggagtctatagataacataactggttaggtcaggggtggatctttaaccaagcccaaggtgcagcgccgggctgtctgcctgtggatttcatttctgccttttagtttttacctctttctttggaagcagaaattgggcataagacaatatgaggggtggtctcctaccttattggggttacaggcatgagccaccgtgcccagccaagaccctgaatttaaatcctgactctgtcattcattagctcctgacctcaagtatgccattaactactttgaatcctggtatccttgctgtcaaaggagatgagagttctgacacttataggtccactgtaagacataatttttaaaatatctgtaaaaactgggccgggcatggtggctcatacctgtaatcccaatactttgggaggtcaaggaaggcagattgcttgagcccaggagtttgagaccagcctgggcaacatgatgaaaccccgtctttaccaaaaattcaaaaaaatttagctaggcattggcacgtgtctgttagtcccatctgctcgggaggctgaagtgggaggatcactggagcccaggaggcagaggttgcagtgagccgagattgtgccactgcactccagcctggcagagtgagaccctgtctctacaaaaatgtaaaataaacttaaaaaatgtcaaagcatgataaagtacaggacataaagaccatgattaatctaacacccatcactacaatctttgcctctgttctggcattcccctatgtgtcttcgcatcaccctccttctgggtgactcctttatgttgtatttttttgtttggtttggtttttttggttagtttgttctgagacagagtcttgctctgttgctcaggctggagtgtagtggtgtgatcttggctcactgctacctctgcctcccaagtttgtacctcagcctcccgagtagttgggattacaggcatgcgccaccatgccctgctaatttttgtatttttagtagagacggggttttgccatgttggccaggctggtctcagactcctggctcaagtgacctgcccacctcagcctcctaaagtgttgggactacaggcatgagccaccacgcccggccaccccactcattttgaatgtaagtagattaccaattctgaaatgggttttgagcagtagcaacattgacacaaatttataatattttcaagaagatacttccttcaatatgtaaaatgcaacagatatcatttgcaatcatacatatgtacatatatacatacacacatataatatatatatctcaccatggaataagtctgagctgaaacatgcattacttaaaaaagaaaacacttacagacaggatcttgctccgtcatccaggctgaagtacagtggcacgattgtggctcactgcagcctcgacctcctgggctcaagtgatcctcccacctcagcctcccaagtagctgggactacaggcatgagctacctcgcctggcctgcatgatctttatgaagaatgtcatagaaagtttttgaaagcgattaaagttcacctaaacaagcagggatctatgctgtatgccatgctattattggggaggaaaaaaattctcctctacattcttagggtctctggagatctggaactaagaataaaactgaaataagacagattaacagaagaaaatcattcaagttttgctaaattttcagtgtacatgggtactttcacaagagaatgaaggcctaaagaagtcactaaagtagaaaaacaataccttttttttttttttttttaagacaaggacgggtgcggtggctcatgcctataatcccagcactttgggaggccaaggcgggcagatcacaaggtcaggagattgagaccatcctggccaacatggtgaaaccccatctctactaaaaatacaaaaaaattagccaggtgcggtggcgggcacctgtagtcccagctactcaggaggctgaggcaggagaatggcatgaatcctggaggcggagcttgcagtgagcggagatcgcaccactgcactccagcctgggtgacagagcaagactctgcctcaaaaaaaaaaaatgacaagacaaagcggcttggattatagggagtaaattgtggagaagggactaggacatacatgcggagcaaaattagaagataaggattatttttagtcgtgtgtttatacagatccattggaaccttgattcacagtcacttgtgatgacaatgttcttctcttcctggtaaagggagggtgctttcttatgggaaattgtgtggcctattcttagatagaaaagggcaggtcagagagtctttcctgcatgtgctatttctcaagtgccttcaactcaaaataattaatactccaaagcagcatatttggggtgacgtgtttttaattccttcatttcccctgctgcagactttcctagaagtttcagatattaaaagctgagttggtggctatggagataagagccagattcataacgagggatctacaaatggggagaagaacatagataagaataggaatgaataagctgaaaggaacaggtctgagcacatttccccttatcctgttaaacacacatcccattgctgggacaaggtcagtacagcagaaggaatgcacctcttttgtttgatggagagtgtttagcttgttctttaacaggtgcagcttaggcactatttgtcccagtggatttacacagaccagccttatccaccaatgatcacacaaactcctccttttgaggctgtcagtgtgtccagggtgcaacaattttggaatacagcagaagctaagctattaacttcttttgttgtggttgctgttgttgttttgagacagaatctcactttgttgagtgcaggctggagtgcagtggtgcgatcatggcttgctgcatccccagcctcctgggctcaagtgatcctcccacctcagcccccagagtagctggaactactactatgccctactaatttttaaactttttgtagagacagtctcactatgctgcccaggctggcctcgaacttctgggctcaagtgatcctccctcctcagactttcaaagtgctgggattagaggcctcagccaccatgcccagattgctttgacatcttgaggccttactgatccaggagagactgcccctccctgggccagctaattcctacagagaataaatgatttgcttatggtgtgccttcgatgggccaatcaaccgattcgtatctccaacataactttaccagccacctttcagcaggttcctgccccaaatcactccagggacaggtaccaggtaacaaaggaccactcctataacccagagcccatcacaattattaaaactagccagtcctaagtctgtttaccctgtcttgccttcttgcaaaaaacacagtaaagccttttgtccaccttttgccctcactcattctgccacctgactgaccctggtgcttccccatggccctgcatggtgtggcatgtcccccctattgtcttgggaactgtgagtaacaaactttcttttacatggctatcacctctgatctgtggcctcgccatacctgaataaagccaaaatcccaggtacattttaaaacaagtctacaagtcaaggaataccaaggatttccagcaacaccagagaggccggcccacgcccggcctgactcttactgttaatcactagttttgcatttctcttgaggaactagtcaggaggagaaaacctagacagcagctctcctggtcaagacccagtcattcagaagcctaaatggcatgcctaggtgcttggctttaaactgttagcaggtatggagtgctctgattgtgttttagaataatattctgggctgggcacggtggctcacgcctgtaatcccagcactttgggaggcggaggcaggcggatcacgaggtcaggagattgagaccatcctggctaagatggtgaaaccccgtctctactaaaaatagaaaaaattagccgggcgtggtggtgggcgcctgtcgtcccagctactcgggaggctgaggcaggagaatggcgtaaacccaggagtcggagcttgcagtgagccgagattgcgccactcattccagcctgggcaacagagcgagactccatctcaaaaaaaaaaaaaaaaaaaaaaagaataatattctggctgctgctggaaggcagccagggaggaagcaaggacattggatactgcagtaatcctggccaaaggcgacttgtgaaaaggggtgggcaactgaaggggcaggagaatgtggcccctctcagtctggagagagctgcagcactaggccaggaaggcactcttctgcggggggataggtcttaaatggggaccatgggattgggtgcagtggctcatgcctgtaatctcaacacttcaggagtctgaggcaggaagaccacttgagcccaggagttggagaccagcctgggcaacatagtgagaccctgtctcaaaaaaaaaaaaaaagacaatttaaaaactagccagatgtgatgcctgtggtcccagctacttgggaggctgaggtgagatgatcacttgatcacttgagccctggaggtcaaggctacactgagccatgatcatcccactgcactccagcctgcgcaacaaagtgagactcttatctcaaaaaaggcgacaggtgggaaccatggggaaccagagaagcaaagctattctcaagttttccagtaaccatcctcttgccaatggtctttctctgaatcttggatttgggaataggattttcctgccttgggaggctcccttgggaaatgggagtgtcacagccacaggcatcaaaagccctagagttgcacttgaatagtgggtagaaagttctgtgcaatgccaggcactgttggaaacctctgggtagggcttacagggccttagccatctgtgggaggcattagctggagtgtaataaatatgaccctcaggactggggagaaacagctcattccttcatgaggtgtggggctggcagccttgcaggcagccagccacccttcccctctggcctccatcctgggcactgagccaggcactgggtaagaaggctgctgcacctcctttctcctcttcccttttagagagaaagatacccccagccgaggatcccagaaaggcgagagcagacgcgccattgattggcccaaagttctccggagccaacctttgagcaaggagggcgtggctgggctccagtctcctagtgaggtgcaccactgcaggcttggtgacccagccgttcctgcccgctgcccccaaccagccgttcctgcccacagttcctgttcccgggcctgtccccgggtttgtccccagggcccgtcccctgggtttaggtctaccctccctcgccccaccccatcgccctcgccatgggtctggagctgtacctggacctgctgtcccagccctgccgttcagtctacatcttcaccaagaacggcatccccttcgagcttcgcaaagtggagctgaccaaagctgggctgggcaggcaggcccaggggatattggctgcggatccccacctgtccccactgctttgcagtcgggccgagaatgcagactaacatgaagaatcagactctctggtgtggaaactattacgtaattatctatgttattatttttactttttggagacaggagctaactctgtcactcaggctggagtgcagtggcacaatcatggctcactgcagcctcgaccttccaggctcaagcgatcctcccatctcagcccctcaagtagctgggactacagatgcccaccgatatgcccggccaatttattattattattattattattattactattgagaggaggtcttcctgtgttgcccaggcaggtctcaaactcctgagctcaggcgatcctctttccttggcctcccaaagtgctgggattacaggcatcagctgtcatgccctgctggttgtttattttaaaagaggcttcatctttgcttagtgaatacaaagcattcttcaaaatacaggttaagagggggcagagcagatgcagcaggagggcagggaaatggagtggggctagaatatcttcaccccatgtgcttggaaaaaacaatgaaactacctccttgtttcctaagtggagtagtccttgtttacctctgcctgggtctcttcccttcttgcctcttctttttttgacacggtctcactctgcagcccaggtagagggcagtggcatgatcccggctcactgcagccttgacctctcaggctcaagtgatcctcccacttcctcctctcaagtagagtagttgggaccacaggcacgcaaccacatccagcaatttcttttttttcctttttttttttttttttggtatttgtggagacgggattttgccatgtagaccaggctgaccttgaactccagagctcaagtgatcctcctgcctcctccttctaaagtgttgagattacagacatgcactaccatgtctggccctgggtctcttccacttttatgtatttcttggcattcttctgccttttcttttcctgcatctgacttgctctatcccatggggcttctcacccagctgaaggggctgctcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagaaggaggaacctgctcagctgactcttcccaactgctgcccttggtacaaccagcttgagtcacctgctacagaacaggggctggacacagaagcagtctgtggagggagaatgggcaggggtgtgcatgtccattcagtagaaggccagagaggcccacatgtaggcctatgatcagactggagcctggcttgactgatgccctctgatccaaacaccaggcacctaatgcggcctctagcactggcctagagtgctaaagtgagtcagacctgggaacccccagtggggagggagccttgagagtttggcacaagaaaggaagaagagctgagccaccgggggctgagtggctgaatggggcagggattcccagcaagaatgaggttggtctgagggttgggaacatgtttggctgggactctggggtattgacaggtcacccagcctggccagtagggcctaaggccccagctgggataggaagctgaatcagagggggcaagcctagagcccagggaggaggctggaggggtctgacctatggatggaactggctgggggtggggtgtgaattacagctccagggaattgtccttgagccatgcttcaaggaactggacacaggaaaggtggccctctgatagggtcagggtctgtgacccagtgactaacagagaggcttcctcttccctgatgcctcccagataggggcctcagaaagctgctgctgggagtttggagtgggggtgggcagagacatcagagaactcagggttctccccactcacctctctgatctcgcctgcaggccagcagcacagtgatgcctttgcccaggtgaatgccctgaggaaggtgccaggccttgaaggatggggacttcaccttggctgagaggtaaccggtccctgggctgctgccgggccttgtggggccagtcagtcagctgtctgtttactgctgatggcttggatcatggactgtgggccctgcaccagccccagggtgaagaatgggtggaggcaggcagaggtgcccagtgttgacaagggctatagaagtcccctcctgcattgtacaagtgaggaaactgaggctggaggaggggagggacttgcacaaggccacagggcccagtctgcttccgggcctcctcaccgccagtcttcccctccgaaaaaaagagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctacgtccttctcctcatggagctcacattccattaatagaagggggagctgacagtaacccatgtaaacatggaacatatcggatgttgatggatgccatggaaaaaataaacagggtaagagtgggggtgtgtgtcattatgagtaggatgttgagggaagactccctggaggaggtggcatctgagcagagagctgtaggaatgtgcaaggcatgaggggaagggtgttctcactggagggaagagtgagggcgaaggctccaggtgggacaatgcatggggttcagactggagagcaacgggccagggtgggtgcagtgagcaggaagagcaggaggtcatgacagaggggagcatgggacactgggaaggctttggctcttaccacaggtagattgagtcgctggagggttttgagcagaggagaactgtgatctgacttacgtcataaaggatccccctggcaggggtgagaaagccactgcagtcatctggcatgcagcgctggagccccagaccaaggtggtggtggtgcagggttggtggggattgtggtcagttctgacttttattgaaatctaactgcagggtttgctgaagggttggaggtgggtgggaaaaatgaaagccaaaaccagcctctaggttggtggctgcatggtggcgtcctttaccgaggccaaatagtgcctccttggtggagctggattcacattcagagcctgggatcactggatggtccaacacccatagaggcatgatgagctctgggggtcagactgcacaacccttcaccataggtgaacaggagatgggacagggtggggagcaatgctgccatgtcacctggaaggctctctccctgctggccttgctcctggccctgtccacgctttggatatgttggggagatatccaacatgctctcgttcttcagactcacagtggatgccccttcctcctggaagccttccctgagcccctgctgaagttcatgacattttgtttcttacttgctgcccttagttgagatgatagtctggccccgtgtagggctgtgtgaccctgggcacttacctaacctctctgagcctcacatccctcctctgcatcatggggatagtgaaaatgccccagaaaatggctgaagagtgttcagggcatgttttctgcccctgccatgtccccccagtgtggctagcttgctgtgtatgaactgcatgtacaaagcacctgaccactggtacccccaggacctgcaggcccgcgcccgtggggatgagtacctgtcatggcagcacatggccctgcagagtagctgctgctgggccatgtggcagaaggcgagccatggagggcagggacatctcccaagatgccaagggatgctgctttcactttacaaaatcctgtttagacctgagaccaaatcctggaatgccagagactgcctaattcacccaacttgtttcctaggagggaaaccaaggaccagagccaaggaaggattcccctaatatgccttaattccagagctatgagcagttaatcctatgctcttttgcatactccaggttgcctgggaatcttgcctttagggggagaaaataaacaaaccctcactttgctacacacataattcgtagatggagaagtatgaagtgaaaaaagtcaaactaggaagaagtgaggagacatttcaataaacgtttgtctgatgtctcggtatgaaaggactttctaaccctcagaacagtgggagaactcaacaaagaaataaccactacatgccagctgcggtagcatctgtaatgagcacacctgtaatcccagcactttgggaggccgaggcaggcagatcacctgagattgggagtttgagaccagcgtgaccaacatggagaaaccccgtctctaccaaaaatgcaaaattagccgggtatggtggcgcatgcctgtaatcccagctactcgggaggctgagtcaggagaattgcttgaatctgggaggcagagattgcagtcagctgagatcacgccattgaactccagccttggcaacaagagcaaaactctgtctcaaaaaacaaacaaacaaaaaaacatatacaaggacatgttgtgtaagaaaaaatggattaaacataaaacaagcaaaaaaccgggaaggatcttgataaaagatatgtcagaaggaggtaatgttctttaagatgctcttagaaacccttaagagaggcctggtatggtggctcacccctgtaatcccagcattttgggaggccaaggtgggcagatcacttgaggtcaggagtttgagaccaccctgggcaacatgatgaaaccccatctatattaaaaatacaaaaattagttgggtgcggtggcacactcaggagactgagacaggagaatcacttgaacctgggaggcggaggttgcagtgagctgacatcataccactgcactcaagctccacttagagcgagactgtctcaaaagcaaacaaagaaaaataagagaaacccatcagacaagagacaggaaaaaaatgagtcatagctcactgcattctagatctcctgggctcaagcgatcctcctgcctccgcccaggtagctagaactacaggtgcacaccacaacactgggattctttttttttttctttttttttgtagaaaacaacgaagggaatcttgctatgttgcctagcctggtcttgaactcctgggctcaagcaatcctcccttcttggcctcccaaagagctgagattacaggtgtcagccactttgcgtgaccacaatttcaatcatatttaaaatgtacaattcaagtgattttgccacactaaccacagactcatgtttaagccacaccaacggatttccatgttttaaataacatattttgccaccccctagtggacagtggctcaccaccggcacaaggggctacataggcagtcaatgggaaccaggcggggacgggaaatgtcgtgaacccaacggtccctgcccagccccacccgcgtccgcaacgtgtaaccacatctcctgactgcccaagagaagcgcagatttccatactgaacatgaaattgcctgacttcgaaatggtggcaaatcattaaaaaaaattttaaactcactttgcattggttattagggtcgaacttggggaagacccctacaggtgtgtgtgtgtctgtatgttaggggtgttcagacctttaatagggctagaaaccaggcaaccacaccgcggaaagcttgaggagagggaaatccaccagacgccaagcaggagggtcagggaagagacagggtggggccactaccgggttaaagacttgtagtgggtggggctacacgtagggccgagacgaccggatttccggaaatcagagccggcacacgtgacttttgtttgcagaagtgggaaggtaccctaggcagccaatcggggagcgctgagtctctgtccagccaatgagaagccaggttgttttagcgcctcgcccctcctctccggtccgcgagccttgggtatctccagcttttttccgccagagctgtttccgttcctctgcccgccatgccgttcctagagctgcacacgaatttccccgccaaccgagtgcccgcggggctggagaaacggctgtgcgccgtcgctgcctccatcttgggcaaacctgcagacgtgagcgtgggccgggcagcactgggcgaggggaagttggtgggccaggggtccggccttgtccctgctctgcctccgcaacagcgaccccgatccctttccccagggaccaccccccaccccattccgcaggccaagctctgactttccgtgcttcacgatcccgcggctccccctccgcacgtctttcccttgtcgccctccccagtcatgacccggacgtgaccttcagggacctcggcctgtactgggatccctgtccccgcgaacactgcgcgtttcggctttcgcgcgctcgggtcgggaccccagacgtagcccgactggctccagcttcgggtaaaacttttcatgttcccctcagcttgtgaacgtgacggtacggccgggcctggccagggcgctgagcgggtccaccgagccctgcgcgcagctgtccatctcctccatcggcgtagtgggcaccgccgaggacaaccgcagccacagtgcccacttctttgagtttctcaccaaggagctagccctgggccaggaccggtgcgcaggggtagtaggcccggaatattattctaaaacacaatcagagtactccattcctgctaacagtttaaagccaaacacctaggcaggccatttaggcttctgaatgactgggtcttgaccaggagagctgctgtctaggttttctcttcctgaccagttcctcaagagaaatgcaaaactagtgattaacagtaagagtcaggcagggcgcggtggctcacgcctgtaatcccagcactttgggaggccgaggcgggcggattatgaggtcaggagatcgagaccatcctgactaacacggtgaaactccgtctctactaaaaatacaaaaaactagccggacgtggtgggcgcctgtagtccccgctactcgggaggctgaggcaggagaatggcgtgaacccgggaggcggagcttgcagtgagccgaaattgcgctactgcacaccagccggggcgacaaagcgagactgtctcaaaaaaataccaaaaaacaagcaaaagaaaacaaaacaaaaacagtaagagtcgtcccaacgcagtggcttatgcctgtaattccagcactttgggaggccgaggcaggcagatcacctgtggttgggagttcgagaccagcctgaccaacatggagaaaccctgtctctactacaaatacaaaattagctgggcgtggtggtgcatgcctgtaatcccagctactcagaaggctgaggcaggagaatcactttaacccgggaggcggaggttgtggtgagctgagattttgccactgaactccagcctgggcaaaaagagcaaaactccttctcaaaaaaacaaacaaacaaacaaaaaaaaaaaacacacacacacacaatccaaaaaccagtaagggtcatgtcctgggaggctaactcagccgactgttaggtcaccatgcttatagccaagaaatgtgggatgctgctgggccctgagcggtcagataaactactttctctgataattagaaggctacaggaaatgttttgttttgttttgttttgggtttctttgtgtgtttttagagacaggatcttgttctgttgccccaggctggagtgctatggctcaatcagagctcactgcagcctcgaactcctgggctcaagcaatcctcccacctcagcctcccaagtagctagaactacaggtatgcatcaccacgcctgactaattaaaaaaaaaatttcttttggttgcgtgtggtgtcttggcacccgtaatcccagcactttgggaggtagaggtgggagcatctcttgagcacaggagtgcagggctagcctgggcaacatggcaagaccctgtctctacaaaaataaaaaagaaatgagctgggcgtggtggggtgcacctgttgtcccagcttcttaggaggctgaggtgggaatattgcttgagcctgggatgtcaaggctgcagtgagccatgactgtgccactgcactccaggctgggcaacagagtgagaccccatctctgaaaaaatatttttttggggagccaggcacagtggctcatggtaatcccagcactttcagaggtggaggtgcacagatcatttgaggtacagagtttgacaccagcctggacaacacggtgaaaccctgtttctactaaaaacacaaaaattagccaggtgtgatagtgcgtgcctataatcccagcttctggggagactgaggcaagagaatcgcttgaacctgggaggtggaggttgcagtgagctgtgatcatgccattgcactccagcctgggcaacagagcaagacactatctcaaaaaaaaaaaaaaaaaagtttgttttgaaatcctggactcaagcaatccccccaacctggacctcccaaagtactaggattataagtatgagctaccacactcagccactttttttttttttgagatggagtctcgctcggttgcccaggctggagtgcagtggcgcgatctcggctcattgcaaggtccgcctcctgggttcatgccattctcctgcctcagcctcccgagtagctgggactacaggcacccaccaccacgcccggctaattttttgtatttttagtagagacggggtttcaccgtgttagccaggatggtctcgatctcctgacctcgtgatccccctgccccggcctcccaaagtgctgggattacaagcgtgagccaccgcacgcggcctcagccacatttattaatttcactcttggcaaacatcagggggaagctgacccacacggcctgggaagggggttgtcttttgcatagagaccatgaccaggtctgggacagaggaaagtcaaataaatcacacattagagttagaagcagaggctcaggctgagcccaggtttattatccaaaatcaaaatgaaatgcagtgattaaaggacacaaggcctcagtgtgcatcattctcattgtggctttcaggcggctgtggaagacagggtggggatggtggcttcgggaggtgaggtgctctgggacttgggcaagtcttaggcaagccattcctgctttctgggcctggctcccatgggccattagaaatgaaaatgctttgtggactgctgaggacggtgcaagggtgaggtttcccagctcaccggatcatggccagcacccagggcatcagcttctgctttatggtggggtctgcaggtgggaagtccttggccttcagaatgacctcatgggcctcctggaagaggtcctcccccactgctgcctccacgcgctgccgccatgtggccagcttgggtcggccttcgaagacttggcagccagcacccacgggctgtggggaaaagggtacagactggggatggatggttgtgagggcagggatgggcagcatctgatttggggaccacagatctccaggaggtgtttgcacacacacttaagcacagtgccatagcccggtgtggcagcataagcaggacttcagcaactagccagggccccctgcctagtgggttcacctgcccacagcactcacatgcatcagctccgtgatggctacgaggtcagctaaggagatgtgaggaccagtaaggaaggccttgttctggaggaacttgtcctcgagcaactgcagggtcacatccaactctgccagggtggctgccagtgtctggggagatactggctcacccaggaaaacagggaacatcacctggggattgggcaggcaaagtcgggagttactggagtagggagttagttttgatttgcatttccctaatgattagtgatgctgagcatcttttcttttttttttttttttgagactgagtcttgctctctcgcccaggctggagtgcagtggggtgatctcggctcactgcaagctccgcctcctgggttcacgccattctcctgcctcagcctcccgagtagctgggactacaggtgcccgccaccacgcccagctaattttttttttatttttagtagagacagggtttcactgtgttagccaggatggtctcaatctcctgaccttgtgatctgcctgcctccgcctcccaaagtgctgggattacaggcgtgagccaccgcgcccggccaagcatcttttcttgtacttgttggccaaaatgataatattctcaacacattgggttaagtaaaatatatcaatttccttttactttttttttttcttttgagacagtgttcagctctgtcacccaggctggagtgaagtggcaccatctcggcacactgccaactttgccccctgggttcaagcaattctcctgcctcagcatcctgagtagctgggattataggcacaggccaccaagcctggctaatttttgtggttttagtagagacaaggtttccccatgttgaccaggctggtctcgaactcctgacctcaggtgatccactgccttggcctcccaaagtgctaggattattggcatgagccactgtgcctggactctttttactttttaaatgtgcctactagaaaatttaaaattacgtatgtggctcactttatacttctatcggacagcacttgactaaatgaactaaattccagagaggcataagccgttcctagatgagctactttcattccaatttcatttccttgggcccaagcaggctgggagaaagactgtcacaggcatgggcttttctgactgagcagcagtttgggaactgggggcagggatgaaaagcagagagatcttacaggcaacatcgtagttggtgattagattccaaagccatgctagactgagctagtgacctgatctcacattcaagatatttgaaaccaaagataaactgaaaccaactaaacctgcaacccagcccacctcctgattagcttagaagagaacagcctcacatcctggctacctgacacagggaagtgcaagccctttcttgggggtgtttattatgcaattcaatctctgctcttcttttatcataatgtctggcacacaaggatacatcatgaggccgggcatggtggctcatgcctacaatcccagcactttgggaggccgagatgggaggatcacctgaggtcaggagttcaagaccagcctggccaacatggtgaaaccctgtctctacaaaaatacaaaaattagccaggcatgatggcaggtgcctgtaattctagctacttgggaggctgaggtgggagaatcgcttgaacccaggaggcggaggttgcagtgagccaagatcgtgccattgcacgccagcctgggcaatggagtgagagtccgtctcaaaaaaataaaaaataatgataatacatcatgagacatgcaaagaagcaggcaaatgtgacccataatcaagagggagaaaacaacaatcaatagaaatagacccgtaggctgggtatggtggctcatgcctgtaatcccaacactttgggaagccaaggaggacgaatcacttcaggtggagagttcgaaaccagcctggccaacatggtgaaacccggtctccactacaaataacaaaagttagccaggtgtgctggtgggtgcctgtaatcccagctacgcaggaggctgaggcaggagaatcgcttgagcctgggaggtggaggttgcagtgagctgagatcgcaccattgcactcagcctgggtgacagagtgagaccccatctcaaaaacaaaacaaaacaaaaaaaccagacccacagaacacctacgtgttgaaattagttgacaaagatttttaggtaacagtgataaatatgttaaagaatttacaagaaaagacagataaaatggatgaacagatggtgaatttcatcagagaagtggaaattctaaaaaacaaccaaatggaatttccagagctgaaaaatacatatctcaaacaaagaatgtattggatgggcttaatagcaatttggcacaacagaggaaagaatctgtgaaggcaaagacaggtcagtagaaataatccaaaactgaaaagaagagactggtgcctgaacacctttggggaatgctctcgctgccgccccccacattcccagcctcaccttatgccacaaggcccggaggcagcttctccgcagagtcgtgtgctgccatgccaggtactcatccacacgggcacgggcctgcaggtcctgagggtaccagtagtcagggaccttatatttgcgcgtcaggtagagcaggatggccacactgtgggtgtgggggtcatgatgggtaagggaagggcactgtgctgggtatttcatacatagtcgcttttttttttttttgatacggagtctcgctctgtcgctcaggctggagtgcagtggtgcgatcttggctcactgcaacctccacctcccgggttcaagtgattctcctgcctcagcctcccaagtagctggaactacaggtgcgtgccaccatgcctggctaattttttgtagttttagtagagatggggtttcaccatattagccaggatggtctcgaactcctgaccttgtgatctgcctgcctcggcctcccaaagtgctgtgattacacgtataagcaaccgcacctggccttttttttttttttttttttttttttttttggagacaaggtcttcctcagtcacccaggctggagtgcagtggtgcagtctcagctcactgcagcttcaatttttataggagtgcaccaccatgcctggctaccttttttcttttttgtagagatgggatctcactgtattgccaggctggtcttaaactcctatcctcaagcaatcctccagccttggcatcccaaagcgctggcattataggcatgaaccactgtgcccagcacacttctttaacctttctgacaatttgccaaagtattagcctcattttccagagaagaaaaccaggcttagaaaggcagagacttgccctagggcacacagctcttaatggcagagctgagaatctttctgaggctaatacccaagcttttcctaccaccaggcaaaatcccacaacagaatgtcttgccaaatgtttagagacagtttctgatcagagaaccagagagagcttccaggagaacggggcatcaaagctgagctttaaagaagctcagttctttccattcggtatccactctcatctgctgggattccgaccagcctctgatggcctgactgttcaaaaaggcttccgtgtccctttgttctttctgtcattctttctgccaagaatcagctcctatctaagctgactggggtagtttggcttcctaaagtaccactcaggaagcactcctgcagctgcaggatcctagaacaacagaacagacaaggccccctggcactctcctccttccctgggttttgagggccgccatggtgatgagatgagcatggacctggaaggacacaggatgtgtccatttggagacacagaaaagctttcaggaacttggggtttcccaaaggttgggcatgcaggccaaaagggcagaaaacctctgtatctgccacgggcctatattctcttttaagctggggctacacacgtgtcccagcttaacgactccgttgtctgtgcagggtgcccaggagctccttttgctcccagccaattgttcaagccacctctgaggagggctgcaggtctctgtgagccacagacctgaaggtgagagtagtgacagaggcagagattgcacattgactctggctggtacctgggggtcacaacgctgagtgacacaaggactcaggacacctggggcaccagggaggaagacgggccctggcagaatgtcagaggaattcatcggaggtgcgtccatcctgagatttcagagatgagctttaaagcacaaactccaggttcttgttaggggaagggtgactctggtgacaaaaggggcagaactggggaaagattggcttttcctgaagaggattcaacttcttgggaccagctgtgatgtaagacgtccatatctggtggctcttccatggggaagacccatcctgggaagctgcagcccagagatggagccaccgggcagcccagatgccactgagccatcgccacacaagcttggccagaggcctgccccacggtgggcaaagctgccatcgtcctctggcctaccctgtctcaaggatactctcaccactcaccagcaaccaaagcactggtgtggaagtaaagtagatatttgcttttctaatcatcagggtgaactggaatagcaggaaggcaagggcctggggtccagtactgactctctgcaggatgcggggcacagagactctctgcctctgaagactttagtttccttgtctatgaaatagagggttagaacaggatggttccagcaggcctggcagcagtcctagggtcccagttacctctccgtcaaggtgaagtccccgtccttcaaggctggcaccttcttgagggggttcacctgggcaaaggcatcgcttaagtgctgacctgggaagagtccagcatggtgggtggtgggaggagaacgctgagcccgccatggcctgtgcccctccctgcaatgctctggccccagtttcacagttcttcttcccaccagtctgcactcctggttggcaaagactggaagggcccctgcgggaggaggaggagaccactccaccggctggtacaaaatagacaacaccccttgctaagtcctgtaggcacagcctcctcccacaggctgcccctctgcaacagagctcactgtgcagggtgtggttcctggacctttgcatgcaccctacccatctcctctttccactattgccagcttcatgaactcacaatcagagcaccccaagctgcacgataggtcacctgaggggactgactaccttgtcccttccaccattaattctaaggcagggtcatgaaacacagagaagtggtctttttctggtatctacctacttagaagcaacttctactggccccaccatgtccctttgttcaccctgccctgggcactgtggagctgtgtgtagcatacctgctaccaccccctgtgccccaaacttttattccccttacagttggggtctcactatgttgcccaggctggtcttgaactactggcctcaagtaatcttcctacttcggcctcccaaagtgctgggattacaggtgtgagccaccatgcccagcctgctaccctctcttcaccctcccttcagactgttccttcaccaggaaaaccctcctctgtctcctgggaaaacacacttccctctgcaccactacatttgacaaccagcttggacgtcctcttgtcccccattccctttcctctactccacactctgcagaggaagtccttgcgcaggacagtgggcagtttgcagaagagattatgtggagaagtttcaggcagagggccagccatggagtgggagccctgggcagaaggcttagccaagtagagtcgccttacttgccccaccagccatacctggattctgcttccaacccctcctactaccccaccctgcactgggcctgggcctgggcctgccagctgagtcctcaagggccttggaggcatgctagagaaacaaaacagggtgtagggctcatcaagccccagggtccccctgctgcttccagcatcagcagcctggggcaacctacctccccagcaggaacaagaggcagaggacaaggtttcgggcggcagaggttgcagtgagctgtgatcctgccactgcactccagcctgggcgacagagcgagactccgtctcaaaaacaaacaaacaaataaacaaaatgccttgggccaggcacagtggctcatgcctgtaatcccagcactttgggaggctaagccggcagatcatttgatgtcaggagttcgagaacagcctgaccaaaattgtgaaatcccatctctgttaaaaatacaaaaaaattagccagacatagtggcacacatttgtaatctagctactcaggaggctgaagcaggagaattgcttgaacccgggaggtggtggttgcagtgattcgagatccgtgccactgcactgcaacaaagcaaaagcaagactctgtctcaaaaaaaaaaggacaaggacaaggtcagaggcaaaacaggaggaacagaggaaggaagggacaaagagggaccccaatgcagactggacgagtgcagagggcagggatggaaagtcacgtcctgagctgtttgctgttgcagaatctcagcagctgggccataaagaagggacttgacgctgtcccagtctctacacttggcacccttgacctctctcatcccacctttccctaggccgaggtcacacctgctttcattttgtttttttttgttttttttttttaagacggggtctcgctagattgccctgacgggagtgcagtggctattcaagggcaccatgatagtgcactgcggcctggaattcctgggctcaagcgatcctcccaccccagcctctcgagttgctgggactacaggcgtgtgcccctgcacccagctgcgcccgtttttgtcctcctgtctggcttctcttcatgatccccacccctttattcggcctcaggggaaccccgtggtctattccgtgagaccgagcagagttttggggagccccgactcttggatctccctgctggctcacctttctctgttcggtctccaaaccagaccagcaatggccccaggaagaaggtggcgctgggagaagttccctaagctatgtatgcctacctgtccccttcctgacttttcggttccccaaacccgaggctggacctacctttaatcagatccacgatgcgcagctcgaagggaatgtcgttcttcttggcaaagatgtaaacagcgcggcagggctgggacagcaggtccaggtacagctccaggcccatagtggggaccgaccgacctgaccggaaaccagagggagtcagcaaactccagtgccaggactcgggtctcggacctcagaccacgcccctgcggctacgcaccccgaccgctgtgccccattgggcggcacggacgcctgggacactctttagtccaattgcgggcggcgggcggcctgtctcagggctgggcccgcctggctcctgtgggatcagggtgggtggccaagagaccgttgtctctcagggggacgcacagagaggccccagtcccatccctttcgtgcctggctcgctcatttcacttagcataatgtcttcaaggtgcatctgtgttgaagcgtgtgtcagaatttcccaccgtccgcattttagaggaggagacagacactgaatgattatagacccagaaagtctggctccaaagtccatcctcttggctcaacactgcagagtccttggtgccagcaagtggcaaagcctcagggcttacgttcagtgttttgtggtcactcgcttcactgcagtcgcactccctggaatgtcacagccttggtcttcctgcccctgccagcacagtgccatctatcgcattccctgggtttatttcttcctttctccaggcctgtgtttctccatctttaaaatgacagggaagctagagccctccagagtccttgcaagtccacccccctggattcatctgctgagccgtaagcccaggcctgccccttgctgccatggagcctgtcaaatagtatcagggtcacatgtcattttctaaaacgaatcccactgaaagtgtgtcagccaacgcataatgttttctagagaataaggaacatttctgcaaataaagtggaagtaacaactgttttattttatttagatagagtctcactctcttgcccagggtagaatgcagtggcatgatcacagctcactacagactccaactcctgggctcaagccatcctcccatctcagcctccccaagtagctgggactacaggtgcgcacaaagacgcccagctagttaaaaaaaatttttttctgtagaggcagggtctcactatgttgcctaggctgatcctcccacctctgccacctgctgggattacagatgtgagccactacaactggccagtaataatgatttttaactggaaaaaaaattaaggaaagatgagaaattcagatttccatgttaaagttttgaaaggaggtagacactcagagaaggcaatggctgccttatcctcacctctggataactccagtcagaggcccaaggaggagctgtcaggattctggttcaaggctcagcctgtcttttaagttcaaaacctaatttggggcgggagtggtggctcattcctataaccccagcaccttgggaggctgaggccggcggatcacctgagttcaggagtttgagaccagcctggccaacttggtgaaaccccatctctgctaaaaatataaaaattatctgggcgtggtggcatgcacctgtaattccagctactcaggaggctgaggcaggagaatcgttgaactctagaggcagaggttgccgtgtgccaagactgcgccattgcactccaggctgggcgacaagagagtaactccaactaaaaaacaaaacaactaatttggtccacgtttcaggattgatcattttctttgggtctgactcacataaaccaactcacaaaggctgtatttattaatttatagaaacaagataaaagtgagagtgtgtgggttggttcgtttgtttgttttttgactttgcccctctctgtcactcaggctgaagtgcagtggtgcaatctctgctcactgcaacctctgcctcctgggttcaagcgattctcgtgcctcagccacccgggtagctgggatttcaggcatgtgccaccatgctcagctaattgtatttttagtagagacagggtttcaccatgttggccaggctggtcttgaactcctggcctcaagtgacctgccagcctcggcctctcaaagtgctgggattacaggcgtgagccaccgtgcccggcctagaaagaagagaaaagtcatttagacagaatgctcccaaccattgctcagtgctctcttggcagtgtagtctcctaggaagcctcgtgggtgttactggccaggaccaggtccgttctgcccatgcacagtaaattaatcactgtgacatgagttttgcaaaagactaaagatttattcacaagggtgccaagcaaggaggtaggataatagctctcaaatccacctccccgaaaataaggcttagggataagccttgcttccaagcaataaagcacagaccccagtcacactcaaggggagggggctatacaaggatgtgaataccagtctgcctgcctcgtgggcctacaacgcagaagggccatgcacttggtttaaaactttgttgttgctgtcttgacattcttaacaatttaaaaataagggtccccacattttcatgtgtagccagtcctgtccaaggagtccaaagaggtcatgagggtggacaggtcactgtctcctctgggcagtgatggggccactagcagttgttctgtagtctcctagcccctaccccagggccacaccttccccatggtctctcacattcttttttttttttttttttttttttttgagacagggtcctgctgttgcccaggctggagtgagtgcagtgctgcaaactcagcttactatagcctcgacctcctgggctcaaacaatccttctgcctcaccctcctgtgtagttcggatcacaggcacatgccaccatgcttggctaattttttgactttgtagagagggcatcacactttgtttcccagggtggtcttgaattcctgggctcaagtgatcctcccacctcagcctcccaaagtgctaggattataaagatgtgatccgccgccccggcctctctcacattcttggcatttaaagttaccgtcattgacaaggaacatgggtacactccaatttactcaagaaaaaaactcttttctccattgaagagatatgtggcctggctgcttcctactctagttgaggtcttctttttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagcagcagccttgcctgggagcttgttagaaatatactaacaggctcccacccccaaacccagacctactgaatcagacagagtctgtattttcataagatcctcagatgatccaaatgcgccttaaactttgaggagctttgatccagaacctgggctggaggcccctgggggccactctgttcctcacagactgcaaggtatgtttttttcttgcctcttctctctgtcctaatgtctccttctctctgtgtctgaccctgaggaccctatgacatcttcccaggggagtttccactgtcaaagagctgattctctctctcttttttttttttttgagacggagtttcgctcttgttgcccaggctggagggcaatggcgtgatctcggcttaccgcgacctctgcctcccaggttgaagcgattctcctgcctcagcctcccgagtagctgggattacaggcatgcatcaccacgcccagctaattttttgtagttttagtagagacagggtttctccatgttggtcaggctggtctcgaactcctgaactcaggtgatctgcccacctcagcctcccaaaggcatgagccaccatgccctactgccagaggcctgattctctagaatctgatgggctcttctagacagcaatctctacctgggctcttgttgaagaagccaatcagctcattggttggaggtcacatgatataaaacatggccatcttccaagccctatgtgtggacaacgagatagggacaagtaggcatatcacgttctgatacctggacccacatctgtcgctgggcccacgtctgtcctcaggcccccaggatatacttttatggggagttttcctcccttcccccaatgtggtcactcataactttacacccaacagtcaaacaggagtggaagctacagagtttcacgcaaacaataggctaggctgtgggactgagtaaaaggcactggactgtggtaggtcttactccaagatggccaaatggaagggcttttagctttctttgtttttgttttatatcctgagacaaaatgttcaatttctacactttagaataaaaagagccatattttatgtttcatattttttgtatgcttcctttcatactcttttgaacaatgcaatcatattttcattatgaggtataattcacataccataatatccgctctttcaaaatatactttaaaattcaattggtttaaagccaattcattggtttttagtatattaacaaagttttgtcaccatcacaattatctaattctagatcattttcatcacccctaaaagaaactctgtacccattaaacagtcactccccatttccctcttctcctagcccctggtaaccattcatctactttctacctctgtggacagtaagtatctgcctattctggacatttcattcaaatttaataatgaaatatgtgagcttttatgactggcttctttcatttaacataatggtgtcaaggttcattcatggtgtagcatataacagtacttcatcccttcctgtggctgaattatattccattttatgtatacaccacattctgtttatccattcaccagttgatggacttttgcattgattctacttttcagctattgtgaatccccatgctgtgatgaacattcacgtacaagtttttgtctggacatatgtcttcagttgtcttgggtatacacctaggaatggaattgctggataatataattctatgttggccgggcacggtggcacatgcctgtaatcccagcactttggaaggctgaggtgggtggatcacctgaggtcaggagttcgagaccagcctggccaacatggcgaaaccccgtctctactaaaaatacaaaaactagctgggcatggtggtgcctgcctgtaattccagcctgtaattccagttactcaggaggctgaggcaggagaattgcttgaaaccaggagacggaggttgcagtgagccgagatggcaccactgcactctagcgtgggtgacagagcaagaatctgtctccaaaaaaaaaaaaaacaaaaaaaacaaaacaaaactaacccatatatatataatatgttatatatacataataatatattttatatatatgtgtatatatgtttaacttttggaggaactgcaagctgttttccaaagcggttatacattttacattctcagcagcagcacacaagggtttcaatttcttcacacatcctcaacaatacttttaatctgtcttttctgttatacccctcatagagtgtgtgaagtgatatctcattgtggtttgattggcaatgtcttgattatagtatctttgtactaagttttgaaattgggaagcatgagtcctacagctttttctttttcaaaattattttgaagattctgagtcactttaatttccaaatgaattttagggccaatttgtcagtttgtgcaaacaggccaagtggaattttaatgcagactgtgttgaatttgacatcttaacattactacaccttccaatcatgaacatgggatgtctttccatttattaaggtcttctttaagttttcccccaacttttaaattatgaaaacatttaaaatccagaaaatgaaaggactagtacaacagcactaatatatgcaaccccagtttcaacttactgttttttgaacataagataccaacatcatgacaccccacctaaggactttttagcaaaacattctaatttctctactgggattattgtttgttgtcttcctccacaataatgtgagcactaaaggtagagacttttgcgtactttgttcactactgcttcctctgcaccaaaaacactgcctggttgtgggtacttttctagttttaggaaggagaagacaagatataggtcctgactctggttctgcctctcattcatatgctactccgaggatcccttccccttgaagaacttgtttcttcatctacgaaatggggataatactactactcatcagggtggttgtgaggattaaacaaggtaagagatgtaaaattgcatgttagttatcagatagttttgttttcccatctagctccatgagggagaggatttgctctagtccgtccgtctgggctctgggcttctaatgggcagacaccttcctccatgatgtttgtagctgcaaagcctggcacagtccctcaagacaagctttttgacttgaactgctgatggtcttccatgcacaattcaacagaaacccagtagcatacacttccttgtatgcacttgcccctctttttacatttattacacattcattgctacctaataatccccgatacttatcttttactttatccaattattcaacagttttcaacagaaatacctagaagagagctattccgacttcattagaccctgagattctatttttaacatttcttccatggattgttgaatgtttccaatgattgatccaccttcccttggccttatctgcattccagatttggttgtgtgtccatctctgtgttgccagacttacctcacagacccagcttgaacacaagatgggtgcttgctgaagagcaggactcattctgttgaacctgcatgctttctcaggtcagattgcttggtggtgcttctttaatttctttcaacagcacattgtagtttgctgtgtttaagtgttgcttttctttggttaaagttattctaagtattttattctttttgatgctattgtaaatgaaagtgttgttttaattttgtttttgatcctttactgcaaatgtatactattgatttttgtgtattaatcttgtatcctgcaaccttgctgaacttgcttatgagctctaatggtttttaagtgagttccttaggagttcctataatgtcatctgtgactaaagatagttttacttctttctttccgatctggattccaccttgttcctttttcttgcctaattgccctaataaatagaagtagtatgaatgaacattcttgtcctgctcttgatcttgaggggaaacactcaatctttcacaaggaatgaagtatggtgtttataggtttttcatagatgctctttgtcaggctgaggaagttcctttctagtcttcatctgttgagtaattttatcataaaaggatgttagattttgtcaaatgccttctctgcattaggatgatcatgtgactttctattaatatgaagtgctatatggattggtttttgtacattgaaccacatttgtactcctgggataaatcctacctggtcaatgtgtataatcctcttaatatgctgctgaatttgatttgctaatattttgctgaggatatttacatctatatttataaggatattgctttgtaactttattttcttataatgtgtttttctgtctttggtatcagggtaatgctggcctcatagaatgagttgaaaaatatttcttcctgttctattttttagaagagtttttgaagggttggtgtcaattcttcaagcttttggttgaattcaccagtgaagctatctggtcctggacttttctttgtagggatttcatttattgatttattgatttattttttgagacggagtctcgctctgtcacccaggctggagtgcagtggtgcgatctcggctcactgcaagctccgccttcctggttcacaccattctcctgcctcagcctcccgagtagctgggactacaggtgcccaccaccacgccccatctaatttttttgtatttttagtagagatggggtttcactgcattagccaggatggtcttgatctcctgacctcgtgatccgcccacctcagcctcccaaagtgctgggattacaggcatgagccaccgcgcccggctttttggtaggattttaaaaaaattaatattttaatatctttacttttacaggtctattcaaattttatcttccttcttaagtccgttttggtagattgcatgtttctaaaattttctcatttcatcgaggttatctcatttgttcacatacaattattcatagtatttctttataaacctttgtacttctctaataccagtagtgatgtgtccattttctttctttctggtgtctggttttttggtttttgttttttttgtttttttttttgatataaggttttcctatgttacccagactagagtgcagtggtgcaatcacagctcaatgtaaccttgaattcctgggctaaagtgatcctcccaccttagccacccaatttgctaggactacaggcgcgcaccaacacactcagctaattttttctttcttttttttttttgagacgaaattttgctcttgtcacccagggtggagtgcagcagtgtgatcttggctcactgcaactctgcttcttgggttcaagcgattctcctgcctcagcctcccgagtagctgggattacaggcgcctgccaccatgcccagctagttttttatttttactagagatggtgtttcaccatgttggccaggctggtctgaaactcctgatatcaggtgatccgcccgtctcagcctcccaaagtgctgggattacaggcatgaaccactgggccttgcctcctagctaattaaaaaaaataaataactctttttgtagaaacaagtctcactatgttgcccaggctggtctcaatctcttggcctcaaatgatcctcctgcctcggcctcccaaagtcctgggattacaggtgtgagccattgcacccatcctccactttcttggtgaataatttgagtcttattttttcacttggccattctaactaaaggtttgccaagttttgttgatcttttcaaagatccaatttttggtttctttgattttctctattgtttttctgttttccatttcatttatctccattctaatctttattatttcctgtcttctattggtgttgggtttattttgctcttatttttctagttccttaaggtgtaaagttaggttattgattgaagattgttcttctttaacttaggtgtttacagctataaattttgctcttagcactgcttctgctgcatcctataaatttgggcatgttgtgttttcatttttattcattcaagatactttttaatttcccttgtggttttgtctttgacccattggttgtttaagagtgtgccgtttaatttctatgtgcttgtgagttttctagttttccttttgttcttgattttaaactttattccactgtgtccagagaacaccctttgtatgatttcaatcttcttaaatttgagacttaggaccaaatatatgctctatactggagaatattccatgtgctctttagaagaatgcttattctgctcctgtcgggtagaacgttctgttcatgtctagtgtgtgcaattggtttacagtgcttttcaagtcctctatttccttgatggtcttctgcagtttttctattactgaaagtgggggccaggtgtggtggctcacgccccgaatccctttggggattcagggtggctcagcactttgggaggctgaggcgggcgatttgcctgagctcaggagttcgagaccagcctgggcaatacaatgaaaccctgtctctactaaaatacagaaaaaaattagctgggcatggcggcatgtgcctgtaatcccagctactcaggaggctgaggcaggaggattgcttgaacctgggaggtggatgttgcagtgagctgagatcgcaccactgcactccagcctgagtgacagagtgagactccatctcaaaaaaaaaaaaaaaaaaaaaaaaaagtcaggtattgaagtcaccaactattattactgacaacgtaatcatatttaaccctttacttttaaaattctttttggaaactggaaggatctgtaaccaccacccacttccacatcagaccctatgcatacgccaactgtctgttgctcagcagctgtgatgttgttccagttctttattaggcaaagaacagttgtttttttagcatttcctttaaggaaggtggctcagatcattgagccagccaggccctgcaggatgggctgcgattagggtcacaagtacttctcccgaaactcacagattttcctcgtgaccattggatccaatgttgaaaagtcccagtcggccaactgcattagtcgatcatgggcctccctaaagaggccacagccaatattcagctccacccgcatacgccactcagctagcttggagctgttgaggaagacattatagttggctgccatgggctgtggatagacaaagacgaagatgtggtcagcctggggaccagccccacctgggtcctctcccacagcctctggcccacgtccctaacatctacctatggaaagaattaggctgctgacccccaaggcctgagcaaggggtcacagactatgtaatagatgtaggtggggatggaggatccagaatccctcagagtcctcagtcactggtcttcttgctccaagccttctgaaccacactgagagggctcctggcccaggcagctcccacttctccagcctgcgacctcgcatgaatcctgccttcttccagggaaaccccttatcccaggtgtgtatatgcggatgagggagagaactcaggttttttcctccatgtttagactcccactatgatcaagctcaggggctaagatgggagacctggcgggcagtctaccctgcagtttcgctggctcactaagacagtctaccctgtagttccgtttgcacccaagatctttgggaagccaaagaaggggtgggtcgttggtgaaatgtaaggggtggggacgaagtatatggctgaacccttggggcaggccagaatgatttttcctggtgctggtctgccctgcaaacagaccaaagagactaattttcgtatcaaccagagatctctgcaatagggaaaagaacactgtatttcctggtcaatccaccaggatcccaggtgcctcctcctggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttccttccctgttatctttgggatcagcaactggccagggttgggaagaggagggaagaggaggctgtactccagggccacctgccctgccaggtctctgtactcttgtctgctggatagatattgaacacttcccaggatataaagcagtttcacctcttttagcagttctgattggtggaaggtgccgggaaccatgcgttcacaaggatttggggagctcagcaggcataagtcctgtgattgattagtgatgccggtcacaggcatggaatttgaagtagagacacgtgtactggttatttgtcatcttccaattttcttttttcttctttttttttttttttttttttttttgagacggagtctcactctgttgcccatgctggagtgcagtggcgggatcttacctcactgcaacctccgcctgctgggttcaagaaattctcctgcctcagcctttggagtagcgtggattacaggcacatgccagcatgcctgggtaacttttatatttttagtagagatggggtttcaccctgttggccaggctgttattgaagtcctgaccttgtgatccgcccacctcggcctcccaaagtgctgggattacaggcatgagccactgtgcccggccatcttcaaattttctatgagccatttttttttttttttttgagatggaatctcactttgtcacccaggctggagtgcagtggcatgatctcggctcactgcaacatccacttccctggtttaagcgattctcctgcctcagcctcctgagcagctgggattacaggtgcccaccaccacaccagctaattttttttgtatttttagtacagacagtgtttcacaatgttggacaggtaggtcttgaactcctgacctcaagtgatccacctgcctcggcctcccaaagtattgggattacaggcgtgagcactgctcctggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcgggtctggcgggcaccagtgcgatggtgcgctgtacttgcggcacaggtagtaaaggatggccgcgctgcagaaggggccggtcaggggcactgcccttgccttcctgagtgccactacatcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacggagggtagcccctggaggtgcagggaggttatggacttaatgcttaagattaggcattatataagccagggcatgaaaggatccatctctctggtgctggatggagggtgagcccgagggggcagaatggacaatgagggggccagcaactatcgggaaggttgtggtgtctgggaatgttggaggccatggggacagagggaaggggatggaggggagacatgcttcggaggggatgtcctaggccttgctgattgatggctggtgtgggaacctccgcagcacaagggctcctttatcatcaccagcagcaaccatgccaaggtaaaaaggtcagggcatggagagagctatcggttaaaaagtggcaggagagacagcaactggctgcaagactcagaacttcttggctgggcacggtggctcacgcctgtaatcccagcactctgggaggccgaggcggggggatcatggggtcaggagatcgagaccatcctggttaacacagtgaaaccccgtctctactaaaaatacaaaaaaattagccaggcatggtggcgggcacctgtagtcccagctactcaggaggctgaggcaggagaatggcgtgaacccgggaggcggagcttgcagtgagccaagatagcgccactgcactccagcctgggcaacagagcgagactccgtctcaaaaaaaaaaaaaaaaaaaaacttctttggatcctgatccaaacaaactgccaagaaaatgtttaggagataatcatagagttttgaacaggagccacatattagatgaaatccaggaattattgttaattttatgaggtatcttaatggtatcgtagtgatgctacgctctatcctagcccaggctggagtgcagtggcgcaatcagagttcactgcagttctgaacttcctggcctcaagcgatcctcccgtgtcagcctctggaagtgctcggattataggcatgagccaccacacccagcctgttgctttttttttgtttgttttaagaactcttatctctgaaaagtatgttcctaaacatttattgatttatttacttatttatttttatttttgagatgggatctcactctgttgcccacgctgaagtgcaacgacgcagtcttggctcactgcatcctctgcctcctggctcaagcagtctttccgcctcagcctcccgagtagctgggactacaggtgcagaccaccatgctggctaatttttgtattttttgtagagatggggttttgccatgttgtctaggctaggctggtcttgaacacgtgagctcaggccatcccctcacttcagcctctcaaagtgctagaattacaggcatgagctggcttctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgcttgcactgaacctcccaggagaagcagagacagatggtgcaagggccccagggaagacttacctttcacttaagataaatttcccatctttgaggctgggcagcttcctgagggggttgatgtcaatgtatcctttgctgtggtggtgacctgggaggggcagggaaggtctgaggctgtgggactccaggggagagagaactgagactcccagagacccaaacgcctccctctctattttctcaagaagagggaactgaggcccggagggacattgcgtctcaccccaggtcacagggcaaggcagttgcagaaccggactgcgatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagcttttggagtccctctgtgctggggatggagttggagcccacccctctgaccctcactcagggttagtggagccctgagcctttctgaacactggggaggatgggtgtagacggactgtgcacttctgccccctttgccaacctggtgggcaggtgctgagttcacaaggtcctagaatcccacaaggaagccagggtgcctggtgggagcccagggagtcccagctactgttccttcccccttctcctcgaaaagcctgttcatctgtggcgtggggactgtcattagtgagcactgactaaggtaggctggacaaggatgcagcctacaagccgcgtggcatcttttccttccctgtggacctctggggtgattcccttgtctctgtctctgctcctcagaaacgcccctatcaggctgtgcgcggtggctcacgcctgtaatcccagcactctggaggctgaggtgggcagatcacttgaggtcaggagtttgagaccagcctggccaacatggtgaaacccctgttaaaaatacaaaaaattagctgggcgtggtggcatgcacctctaatcccagctactcgggaggctgaggcaggagacgcacttgaacccagcagaggttgcagtgagccgagatagcaccaccgtactccatgctgggcaacagagcgagactccatcaaaaaacaagaaaaaaagaaaagccgcaatctgtgtgtcctgcctccccccaggaccaggcctgccaggcagcagtgggagttgacctttcagcagatccacaaactgaaagttgaactggatgtcatgcttcttcgagaagatgtagacggcacggcagggtgctgacagcaggtccatgtagagctccagtgccatgttgagacacatgccaggccccacagccgcagttggccagccacagacctgggcctatgtctggccagagtccctggccctgtgccctctccgatctgggcccaggatcctgtgttccccagggaaacctcttgtttccctttgtgttgtcataaggccaggaagcctgcaattctcacagcatcaaggattctaaggaggcccaggagtaggctggggagaggcccgtggcaaaggtgtggcagccgtgaccctactctcccccttccacgtgtgcctgtgccccgtggtgccacctcacagacaccagtctgagaagggattatgcctgggaattcccacggctggattttcattgcagaacctgacgaaaggggctttgcagggtccagaatgaagaggaggcaatgagaattatccctggaggattctagaagtagaggctgggagtatccacaggtaaatcgagcctgaactatgactagaaaggaattgggagaaagagacacaggtgaatcgagcctgaactatgactagaaaggaactgggagaaagagacacaggaaactgtgagctttgggagcaatggggacaccaccaccaggaagtcagggggcactcagccggtgtgtgccacacagaggagcctagaaacttcctggccttggttggggctgcagtggccagactgtgtacctggtggccaaggaaggtaactagagccccacgtagaggactgagtgccactcactctatgctgtgatctaataggtctaggctgagaaatgggactgaccccacttctggtgacagagtaagcctggagacaagcgaagagcatgcagtgtgtttattgcagacagcagggtgcagtggagtgggctgcacccactgcacctgcttctgggccagctgggggtcccgccaagcctcactgtggttcagaggctggagtatgagcttgtgggcctccagcaagagctcagtaccaagggcagccgccacacgggcctgccacactgccagccggggcagtcttggaagaggtcgcagccaacggcagtgggctgggaagacagggcagctggggttggggctcagccccatgcccagagtccccccagagggcaggtgggtaggaaagcttcacctgcatcacctccgtcagcaccaagtcttccagggagatctgctccattgccaggaagggcctggccaccagcaccccccaatccaggtgctgcagggctggcatcagcctccccaacagccgctccagctgtgcagcatctgcaggctgtccggagaagtggggcaggagagactgggctgggaggagaggagcaacttaacccagactcttggaagcctcttgggcctcctctccatcccttcccggctgccactcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtgccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatccgggtgacctacgtcctttccccacctgggcagctccagctggctcagactctagccaggttccagcctccagctttagcccaaaggtgcccctgggtccagcctctgcatcggagctacacaggctgaaatgaggaaggggcctcagtgatttggaaagatctccaagccaaggaaagatctcccctctcgcctctgcctccccctacaactctgagccccagaacccaggcagatcctggctctgaccctgggtgggcaccaggtcaccattacctctttgctagtaggaagtcgccatctctgagggcaggcaccttccccagggggttcaccttcaggaactcaggcttcaggtgctcccttggtgggcagaaaggcgagaaggctcagtgtagggcctggtccttggcacccactccatggggcccagcccagccacctggctcaccccaagccaactccaccatccacagctcaaaagggatgtcattctgtcttgcaaaagtggatagtgtgtcaggtccaggaagagctcaagccccattgctgctcctctcacctgccctccccagaattctggacctccaggagttgctcagcccttctccactagttctgagctgtttcctgtccatagtctgctgtagtgggccagagcacagggcagatttgtcttcagggactttctctgggcattcctgggcagagaacttcatcttctctgttaactcttgctgataattctctgtagctaggcaccttgtaaaacccatgtcccagaatgccaaacctggaaatgcaatgtcagcgccgaaactgcattgaaactgaatgaatgaggtccccaccctcttatctaaatatcctatcagtctgttgaatgtcaaagtatgtaggggtggtgtgggggagcctatagggagtctccatttctgtagctttccacatgttccatgcagaattttcctctaatgacccttggacaccgtggtggtcactgtttccctgcataaacctttgatgatccttatctttagcgtaccagtgaaacaccaaattcagattttcagtctgtgcagtctatgtagttaataaaatcaatttctaatggaatatgcctgtgcctggtgtgtttgtacctaaccactgctaaggactttcattgatagctagaccttggagttccttcccctggacccctgacccaagtattttgcactcattcctctgccagtgtgtttcatggtgtcctgcttcccagagtgcctcagggaatgcttgcattggatataaatgaatcgttgcggtcaccatggatgggattcaggcctaactctcaccaagaccataaggccacagtctttgatatagattccccatgttaaatctgccatcctcagtgtagtgagagtgatattgagagagaaaagttaggtaattaaggtgggtccttggtaaaactcctttaaacagaggaacagcctgaaaaatcaggcttcaggcacagataaggaaacttgcacaaacctctggctcactcagataaaggaacaatgcccaacacagaaacacctttgatctttgtgcctaaggcatgcccacagctactttgataagggaacaagacccagcatagaaatgcctttgtcctttgtataaccagtgggcttccaggaaatagtctcttctccttttgtggacatgtacacggtgggctacagtgggttccagtgggcactttcctttcttggacgtgctttagaatgtgagcctctgattggtcctgggccaggctatcacttcagctcctgattggtccctcaaggtccaggggccaagctgagtagtgctttctccaagaccagtcagtacattccttcctttcccagtccataaaaccccctgacccagcctcataatgggcaacctgcttgggccccccgccagctgcaatgagctttcttcatttgcttattaaacttttgcttcaaccttaccctttgtgtccacactccctaattttcttggtcgtgagacaaagaattctgggtgataccccacaatgagagactggtacattgtggtgcacgggcaagactgcaacaatatgttttctgcttgcttgtttggactggcctcttcctaactctccagagtgctctctccccactgtggccctgagctttgcctcacggtaacactgtgctgcatgacactccagcatgatctgcatgtttctcacctccggaccttccccacacaactttcttgctgcttggaccacccttcccacctattttcaactgtttctctccagcgcatctttcatgataaggcttgagtggaagctgtatccgaggctgaaggttatccatgcagctttgaaaccatctgtttatgcttctgtttaccccccaaatactgtttaccccaatactcaaagtcaaggttggtgactcaacaattttcagaacttctagcttatcagtatagctttattgtactgaactgagtttttcaccatgctgttactgtctttgaggttaaaaagcccccaacattcactcctatttgaatcatctgtgcaagactcaagcagctatgaattcaaccacagtgtaaagttcttccctacaatgctttattgttattctagctcccaagagagtaccatctttcagcccaagacccttgacagaaccccttcaactctgtcgccttttttcatctctggaattctgacaccacccatgacccctcttcttgttcatttactaggttttgttcctt

SEQ ID NO: 431 - DNA, 71967 bp, Homo sapiens
acacatttaatgctacctaataattccctatacttttactttatccaatcgttcaacagattccaaccgaaatacatagaagagtgatattccaacttcatcagaccctgagattctatttttaacatttcttccatggattgttgaatgtttccaatgattgatccaccttcccttggccttttctacattacagatttggtggcatgtccatgtctatgttgccaaacttgcctcatagacccagcttgaacacaagatgggtgcttgctgaagagcaggactcattctgttgaacctgcatgttttctcaggtcagattgcttggtggcgcttctttaatttctttcaacagcacattgtagtttgctgtgttgaaatgttgcttttctttggttaaatttattctattttattctttttgatggtattataaatggaagtgtggttttaattttgtttttcatcctttattgcaaatgtatactattgatttttgtgtattaatcttgtaccctgcaaccttgctgaacttattttattttattgagatggagtctcagtcagtcacccaggctggagtgcagtggcttgatcttggcacactgcaacctccacctcctgggctctggtgattctcctgcctttgcctcctgagtagctgggactacaggcatgcgccaccacgcccggctaatttttgtatttttagtagagacggggtttcaccatattggacaggctggtctcaaacttctgacctcatgatctgcccgccttggcctcccaaagtgctgggattacaggtgtgagccaccgtgcccagccttgaacttgtttattagctctaatggtttttaagtgagttaagaatttctgtaatgtcatctgtgaatagagatggttttacttctttctttctgatctagattccaccttgttcctttttcttgcctaattgccctaataagtagaagtagtgtgaatgaacattcttgtcctgttcctgatcttaggggggaaacgcttgatctttcacaatggatgaagtatggtgttagttataggtttttcatagatgctttttgtcaagttgaggaagttcctttctcgtcttcatctgctgagtaattttatcgtaaaaggatgttaggttttgtcaaatgccttctgtgcattaggatgatcatgtgactttctattaacatggtatgctacactgattgatttttgtatgttgaactgcatttgtactcctgggataaatcctacctggtcaaggtgtatgatccttttaatatgctgctggatttgatttgctaatattttgctgaggatttttacatctatatttataaggatattgctttgtaactttattttcttgtaatgtctttttctgtctttggtatcagagtaattctggcctcatagtatgagttgaaaaatatttcttcctgttttatttttttggaagagtttgtgaaggctttgtgttagttcttcaagcttttggttgaattcaccagggaagccatctggtcctgggcttttctttgtggaatttttaaaaataattaatattttaatctctttatttgttacaggcctattaaaattttatctttcttcttaagtcagttttggtagattgtgtgtttctaaaattttcccatttcatctaggttgtctaaattgtccacatatagttattcatagtatttctaaacttttgaatttctctatgaccaatgtgatgtctccattttctttctttctggtttccatttcattttttcatttttgtttttgtttgttttttgagataaggttcttctatgtgcccaggctggagtgcagtggtgcaatcatagctcggtgtaaccttgaactcttggactcgagtgatcctcccacctcggccacccagttagctaagactacaggcttgcaccaccacaccaagctaatttttttaaaaaatatattttttagaaaaaagtctcattgtgttacccaggctgttatcaatctcctggcctcaagtgatccttctgcctctgctttccaaagtgctgggattgcaggtgtgagccattgcacccagcctccactttctttcttggtgaataatttgacccttatttttttcacttggctattctaagtaaaggtttgccaattttgttgatctttgcaaagatccaatttttggttttattgattttattgcttttctattttctatttcatttatctccattctaatctttattatttcctgttttctagtggtgttgggttgagtttgctcttatttttctagttccttaaggtgtaaagttaggttattgattcaagatcattcttctttaacttatgtgtttacagctataaattttgctcttagaactgcttctgctgcatcctataaatctgggcatgttgtgttttcatttttatttgttcaggatactttttgatgtcccttgtgatttcttctttaacccatttgttgtttaagagtgtgctgtttaatttctatgtgcttgtgagttttctagttttccttctgttcttgatttttaactttattccactgtgtccagagaacatactttgtgtgatttcaatcatcttaaatttgagacttaggaccaaatatatgctctatactggagaatattccatgtgctctttagaagaatgcttattctgctcctgtcgggtggaacgttctgttcatgtctagtgtatgcgattggttaatcgtgcttttcaaattccctatttccttgatggtcttctgtagtttttctattactgaaagtggggtattgaagtcaccaactattattactcacaatgtaaccatatttaaccctttacttttaaaattctttttggaaactggaaggatctgtaaccaccacccactcccacatcagaccctatgcatatgccaactgtctgctgctcagcagctgtgatggttgttccagttctttattaggcaaagaacagttgtttttttgtttttttgtttttttttttttaacatttcctttaaggaaggtggctcagattgctaagccagccaggccctgcgggacaggctgcgcctagggtcacctgctcttcttcagcaactcagaaatattctccttgaccattgaatccaatgttgaaaagtcccagtcggccaactgcattagtcgatcatgggcctccctaaagaggccagagccaatattcagctccacctgcatacgccactcagctagcttggagctgttgaggaagacattatagttggctgccatgggctgtagatagacgaagacaaagacgtggtcagcctggggaccagccccacctgggtcctctcccacagcctcaggcccacgtccctaacatctacctatgcaaagaattaggctgctgacccccaaggcctgagcaaggggtcacagactatgtaatagatgtaggtggggatggaggatccagaatccctcagagtcctcagtcactggtcttcttgctccaagccttctgaaccatgctgagagggctcctggcccaggcacttcccacttctccagcctgcgacctcgcatgaatcctgccttcttccagggaaaccccttatcccaggtgtgtatatgtggatgagggagagaactcaggttttttcctccatgtttagcctcccactgtgatcaagctcaggggctaggatgggagacctggcgggcagtctaccctgcagtttcgctggcttactaagagtttggtttgcacccaagatctttgggaagcccaagaatgggtgtgtgtgggtgaaatgtaaggggtggggacgaagcatatggctgaacccttggggcaggccagaatgatttttcctggtgctggtctgccctgcaaacagaccaaggagactaattttcatatcagccagagatctctgggataaggaaaagaatactgcattttctggtcaatccaccaggaccccaggtccctcctctcgggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttcctcccctgttatctttgggatcagcaactggccagggttgggaagaggagggaagaggaggctgcactccagggccacctgccctgccaggtctctgtactcttgtctgctggatagatattgaacacttcccaggatataaagcagtttcacctcttttagcagttctgattggtggaagttgctgggaaccatgtgttcacaaggatttggggagctcagcaggcataagtcctgtgattgattagtgatgtctgtcacaggcatagaattcaaagtagagacacatgtactggttatttgtcatcttctaattttctataggccatactcttttttgtttttgttttttgagatggagtctcactctgtcgcccaggctggagtgcagtggcacaatcttggctcactgccaactccaactcctgggttcaagcaattgtcctgcctcagcgtcctgagtagctgggattacaggtgcccatcaccacacccagctaataattttgtatttttagtagagatggtgtttcacaatgttggcaaggtaggtcttgaactcctgacctcaagtgatctgcccgcctcggcctcccaaagtactgggattacagttgtgagccaccgtacccggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcaggtctggcgggcaccagtgcgatggtgcgctgtacttgcggcacaggtagtaaaggatggccgcgctgcagaaggggccggtcaggggcactgcccttgccttcctgagtgccactacgtcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacgtagggtagcccctggaggtgcagggaggttatggacttaatgcttaagattaggcattatataagccagggcatgaaaggatccatctctctggtgctggatggagggtgagcccgagggggcagaatggacaatgaggtggcgggccagcaactatcgggaaggttgtggtgtctggggatggtggaggccatggggacagagggaaggggacggaggggagacatgcttcggaggggatgtcctaggccttgctgattgatggctggtgtgggaacctccgcagcacaagggctcctttatcatcaccaacagcaaccatgccaaggtaaaaaggtcagggcatggagagagctatcggttaaaaagtggcaggagagacagcaactggctgcaagactcagaacttctttggatcctgatccaaacaaactgccaagaaaatatttaggagataatcagagagttttgaacaggagccacgtattagatgaaatccaggaattactgttaattttatgaggtatcttaatggtatcgtagtgatgctacgctctatcctagcccaggctggagtgcagtggcacaatcagagttcactgcagtcgtgaactcctggcctcaagcgatcctcccgtgtcagcctctcaaagtgctgggattacaggcatgagccaccgcgcccagcctgttgctttttttttttttttttttttttttttaaagaacgcttatctctaagaggtatgttcctgaacgtttattgatttatttacttacttatttttatttttgagatggggtctcactctgttgcccaggctgaagctcaatctttgctcactgcaacctctgcctcccgggctccagcaatccctccacctcagcctcctgagtagctgggactacaggtgcggaccaccatgctggctaacttttgtattttttgtagagatgggggttttgccatgttgtctaggctaggctggtcttgaacacgtgagctcaggccatcccctcacttcagcctctcaaagtgctagaattacaggcatgagctggcccctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgctcgcactgaacctcccaggaggagcagagacagatggtgcaagggccccagggaagacttacctttcacttaagataaatttcccatctttgaggctgggaagcttcctgagggggttgatgtcaatgtattctttgctgtggtggtgacctgggaggagcagggaaggtctgaggctgtgggactccaggggagagagaactgagactcccagagacacaaacgcctccctctctattttctcaagaagagaggactgaggcccggagggacatggcggctcaccccaggtcacagggcaaggcagttgcagaaccggactgggatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagttttggagtccctctgtgctcgggatggagttggagcccacccctctgaccctcactcgggagcagtggagccctgagcctttctgaacactggggaggatgggtgtagacggactgtgcacttctgccccctttgccaacctggtgggcaggtgctgagttcacaaggtcctagaatcccacaacgaagccagggtgcctggtgggagcccagggagtcccagctgctgttcattcccccttctcctcaaaaagcctgttcatctgtggcgtggggactatcattagtggggagtggctaaggtaggctaggcagggacgcagcctacaagccccgtggcatcttttccttccctgtggacctctggggtgattcccttgtctctgtccctgcttctcagaaatgcccctatcaatctgagcgtggtggctcacgcctgtaatcccagcactttggaggctgaggcggggcagatcacttttggtcaggggttcgagaccagcctggccaacatggtgaaactccatctcgactaaaaatacaaaaaatgagccgggcatggtggcgtttgcctataaacccagcaactcgggaggctgagctgggagaatcacttgaacccagtggagattgcagtgagccaagatagcaccactgcactccagcctgggtgacaaagtgaggctctaccaaaaagaaaaagaaaaaaaaagctccaatctgtgtgtcctgcctccccccaggaccaggcctgccaggcagcagtgggagctgacctttcagcagatccacaaactgaaagttgaactggatgtcatgcttcttcgagaagatgtagacggcacggcagggtgctgacagcaggtccatgtagagctccagggccatgttgagacacatgccaggccccacagctgcagctggccagccacagacctgggcctatgtctggccagagtccctggccctgtgccctctccgatctgggcccaggaccctgcattctggaacctcttgtttccctttgtgttgtcataaggccaggaagcctgcaattctcacagcatcaaggattctaaggaggcccaggagtaggctggcagaggcccgtggcaaaggtgtggcagccgtgaccctactctccccctctcacgtgtgtctgtgtcccgtggcgccacctcacagacaccctgtctgagaagggattatgcctgggaattcccagggccggactttgattgcagaacctgacgaaaggggctttgcagggtccagaatgaggaggaggcaatgagaattatccctggaggattctagaagtagaggctgggagcatccacaggtgaatggagcctgaactatgactagaaaggaattgggagaaagagacacaggaacctgggagcttcgggagcagtggggacaccaccaccaggaagtcagggggcactcggcaatgaaagtggcagatgcaataaaacttttaacatattgttgtataatgtacaataatgtaataaaaatacaccccctatacattattgttccaactctagctctatctattgccctcctcatatgaatccctctccccataccccattctctagttaatcttaactaggcctcctgtttatattagccacatcaagcctagctgtctactctatcctgtgatcaggatgagcatctaatttgaaatatgcactcatcggtgcactatgtacagtggcccaaacagtctcatatgaagtcactctagctattatcctcctatcagtcctattaataagtggttcatttaatttgtatatactcattggaacagaagaatttctctggctgctcctaccatcatgacctctggccataatatgacttatttccacactagcagaaaccagccgagcctctttagacctaacagagggggaatcagaattaatctcgggctttaacgtcgaatatgctgcaggcccatttgccctgttctttatagcagactatataaatatcattataataaatgccctgaaggccgcaagaggttcgtgggtgcagtgcacaggagaccatatctggggacagcagctgcagcagaccccaagctgggccatccctgccacttgccaggtggtgcttggcgaaggcaagcagctcccacccgcccggggaatacagcgcgacccccggcggcatgctcttcagcaccaccccaggaggtaccaggatcatctaccactggaaattcctgatggagtgttgaaacttacccgtgaccaaaacactcccaagggatctgcccaccattcccggggtcaccagccctgccagtgatgatccccccaacggaagccagccagagccacctgagcaatagtccagaagataagcagggcgggcagtgaagaagcacagttttgagatggacatttaaagcaccagccatcgcatggagcactgccaagggacccctcaggcccttcctggaggagtcccaccagccaggccttatgaaagtgatcatactaggcaggcattggtgtggggccagtcaccccagccctctctccctcactcgcggcacctgccccctcctctttgtgaacaccagcaggtacctccttgtgcctccgctgatgcaggagcagctgccccaaggggagtaacccctgccagcacaccctgcagctgagggccaggaagtggacaagaatgaaccctttcttccaaatgatcagctcttccagcccctgctgggggccccacgaccccttccttaggttgacgtgcctgggaaagctcacctccccctcttccctaagagaggaaataaaagccaccttcgccctagggcaaaaaataaataaataataaatcccgtaatcactattgtcttcctaggagcactgcataacatatatataccagaactctataccacaaatttcgtcacccaaactctcattttaacaagtctttttttatgaattcgaacatcatattcctgattccattatgatcagctcatatatctccttgaaaaaattttctaccactcacactagtactttcatatgacatatcttcatgccagtcctaacctccagcatcccaccccaaacataagaaatatgtctcacaaaagagttactttgatagaataaattacagaggtttaaacccttttgtttctagaattacaggaattgaacctacccatgagaatccaaaattctccgtgctacataatacaccacatcctatcacaccccacagtaaggacagctaagtaagctattgggcccataccctgaaaatgttggttatacccttcctatactaattaatcctccagtgtatgccatgcagaggagcccagaaacttcctggcctgggttggggctgcagtggccagactgtgcacctggtggcccaggaaggtaactagagccccacgtagaggactgagtgccactcactctatgctttgtgatttaataggtctaggctcagaaatgggactgatcccacttccagtgacagagtaagcctggagacaagcgaagagcatgcagtgtgtttattgcagacagcagggtgcagtgcagtgggctgtacccactcagtggagccactcctgcagcaactgcacctgcttctgggccagctgggggtcctgccgagcctcactgtggttcagaggctggagtatgagcttgtgggcctccaggaagagctcagtaccaagggcagccttcatatgggcctgtcacactgccagccagggccagtcttggaagaggtcgcagccaacggcagtgggctgggaagacagggcagctggggttggggctcagccccatgcccagagtccccccgagggcaggtgggtaggaaagcttcacctgcatcacctccgtcagcaccaagtcttccagggagatctgctccattgccaggaagggcctggccaccaggacccccccatccaggtgctgcagggctggcgtcagcctccccaacagccgctccagctgtgcagcatctgcaggctgtctggagaagtggggcaggagagactgggctgtgaggagaggagcaacttaacccagactcttggaagcctcttgggcctcctctccatcccttcccggctgccattcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtaccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatctgggtgacctacgtcctttccccatctgggcagctccagctggcttagactctagccaggttccagcctccagctttagcccaaaggtgcccctgggtccagcctctgcatcggagctacacaggctgaaatgaggaaggggccacagtgatttggaaagatctccaacccaaggaaagatctcccctctcgcctctgcctccccctacaactctgagccccagaacccaggcagatcctggctctgaccctgggtgggcaccaggtcaccattacctctctgctagtaggaagtcgccatctctgagggcaggcaccttccccagggggttcaccttcaggaactcaggcttcaggtgctcccctggtgggcagaaaggagagaaggctcagtgcagggcctggtccttggcacccactccatggggcccagcccagccacctggctcaccccaagccaactccactgtctgcagctgaaaagggatgtcattctgcctggcaaaagtggatagcatggcagggggctgagtgcatgtccaggaacagcttgggccccattgctgctcctcccacctgccctccccagaggtctgtacctccaggagttgctcagcccttctcggccagtgccttcccccaaaatggggccagaactctgtactcctcctgaagcctattccctccatgactggctgggaggcctgccaagcccctctccccttttctccacctctgtagagtggaggcaggggtggccagtgtccctttgggggtttcagatagaaactcaatgacaattggcttagcaaaaacaaacaaacaaaaaaaaaacaacaaaaaaaaaacaaagggagtggggtgggtggggagatttctcagaaaacttctccagtcataggaggggaggggtgtagaagccactaagagaactggaatcagaacctgtttctgtctccccacttttcctcccctctcctcctctcccctccttcccctcctgtcccctcccctcctctcccctcccctcccttccctttccttccttcccttcctcctttcctcccttctttctttgagacaggatctctgtctccctacacttttttcttttaattctctgtctctttcttgacatagaatcttgctctgtcacccagcctggagttcagtggcacgatcatggcttactgcaatctccaagtcctgtgctccagcagtcattccactacagcctctggagtacctaggactacaggtgcacatgaccataccccactagttaaaaaaaacaaaaacaaaaacaaaaaaacccttgggcctggcagggcggctcgtgcctacaatcccagccctttgggaggccaagatgggctgatcacatgagcccaggacatcaagacgagcctgggcaacgtgccgaaacccagtctctacaaaaaatacaaaaattagctgggcatggtggcgcatgcctgtagtcccagctactcaagagactgaggtggcaggatcacttgagcccaggaggcagaggttgcagtgagccaagatcacgccactgcgctccagcctaggcaacagagccagactctgtctcaaaaaaaaaaaaaagagagagagacagatagggtctcactatgttgtccaagctgatcacaaactcctggcctaaagtgatccttgggtctcagcctcccgagctgattagctgggattgcaggtgtgggctaccacgccctgttatcactccctttctctgagtcagcttttctctctcagactagcctactccatgaactcaggaaatgtcactacaggtggccccagctcccatttacctccccatagggagctcctctctccagttccaatttcaaaactcccaaggaagcattctggttcactcgcttgggccactggccagagggatgggatactctgaaagattcagctagagtcccgggcccagccctggaccatcactgtgcaccctggttagatgccagggctgggattcagggagaagaaaggaggttcccggacagtcattcctgcctcctgcggctgcgggctccctgcacagtcattcctgcctcctgcggctgcgggctccctgcccccatcctgtgcacgaagtgggagctcccgctgtctggcagcagctgctctgcaggggacagtctggacggcagaaagttcatccttaaccccagccttccagtcaaggttcccacaagtctgggacacctgcaagtgtcatatcccgctgggtgaaagtctgagatcccttttagaggatcccattcgctccctcccttctgccaccttccagctccgagaaacagagctctgaacgaaccctcagatgtccatgcgctggggcctttccaggacggcggggcgcagtcctttctgggttggggtgacacctggaaacatgtaaggtccctggcacagggacccctcccagtttcaagcgattctcctgcctcagtctcccgagtagctgggattacaggcgcccaccactgcacccagctaattttttgtgtttttagtagagatggggtttcaccgtgttagccaggatggtcgcgatctcctgacctcgtgactagcccgcctcagcctcccaaagtgctgggattacaggcgtgagccaccatgcagggccaatttttgtattttcagtagagacagggttttaccatattggacaggttggtctcgaactcctgacctcaggtgatctgcctgcattggcctcccaaagtgctgggattacaggcgtgagccaccaagcctggtggtaatttataaggggtggacatttgttggctcatggtcctgaaggctggaaagtccaagatcgaggggccagcatctggccagagctttcttgctgtatcatcccctggtgaaaggataaagagagggtaagagagagcaagaggctgaactcacagcctcaaagtccttttataatccacatcaatccatctgtaacggtggaggcctcatgagataaacacctctcattaggccccacctcccaacactgttgcattggggattacatttccaacacatgctttgtgggggacccattcaaaccacagcacagggacaccttctctttccttcctgtgatatgctgaataatgacccctaaggatatacaagtcctgatctctggaacctgtgaatattaccttctgtggcaaaagggactttgcagaattgattaagaatgttgagatggaggcattgtcttggattatctgagtgagccctaaatgcagtcacaagtatctgtgtaagaggagacagacggagatttgaaacagaagacaggagaagatggaagcagagagatttgaagatgctacattgtgggctttgaagatggaagaaggggctacatgacccaagacaggcagctccaaaagctggaaaaattgaggaaaccaattcccctctcagagcctctggagggtgtgcaaccctattggcacctgggttttggcccagagaaatagattataaagttctggtctccataactgtaagagaatagatttatgttgttttaagccaccaaggtggtggtaatttgttataccatccagaggagaggaacacagattttggtgccaggaagcagggtgctgctataaaaaagaaaatctaggctgggcacagtggctcatgtctgtaatttcaacattttcggatgccaaggtgggtggattacttgagccctggagtttgagactagcctgggcaacatggcaaaaccccgtctctactaaaaatatataaattagctggggatgggccgggagcagtggctcacgcctataatcccagcactttgggtggcaaaggcaggcggatcacgaggtcagaaggttgagaccatcctggcgaacatggtgaaacccagtctctactaaaaatacaaaaaattaaccaggcgtggtggcgggtgcctgttgtcccagctactcaggaggctgaggtagcagaatggcatgaacccaggaggcggagcttgcagagagccaagatcgtgccactgcactccagcctggggaacaaagcgcgactccgtctcaaaaaaaaaaaaaattagttggggatggtagtgcatgcttgtagtcccagctactggggagaccgaggtgggaggattgcttgaggctgggaagtctaggctgcagtgacctgtgactgtgacactgcactccagcctgggcaacagagtcagaccctgtctcaaacaaacaaacaaacaaaaatctaaaaatgtggaagtagctttaaatttgggtgatgtgcagaggccagaaaaattatgaggcccatgatagagaaaacctagattgccttgcacagattgttggtagaaatatggatgttaaagactatagggagggctcacgagtatcaactaaacatggtcagagcaagtctacattgccttacagcatacctaagtcatcataggcagctgtaggtagatatatagatattggctgggtgcagtggctcacgcctgtaatgccagcactttgggaggctgaggtgggtggatcacctgaggtcaggagttcaaaccagcctggccaacatagtgaaaccccgtctctactaaaaatacaaaaattagctaggcgtggtggcatcccagctactagggaggcggaagcaggagaattgctcgaacctgggagacggaggttgcagtgagccaagattgcgccactatactccatcctgggcgaccaagcgagaatctgcctcaaaaaaagaaaaaatagatattaaaaatcctgctgctgaggactctgaagaaatgaggaacgtgtttctggaaactggaggaaggaggatcatttcccagaaaaggagcccgtagggaggtagaaagcttagttgaattgtgtccgatagttatatggtgggtgaacttaaagcaacgaagttggatatttagctgaggagacttccaagcaaagcgttgaaggtgaagcctcatttcttcttgctgtttatggtgaaaagcaagaggaaagtgataaaatgaggaaaaagctgttaagcaaaaagaaaccaaggtttgatgatttgggaaattatcagcctgtgcagattgcaaaagatgctaaaattagaagattcgctgtttggaaaacacaactctatccctgtcctggggatcactcaagacttgtatccatagacaaccagatttctatgggcttgaactctgtgtgtgtgtgtgtgtgtgtgtgtgtgtgtgtgtgtgtgtgtgtgtgtgtgtgtgtagcaaggttgggggagcacagtggaaagaccttgaatttatttgtttattttttagacggagtcttgctctgtcgcccaggctggagtgcaatggcacgatctcagctcactgcaacctccacctccagggtggttcgagcgattctcctgcctcagcctcccgagtagctgggactacaggcgtataccactatgcccagctaatttttgtattgttagtagagatggggtttcaccatgttggtcaggctggcctcaaattcctgacctcaggtgatcaggctggtctcaaactcctgacatcaggagatccaccagcctcggccttccaaggtgctgggattacaggcatgagccaccatgcccagccttattatttatttatttatttttgagacaaagtctccctctgtcacccagactggagtgcagtggcgcaatctctgctcactgcaacctctgtctcccaggttcaagtgattctcccagctcaacctctcaagtagctgggactacaggtgcgcaccaccatgacctgctaatttttgtatttttatttatttatgtattattttattttatttttccataagttattggggtatgggtggtatttggttacatgagtaagttcttttgtagcaatttgtgagattttggtgcacctgtcaccccagcagtatacactgcaccatatttgtagtcttttatccctcaccctcctcccactcttcccctcaagtccccaaagtccattcttatgcctttgcgtcctcatagcttagctcccacatatcagtgaaaacataagatgtttggttttccattcctcagttacttcacttagaataatagtctccaaactcatccaggtcactgcaaatgctgttaattaattccttttcatgactgagtagtattccacatatacatattccatatatattcattccatatatatattccatatatgctcattccatatacatattccatatatgctcattccatatacatattccatatatactcattccatatacgtattccatacgtatgtactccatatacgtattccatacgtatgtactccatatacgtattccatgtatgtattccatacgtatgtattccatgtatgtattccatgtatattttccatatgtatatattccatgtatatattccatatgtatatattccatatatattccttatgtatatattctgtatgtatatactccatgtatatattccgtatatctatattccatatatgtattccgtatgtatatattccatatgtactccatatgtattccatatgttccatatatattccatatattccatataaattccatatattccatatatatcccatatacattccatatattccacatatattccatatacattccatatattccacatatattccgtatattccatatagattccatacatttattccatatatattccatatagattccatatatattcagatatattccatatttatattccatatatggaatatatatgtattccatatatatgtattccgtatatgtatgtattccacatatatattccatatatgtatgtattccacatatatattccatatacgtatattccagatatatactccatatgtatatcccagatatatatattccagatgtatatattccacatatatattccagatgtatatattccatgtgtgtatattccatatatgtatattccatgtgtgtatattccatgtgtattccatatatatattccatgtgtgtattccatatatatagtccatgtgtgtattccctatatatattccctatatatatattccctatatatattccccatgtacattccatatatatattccccatgtacattccatatatattccccatatatattccatatatattccccatatatattccatatatatattccccatatatattccatatatatattccccatatatattccatatatatattccccatatatattccatatatatattccctatatatatattccctatatatattccctatatattccatatatatatatatatatatatatatatatacaccctatatatatattccctatatattccatatatatatggagtctcgctctgttgcccaggctggagtgcagtggcgcgatctctgctcattgcaagctccacctcccaggttcacgccattctcctgcctcagcctcctgagtagctgggactacaggtgccagccaccatgcccagctaattttgttttcgtatttgtagtagagacggggtttcaccatgttagataggatggtctcgatctcccgacctcgtgatccgcccacctcggcctcccaaagtgctaggattacaggcttgagcctccgcgcccggcctctgaattctttttcaggtaaatcagggatttcttcttggtttggatccgttgctggtgaactagtgtgatatttgggggtgttgacgacccttgttttgtcatgttaccacagttggttttctggttccttctcattggggtaggctctgtcagagggaaggtatagggctgaaggttgttgttaagattttttttgtcccagggctattcccttgatgtagtctctcccccttttcctgtggatgtggcttcctgtgagccaaactgcagtgattgttgtttctcttctgggtctagctgcccagtgagtctagtcagctccaggctggtactgggggttgtctgcacagagtcctgtgatgtgaaccgtctatgggtctctcagccatggataccagcacctattctggtggaggcggcggacggtgcagtgcactccgtgagctttggtggtttaatgctctatttttgtgctggttggcctcctgccaggaggtggctctctccagaaagcatcaactgtagtagtgtggagaggggccagtggtgggtggggccctaggactcccaagattatgcgtcctttgtctaccactactagggtgggtaggaaaggaccctcaggtgaggacggtgctaggcatgtctgagatcagactcttcttgggcaggtgttgctgtagctgctgtggaggatgggggtgagatgcccaggtcattggagttgtgtgcctaggagaattatggctgcctctgctgagtcatgcaggttgtcagggaagtgggggaaagccggaagtcacaggcctcatccagctcccatgcaaactgaaggggcggtctcactcccaccatgtcctgcaaacagccctccatctggaaacagcaaacagtgtgtttccagatggagggccagacgaattgaaaacttgcctgaggctttccacctcccagctgccaaagaaaagggctttagttcttcctccgcctgtgaaatctgcaagccagattcacaccctcccctgggttctggcccagaggcttctcaccccattcaaattgttacaaagttcagctagagaattccttctccctgtggagctgtggagttttaccccttgctttctggccaccctcctgatggatccctgtggtgccaggcaggaatgggctgcttggggatccagtgagctcccagggcctttctgctgcttcctctgaccctgtattttgctcggctgagttttgtaacttgactcagctccaggaaaagtcggaaacttcttccacaaacaggccttcagcttctccagtgggggtgtgtgctcaggagaagcgggtctccctttcccacttccacagctggggcactcacagtatttggggtgtctcctgggccctacaggagcaagtctgcttccttcagagggtctgtggatcctctcaggattgctggtttgttctttcagtggatctgcagctaaaattcacaatgcaagcctccacatgctgctctgtccggagctgcaatctggctatgcctcccgtctgccatgatcccgaaatccctctccaatttttatatttttagtagagttggggttttgccatgttggccaggctggtattgaacttctgacctcaagttatctgcccatctcggcctcccaaagtgttggtgtaccaggacaagctgcagacaaaacctctgagacaccaagttaaagaaggaagggctttattcggccgggaacttcagcaagactcacgtctccaacaaccgagctccctgagtgagcaattcttgtcccttttaagggcttacaattctaaggggtctgtgtgagagggtcatgatcaattgagcaagcagggggtacacgactgggggctgcatgcaccagtaattagaatggaacagaacaggacagggattttcacaatgcttttccatacaatgtctggagtctatagataacataactggttaggtcaggggtggatctttaaccaagcccaaggtgcagcgccgggctgtctgcctgtggatttcatttctgccttttagtttttacctctttctttggaagcagaaattgggcataagacaatatgaggggtggtctcctaccttattggggttacaggcatgagccaccgtgcccagccaagaccctgaatttaaatcctgactctgtcattcattagctcctgacctcaagtatgccattaactactttgaatcctggtatccttgctgtcaaaggagatgagagttctgacacttataggtccactgtaagacataatttttaaaatatctgtaaaaactgggccgggcatggtggctcatacctgtaatcccaatactttgggaggtcaaggaaggcagattgcttgagcccaggagtttgagaccagcctgggcaacatgatgaaaccccgtctttaccaaaaattcaaaaaaatttagctaggcattggcacgtgtctgttagtcccatctgctcgggaggctgaagtgggaggatcactggagcccaggaggcagaggttgcagtgagccgagattgtgccactgcactccagcctggcagagtgagaccctgtctctacaaaaatgtaaaataaacttaaaaaatgtcaaagcatgataaagtacaggacataaagaccatgattaatctaacacccatcactacaatctttgcctctgttctggcattcccctatgtgtcttcgcatcaccctccttctgggtgactcctttatgttgtatttttttgtttggtttggtttttttggttagtttgttctgagacagagtcttgctctgttgctcaggctggagtgtagtggtgtgatcttggctcactgctacctctgcctcccaagtttgtacctcagcctcccgagtagttgggattacaggcatgcgccaccatgccctgctaatttttgtatttttagtagagacggggttttgccatgttggccaggctggtctcagactcctggctcaagtgacctgcccacctcagcctcctaaagtgttgggactacaggcatgagccaccacgcccggccaccccactcattttgaatgtaagtagattaccaattctgaaatgggttttgagcagtagcaacattgacacaaatttataatattttcaagaagatacttccttcaatatgtaaaatgcaacagatatcatttgcaatcatacatatgtacatatatacatacacacatataatatatatatctcaccatggaataagtctgagctgaaacatgcattacttaaaaaagaaaacacttacagacaggatcttgctccgtcatccaggctgaagtacagtggcacgattgtggctcactgcagcctcgacctcctgggctcaagtgatcctcccacctcagcctcccaagtagctgggactacaggcatgagctacctcgcctggcctgcatgatctttatgaagaatgtcatagaaagtttttgaaagcgattaaagttcacctaaacaagcagggatctatgctgtatgccatgctattattggggaggaaaaaaattctcctctacattcttagggtctctggagatctggaactaagaataaaactgaaataagacagattaacagaagaaaatcattcaagttttgctaaattttcagtgtacatgggtactttcacaagagaatgaaggcctaaagaagtcactaaagtagaaaaacaataccttttttttttttttttttaagacaaggacgggtgcggtggctcatgcctataatcccagcactttgggaggccaaggcgggcagatcacaaggtcaggagattgagaccatcctggccaacatggtgaaaccccatctctactaaaaatacaaaaaaattagccaggtgcggtggcgggcacctgtagtcccagctactcaggaggctgaggcaggagaatggcatgaatcctggaggcggagcttgcagtgagcggagatcgcaccactgcactccagcctgggtgacagagcaagactctgcctcaaaaaaaaaaaatgacaagacaaagcggcttggattatagggagtaaattgtggagaagggactaggacatacatgcggagcaaaattagaagataaggattatttttagtcgtgtgtttatacagatccattggaaccttgattcacagtcacttgtgatgacaatgttcttctcttcctggtaaagggagggtgctttcttatgggaaattgtgtggcctattcttagatagaaaagggcaggtcagagagtctttcctgcatgtgctatttctcaagtgccttcaactcaaaataattaatactccaaagcagcatatttggggtgacgtgtttttaattccttcatttcccctgctgcagactttcctagaagtttcagatattaaaagctgagttggtggctatggagataagagccagattcataacgagggatctacaaatggggagaagaacatagataagaataggaatgaataagctgaaaggaacaggtctgagcacatttccccttatcctgttaaacacacatcccattgctgggacaaggtcagtacagcagaaggaatgcacctcttttgtttgatggagagtgtttagcttgttctttaacaggtgcagcttaggcactatttgtcccagtggatttacacagaccagccttatccaccaatgatcacacaaactcctccttttgaggctgtcagtgtgtccagggtgcaacaattttggaatacagcagaagctaagctattaacttcttttgttgtggttgctgttgttgttttgagacagaatctcactttgttgagtgcaggctggagtgcagtggtgcgatcatggcttgctgcatccccagcctcctgggctcaagtgatcctcccacctcagcccccagagtagctggaactactactatgccctactaatttttaaactttttgtagagacagtctcactatgctgcccaggctggcctcgaacttctgggctcaagtgatcctccctcctcagactttcaaagtgctgggattagaggcctcagccaccatgcccagattgctttgacatcttgaggccttactgatccaggagagactgcccctccctgggccagctaattcctacagagaataaatgatttgcttatggtgtgccttcgatgggccaatcaaccgattcgtatctccaacataactttaccagccacctttcagcaggttcctgccccaaatcactccagggacaggtaccaggtaacaaaggaccactcctataacccagagcccatcacaattattaaaactagccagtcctaagtctgtttaccctgtcttgccttcttgcaaaaaacacagtaaagccttttgtccaccttttgccctcactcattctgccacctgactgaccctggtgcttccccatggccctgcatggtgtggcatgtcccccctattgtcttgggaactgtgagtaacaaactttcttttacatggctatcacctctgatctgtggcctcgccatacctgaataaagccaaaatcccaggtacattttaaaacaagtctacaagtcaaggaataccaaggatttccagcaacaccagagaggccggcccacgcccggcctgactcttactgttaatcactagttttgcatttctcttgaggaactagtcaggaggagaaaacctagacagcagctctcctggtcaagacccagtcattcagaagcctaaatggcatgcctaggtgcttggctttaaactgttagcaggtatggagtgctctgattgtgttttagaataatattctgggctgggcacggtggctcacgcctgtaatcccagcactttgggaggcggaggcaggcggatcacgaggtcaggagattgagaccatcctggctaagatggtgaaaccccgtctctactaaaaatagaaaaaattagccgggcgtggtggtgggcgcctgtcgtcccagctactcgggaggctgaggcaggagaatggcgtaaacccaggagtcggagcttgcagtgagccgagattgcgccactcattccagcctgggcaacagagcgagactccatctcaaaaaaaaaaaaaaaaaaaaaaagaataatattctggctgctgctggaaggcagccagggaggaagcaaggacattggatactgcagtaatcctggccaaaggcgacttgtgaaaaggggtgggcaactgaaggggcaggagaatgtggcccctctcagtctggagagagctgcagcactaggccaggaaggcactcttctgcggggggataggtcttaaatggggaccatgggattgggtgcagtggctcatgcctgtaatctcaacacttcaggagtctgaggcaggaagaccacttgagcccaggagttggagaccagcctgggcaacatagtgagaccctgtctcaaaaaaaaaaaaaaagacaatttaaaaactagccagatgtgatgcctgtggtcccagctacttgggaggctgaggtgagatgatcacttgatcacttgagccctggaggtcaaggctacactgagccatgatcatcccactgcactccagcctgcgcaacaaagtgagactcttatctcaaaaaaggcgacaggtgggaaccatggggaaccagagaagcaaagctattctcaagttttccagtaaccatcctcttgccaatggtctttctctgaatcttggatttgggaataggattttcctgccttgggaggctcccttgggaaatgggagtgtcacagccacaggcatcaaaagccctagagttgcacttgaatagtgggtagaaagttctgtgcaatgccaggcactgttggaaacctctgggtagggcttacagggccttagccatctgtgggaggcattagctggagtgtaataaatatgaccctcaggactggggagaaacagctcattccttcatgaggtgtggggctggcagccttgcaggcagccagccacccttcccctctggcctccatcctgggcactgagccaggcactgggtaagaaggctgctgcacctcctttctcctcttcccttttagagagaaagatacccccagccgaggatcccagaaaggcgagagcagacgcgccattgattggcccaaagttctccggagccaacctttgagcaaggagggcgtggctgggctccagtctcctagtgaggtgcaccactgcaggcttggtgacccagccgttcctgcccgctgcccccaaccagccgttcctgcccacagttcctgttcccgggcctgtccccgggtttgtccccagggcccgtcccctgggtttaggtctaccctccctcgccccaccccatcgccctcgccatgggtctggagctgtacctggacctgctgtcccagccctgccgttcagtctacatcttcaccaagaacggcatccccttcgagcttcgcaaagtggagctgaccaaagctgggctgggcaggcaggcccaggggatattggctgcggatccccacctgtccccactgctttgcagtcgggccgagaatgcagactaacatgaagaatcagactctctggtgtggaaactattacgtaattatctatgttattatttttactttttggagacaggagctaactctgtcactcaggctggagtgcagtggcacaatcatggctcactgcagcctcgaccttccaggctcaagcgatcctcccatctcagcccctcaagtagctgggactacagatgcccaccgatatgcccggccaatttattattattattattattattattactattgagaggaggtcttcctgtgttgcccaggcaggtctcaaactcctgagctcaggcgatcctctttccttggcctcccaaagtgctgggattacaggcatcagctgtcatgccctgctggttgtttattttaaaagaggcttcatctttgcttagtgaatacaaagcattcttcaaaatacaggttaagagggggcagagcagatgcagcaggagggcagggaaatggagtggggctagaatatcttcaccccatgtgcttggaaaaaacaatgaaactacctccttgtttcctaagtggagtagtccttgtttacctctgcctgggtctcttcccttcttgcctcttctttttttgacacggtctcactctgcagcccaggtagagggcagtggcatgatcccggctcactgcagccttgacctctcaggctcaagtgatcctcccacttcctcctctcaagtagagtagttgggaccacaggcacgcaaccacatccagcaatttcttttttttcctttttttttttttttttggtatttgtggagacgggattttgccatgtagaccaggctgaccttgaactccagagctcaagtgatcctcctgcctcctccttctaaagtgttgagattacagacatgcactaccatgtctggccctgggtctcttccacttttatgtatttcttggcattcttctgccttttcttttcctgcatctgacttgctctatcccatggggcttctcacccagctgaaggggctgctcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagaaggaggaacctgctcagctgactcttcccaactgctgcccttggtacaaccagcttgagtcacctgctacagaacaggggctggacacagaagcagtctgtggagggagaatgggcaggggtgtgcatgtccattcagtagaaggccagagaggcccacatgtaggcctatgatcagactggagcctggcttgactgatgccctctgatccaaacaccaggcacctaatgcggcctctagcactggcctagagtgctaaagtgagtcagacctgggaacccccagtggggagggagccttgagagtttggcacaagaaaggaagaagagctgagccaccgggggctgagtggctgaatggggcagggattcccagcaagaatgaggttggtctgagggttgggaacatgtttggctgggactctggggtattgacaggtcacccagcctggccagtagggcctaaggccccagctgggataggaagctgaatcagagggggcaagcctagagcccagggaggaggctggaggggtctgacctatggatggaactggctgggggtggggtgtgaattacagctccagggaattgtccttgagccatgcttcaaggaactggacacaggaaaggtggccctctgatagggtcagggtctgtgacccagtgactaacagagaggcttcctcttccctgatgcctcccagataggggcctcagaaagctgctgctgggagtttggagtgggggtgggcagagacatcagagaactcagggttctccccactcacctctctgatctcgcctgcaggccagcagcacagtgatgcctttgcccaggtgaatgccctgaggaaggtgccaggccttgaaggatggggacttcaccttggctgagaggtaaccggtccctgggctgctgccgggccttgtggggccagtcagtcagctgtctgtttactgctgatggcttggatcatggactgtgggccctgcaccagccccagggtgaagaatgggtggaggcaggcagaggtgcccagtgttgacaagggctatagaagtcccctcctgcattgtacaagtgaggaaactgaggctggaggaggggagggacttgcacaaggccacagggcccagtctgcttccgggcctcctcaccgccagtcttcccctccgaaaaaaagagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctacgtccttctcctcatggagctcacattccattaatagaagggggagctgacagtaacccatgtaaacatggaacatatcggatgttgatggatgccatggaaaaaataaacagggtaagagtgggggtgtgtgtcattatgagtaggatgttgagggaagactccctggaggaggtggcatctgagcagagagctgtaggaatgtgcaaggcatgaggggaagggtgttctcactggagggaagagtgagggcgaaggctccaggtgggacaatgcatggggttcagactggagagcaacgggccagggtgggtgcagtgagcaggaagagcaggaggtcatgacagaggggagcatgggacactgggaaggctttggctcttaccacaggtagattgagtcgctggagggttttgagcagaggagaactgtgatctgacttacgtcataaaggatccccctggcaggggtgagaaagccactgcagtcatctggcatgcagcgctggagccccagaccaaggtggtggtggtgcagggttggtggggattgtggtcagttctgacttttattgaaatctaactgcagggtttgctgaagggttggaggtgggtgggaaaaatgaaagccaaaaccagcctctaggttggtggctgcatggtggcgtcctttaccgaggccaaatagtgcctccttggtggagctggattcacattcagagcctgggatcactggatggtccaacacccatagaggcatgatgagctctgggggtcagactgcacaacccttcaccataggtgaacaggagatgggacagggtggggagcaatgctgccatgtcacctggaaggctctctccctgctggccttgctcctggccctgtccacgctttggatatgttggggagatatccaacatgctctcgttcttcagactcacagtggatgccccttcctcctggaagccttccctgagcccctgctgaagttcatgacattttgtttcttacttgctgcccttagttgagatgatagtctggccccgtgtagggctgtgtgaccctgggcacttacctaacctctctgagcctcacatccctcctctgcatcatggggatagtgaaaatgccccagaaaatggctgaagagtgttcagggcatgttttctgcccctgccatgtccccccagtgtggctagcttgctgtgtatgaactgcatgtacaaagcacctgaccactggtacccccaggacctgcaggcccgcgcccgtggggatgagtacctgtcatggcagcacatggccctgcagagtagctgctgctgggccatgtggcagaaggcgagccatggagggcagggacatctcccaagatgccaagggatgctgctttcactttacaaaatcctgtttagacctgagaccaaatcctggaatgccagagactgcctaattcacccaacttgtttcctaggagggaaaccaaggaccagagccaaggaaggattcccctaatatgccttaattccagagctatgagcagttaatcctatgctcttttgcatactccaggttgcctgggaatcttgcctttagggggagaaaataaacaaaccctcactttgctacacacataattcgtagatggagaagtatgaagtgaaaaaagtcaaactaggaagaagtgaggagacatttcaataaacgtttgtctgatgtctcggtatgaaaggactttctaaccctcagaacagtgggagaactcaacaaagaaataaccactacatgccagctgcggtagcatctgtaatgagcacacctgtaatcccagcactttgggaggccgaggcaggcagatcacctgagattgggagtttgagaccagcgtgaccaacatggagaaaccccgtctctaccaaaaatgcaaaattagccgggtatggtggcgcatgcctgtaatcccagctactcgggaggctgagtcaggagaattgcttgaatctgggaggcagagattgcagtcagctgagatcacgccattgaactccagccttggcaacaagagcaaaactctgtctcaaaaaacaaacaaacaaaaaaacatatacaaggacatgttgtgtaagaaaaaatggattaaacataaaacaagcaaaaaaccgggaaggatcttgataaaagatatgtcagaaggaggtaatgttctttaagatgctcttagaaacccttaagagaggcctggtatggtggctcacccctgtaatcccagcattttgggaggccaaggtgggcagatcacttgaggtcaggagtttgagaccaccctgggcaacatgatgaaaccccatctatattaaaaatacaaaaattagttgggtgcggtggcacactcaggagactgagacaggagaatcacttgaacctgggaggcggaggttgcagtgagctgacatcataccactgcactcaagctccacttagagcgagactgtctcaaaagcaaacaaagaaaaataagagaaacccatcagacaagagacaggaaaaaaatgagtcatagctcactgcattctagatctcctgggctcaagcgatcctcctgcctccgcccaggtagctagaactacaggtgcacaccacaacactgggattctttttttttttctttttttttgtagaaaacaacgaagggaatcttgctatgttgcctagcctggtcttgaactcctgggctcaagcaatcctcccttcttggcctcccaaagagctgagattacaggtgtcagccactttgcgtgaccacaatttcaatcatatttaaaatgtacaattcaagtgattttgccacactaaccacagactcatgtttaagccacaccaacggatttccatgttttaaataacatattttgccaccccctagtggacagtggctcaccaccggcacaaggggctacataggcagtcaatgggaaccaggcggggacgggaaatgtcgtgaacccaacggtccctgcccagccccacccgcgtccgcaacgtgtaaccacatctcctgactgcccaagagaagcgcagatttccatactgaacatgaaattgcctgacttcgaaatggtggcaaatcattaaaaaaaattttaaactcactttgcattggttattagggtcgaacttggggaagacccctacaggtgtgtgtgtgtctgtatgttaggggtgttcagacctttaatagggctagaaaccaggcaaccacaccgcggaaagcttgaggagagggaaatccaccagacgccaagcaggagggtcagggaagagacagggtggggccactaccgggttaaagacttgtagtgggtggggctacacgtagggccgagacgaccggatttccggaaatcagagccggcacacgtgacttttgtttgcagaagtgggaaggtaccctaggcagccaatcggggagcgctgagtctctgtccagccaatgagaagccaggttgttttagcgcctcgcccctcctctccggtccgcgagccttgggtatctccagcttttttccgccagagctgtttccgttcctctgcccgccatgccgttcctagagctgcacacgaatttccccgccaaccgagtgcccgcggggctggagaaacggctgtgcgccgtcgctgcctccatcttgggcaaacctgcagacgtgagcgtgggccgggcagcactgggcgaggggaagttggtgggccaggggtccggccttgtccctgctctgcctccgcaacagcgaccccgatccctttccccagggaccaccccccaccccattccgcaggccaagctctgactttccgtgcttcacgatcccgcggctccccctccgcacgtctttcccttgtcgccctccccagtcatgacccggacgtgaccttcagggacctcggcctgtactgggatccctgtccccgcgaacactgcgcgtttcggctttcgcgcgctcgggtcgggaccccagacgtagcccgactggctccagcttcgggtaaaacttttcatgttcccctcagcttgtgaacgtgacggtacggccgggcctggccagggcgctgagcgggtccaccgagccctgcgcgcagctgtccatctcctccatcggcgtagtgggcaccgccgaggacaaccgcagccacagtgcccacttctttgagtttctcaccaaggagctagccctgggccaggaccggtgcgcaggggtagtaggcccggaatattattctaaaacacaatcagagtactccattcctgctaacagtttaaagccaaacacctaggcaggccatttaggcttctgaatgactgggtcttgaccaggagagctgctgtctaggttttctcttcctgaccagttcctcaagagaaatgcaaaactagtgattaacagtaagagtcaggcagggcgcggtggctcacgcctgtaatcccagcactttgggaggccgaggcgggcggattatgaggtcaggagatcgagaccatcctgactaacacggtgaaactccgtctctactaaaaatacaaaaaactagccggacgtggtgggcgcctgtagtccccgctactcgggaggctgaggcaggagaatggcgtgaacccgggaggcggagcttgcagtgagccgaaattgcgctactgcacaccagccggggcgacaaagcgagactgtctcaaaaaaataccaaaaaacaagcaaaagaaaacaaaacaaaaacagtaagagtcgtcccaacgcagtggcttatgcctgtaattccagcactttgggaggccgaggcaggcagatcacctgtggttgggagttcgagaccagcctgaccaacatggagaaaccctgtctctactacaaatacaaaattagctgggcgtggtggtgcatgcctgtaatcccagctactcagaaggctgaggcaggagaatcactttaacccgggaggcggaggttgtggtgagctgagattttgccactgaactccagcctgggcaaaaagagcaaaactccttctcaaaaaaacaaacaaacaaacaaaaaaaaaaaacacacacacacacaatccaaaaaccagtaagggtcatgtcctgggaggctaactcagccgactgttaggtcaccatgcttatagccaagaaatgtgggatgctgctgggccctgagcggtcagataaactactttctctgataattagaaggctacaggaaatgttttgttttgttttgttttgggtttctttgtgtgtttttagagacaggatcttgttctgttgccccaggctggagtgctatggctcaatcagagctcactgcagcctcgaactcctgggctcaagcaatcctcccacctcagcctcccaagtagctagaactacaggtatgcatcaccacgcctgactaattaaaaaaaaaatttcttttggttgcgtgtggtgtcttggcacccgtaatcccagcactttgggaggtagaggtgggagcatctcttgagcacaggagtgcagggctagcctgggcaacatggcaagaccctgtctctacaaaaataaaaaagaaatgagctgggcgtggtggggtgcacctgttgtcccagcttcttaggaggctgaggtgggaatattgcttgagcctgggatgtcaaggctgcagtgagccatgactgtgccactgcactccaggctgggcaacagagtgagaccccatctctgaaaaaatatttttttggggagccaggcacagtggctcatggtaatcccagcactttcagaggtggaggtgcacagatcatttgaggtacagagtttgacaccagcctggacaacacggtgaaaccctgtttctactaaaaacacaaaaattagccaggtgtgatagtgcgtgcctataatcccagcttctggggagactgaggcaagagaatcgcttgaacctgggaggtggaggttgcagtgagctgtgatcatgccattgcactccagcctgggcaacagagcaagacactatctcaaaaaaaaaaaaaaaaaagtttgttttgaaatcctggactcaagcaatccccccaacctggacctcccaaagtactaggattataagtatgagctaccacactcagccactttttttttttttgagatggagtctcgctcggttgcccaggctggagtgcagtggcgcgatctcggctcattgcaaggtccgcctcctgggttcatgccattctcctgcctcagcctcccgagtagctgggactacaggcacccaccaccacgcccggctaattttttgtatttttagtagagacggggtttcaccgtgttagccaggatggtctcgatctcctgacctcgtgatccccctgccccggcctcccaaagtgctgggattacaagcgtgagccaccgcacgcggcctcagccacatttattaatttcactcttggcaaacatcagggggaagctgacccacacggcctgggaagggggttgtcttttgcatagagaccatgaccaggtctgggacagaggaaagtcaaataaatcacacattagagttagaagcagaggctcaggctgagcccaggtttattatccaaaatcaaaatgaaatgcagtgattaaaggacacaaggcctcagtgtgcatcattctcattgtggctttcaggcggctgtggaagacagggtggggatggtggcttcgggaggtgaggtgctctgggacttgggcaagtcttaggcaagccattcctgctttctgggcctggctcccatgggccattagaaatgaaaatgctttgtggactgctgaggacggtgcaagggtgaggtttcccagctcaccggatcatggccagcacccagggcatcagcttctgctttatggtggggtctgcaggtgggaagtccttggccttcagaatgacctcatgggcctcctggaagaggtcctcccccactgctgcctccacgcgctgccgccatgtggccagcttgggtcggccttcgaagacttggcagccagcacccacgggctgtggggaaaagggtacagactggggatggatggttgtgagggcagggatgggcagcatctgatttggggaccacagatctccaggaggtgtttgcacacacacttaagcacagtgccatagcccggtgtggcagcataagcaggacttcagcaactagccagggccccctgcctagtgggttcacctgcccacagcactcacatgcatcagctccgtgatggctacgaggtcagctaaggagatgtgaggaccagtaaggaaggccttgttctggaggaacttgtcctcgagcaactgcagggtcacatccaactctgccagggtggctgccagtgtctggggagatactggctcacccaggaaaacagggaacatcacctggggattgggcaggcaaagtcgggagttactggagtagggagttagttttgatttgcatttccctaatgattagtgatgctgagcatcttttcttttttttttttttttgagactgagtcttgctctctcgcccaggctggagtgcagtggggtgatctcggctcactgcaagctccgcctcctgggttcacgccattctcctgcctcagcctcccgagtagctgggactacaggtgcccgccaccacgcccagctaattttttttttatttttagtagagacagggtttcactgtgttagccaggatggtctcaatctcctgaccttgtgatctgcctgcctccgcctcccaaagtgctgggattacaggcgtgagccaccgcgcccggccaagcatcttttcttgtacttgttggccaaaatgataatattctcaacacattgggttaagtaaaatatatcaatttccttttactttttttttttcttttgagacagtgttcagctctgtcacccaggctggagtgaagtggcaccatctcggcacactgccaactttgccccctgggttcaagcaattctcctgcctcagcatcctgagtagctgggattataggcacaggccaccaagcctggctaatttttgtggttttagtagagacaaggtttccccatgttgaccaggctggtctcgaactcctgacctcaggtgatccactgccttggcctcccaaagtgctaggattattggcatgagccactgtgcctggactctttttactttttaaatgtgcctactagaaaatttaaaattacgtatgtggctcactttatacttctatcggacagcacttgactaaatgaactaaattccagagaggcataagccgttcctagatgagctactttcattccaatttcatttccttgggcccaagcaggctgggagaaagactgtcacaggcatgggcttttctgactgagcagcagtttgggaactgggggcagggatgaaaagcagagagatcttacaggcaacatcgtagttggtgattagattccaaagccatgctagactgagctagtgacctgatctcacattcaagatatttgaaaccaaagataaactgaaaccaactaaacctgcaacccagcccacctcctgattagcttagaagagaacagcctcacatcctggctacctgacacagggaagtgcaagccctttcttgggggtgtttattatgcaattcaatctctgctcttcttttatcataatgtctggcacacaaggatacatcatgaggccgggcatggtggctcatgcctacaatcccagcactttgggaggccgagatgggaggatcacctgaggtcaggagttcaagaccagcctggccaacatggtgaaaccctgtctctacaaaaatacaaaaattagccaggcatgatggcaggtgcctgtaattctagctacttgggaggctgaggtgggagaatcgcttgaacccaggaggcggaggttgcagtgagccaagatcgtgccattgcacgccagcctgggcaatggagtgagagtccgtctcaaaaaaataaaaaataatgataatacatcatgagacatgcaaagaagcaggcaaatgtgacccataatcaagagggagaaaacaacaatcaatagaaatagacccgtaggctgggtatggtggctcatgcctgtaatcccaacactttgggaagccaaggaggacgaatcacttcaggtggagagttcgaaaccagcctggccaacatggtgaaacccggtctccactacaaataacaaaagttagccaggtgtgctggtgggtgcctgtaatcccagctacgcaggaggctgaggcaggagaatcgcttgagcctgggaggtggaggttgcagtgagctgagatcgcaccattgcactcagcctgggtgacagagtgagaccccatctcaaaaacaaaacaaaacaaaaaaaccagacccacagaacacctacgtgttgaaattagttgacaaagatttttaggtaacagtgataaatatgttaaagaatttacaagaaaagacagataaaatggatgaacagatggtgaatttcatcagagaagtggaaattctaaaaaacaaccaaatggaatttccagagctgaaaaatacatatctcaaacaaagaatgtattggatgggcttaatagcaatttggcacaacagaggaaagaatctgtgaaggcaaagacaggtcagtagaaataatccaaaactgaaaagaagagactggtgcctgaacacctttggggaatgctctcgctgccgccccccacattcccagcctcaccttatgccacaaggcccggaggcagcttctccgcagagtcgtgtgctgccatgccaggtactcatccacacgggcacgggcctgcaggtcctgagggtaccagtagtcagggaccttatatttgcgcgtcaggtagagcaggatggccacactgtgggtgtgggggtcatgatgggtaagggaagggcactgtgctgggtatttcatacatagtcgcttttttttttttttgatacggagtctcgctctgtcgctcaggctggagtgcagtggtgcgatcttggctcactgcaacctccacctcccgggttcaagtgattctcctgcctcagcctcccaagtagctggaactacaggtgcgtgccaccatgcctggctaattttttgtagttttagtagagatggggtttcaccatattagccaggatggtctcgaactcctgaccttgtgatctgcctgcctcggcctcccaaagtgctgtgattacacgtataagcaaccgcacctggccttttttttttttttttttttttttttttttggagacaaggtcttcctcagtcacccaggctggagtgcagtggtgcagtctcagctcactgcagcttcaatttttataggagtgcaccaccatgcctggctaccttttttcttttttgtagagatgggatctcactgtattgccaggctggtcttaaactcctatcctcaagcaatcctccagccttggcatcccaaagcgctggcattataggcatgaaccactgtgcccagcacacttctttaacctttctgacaatttgccaaagtattagcctcattttccagagaagaaaaccaggcttagaaaggcagagacttgccctagggcacacagctcttaatggcagagctgagaatctttctgaggctaatacccaagcttttcctaccaccaggcaaaatcccacaacagaatgtcttgccaaatgtttagagacagtttctgatcagagaaccagagagagcttccaggagaacggggcatcaaagctgagctttaaagaagctcagttctttccattcggtatccactctcatctgctgggattccgaccagcctctgatggcctgactgttcaaaaaggcttccgtgtccctttgttctttctgtcattctttctgccaagaatcagctcctatctaagctgactggggtagtttggcttcctaaagtaccactcaggaagcactcctgcagctgcaggatcctagaacaacagaacagacaaggccccctggcactctcctccttccctgggttttgagggccgccatggtgatgagatgagcatggacctggaaggacacaggatgtgtccatttggagacacagaaaagctttcaggaacttggggtttcccaaaggttgggcatgcaggccaaaagggcagaaaacctctgtatctgccacgggcctatattctcttttaagctggggctacacacgtgtcccagcttaacgactccgttgtctgtgcagggtgcccaggagctccttttgctcccagccaattgttcaagccacctctgaggagggctgcaggtctctgtgagccacagacctgaaggtgagagtagtgacagaggcagagattgcacattgactctggctggtacctgggggtcacaacgctgagtgacacaaggactcaggacacctggggcaccagggaggaagacgggccctggcagaatgtcagaggaattcatcggaggtgcgtccatcctgagatttcagagatgagctttaaagcacaaactccaggttcttgttaggggaagggtgactctggtgacaaaaggggcagaactggggaaagattggcttttcctgaagaggattcaacttcttgggaccagctgtgatgtaagacgtccatatctggtggctcttccatggggaagacccatcctgggaagctgcagcccagagatggagccaccgggcagcccagatgccactgagccatcgccacacaagcttggccagaggcctgccccacggtgggcaaagctgccatcgtcctctggcctaccctgtctcaaggatactctcaccactcaccagcaaccaaagcactggtgtggaagtaaagtagatatttgcttttctaatcatcagggtgaactggaatagcaggaaggcaagggcctggggtccagtactgactctctgcaggatgcggggcacagagactctctgcctctgaagactttagtttccttgtctatgaaatagagggttagaacaggatggttccagcaggcctggcagcagtcctagggtcccagttacctctccgtcaaggtgaagtccccgtccttcaaggctggcaccttcttgagggggttcacctgggcaaaggcatcgcttaagtgctgacctgggaagagtccagcatggtgggtggtgggaggagaacgctgagcccgccatggcctgtgcccctccctgcaatgctctggccccagtttcacagttcttcttcccaccagtctgcactcctggttggcaaagactggaagggcccctgcgggaggaggaggagaccactccaccggctggtacaaaatagacaacaccccttgctaagtcctgtaggcacagcctcctcccacaggctgcccctctgcaacagagctcactgtgcagggtgtggttcctggacctttgcatgcaccctacccatctcctctttccactattgccagcttcatgaactcacaatcagagcaccccaagctgcacgataggtcacctgaggggactgactaccttgtcccttccaccattaattctaaggcagggtcatgaaacacagagaagtggtctttttctggtatctacctacttagaagcaacttctactggccccaccatgtccctttgttcaccctgccctgggcactgtggagctgtgtgtagcatacctgctaccaccccctgtgccccaaacttttattccccttacagttggggtctcactatgttgcccaggctggtcttgaactactggcctcaagtaatcttcctacttcggcctcccaaagtgctgggattacaggtgtgagccaccatgcccagcctgctaccctctcttcaccctcccttcagactgttccttcaccaggaaaaccctcctctgtctcctgggaaaacacacttccctctgcaccactacatttgacaaccagcttggacgtcctcttgtcccccattccctttcctctactccacactctgcagaggaagtccttgcgcaggacagtgggcagtttgcagaagagattatgtggagaagtttcaggcagagggccagccatggagtgggagccctgggcagaaggcttagccaagtagagtcgccttacttgccccaccagccatacctggattctgcttccaacccctcctactaccccaccctgcactgggcctgggcctgggcctgccagctgagtcctcaagggccttggaggcatgctagagaaacaaaacagggtgtagggctcatcaagccccagggtccccctgctgcttccagcatcagcagcctggggcaacctacctccccagcaggaacaagaggcagaggacaaggtttcgggcggcagaggttgcagtgagctgtgatcctgccactgcactccagcctgggcgacagagcgagactccgtctcaaaaacaaacaaacaaataaacaaaatgccttgggccaggcacagtggctcatgcctgtaatcccagcactttgggaggctaagccggcagatcatttgatgtcaggagttcgagaacagcctgaccaaaattgtgaaatcccatctctgttaaaaatacaaaaaaattagccagacatagtggcacacatttgtaatctagctactcaggaggctgaagcaggagaattgcttgaacccgggaggtggtggttgcagtgattcgagatccgtgccactgcactgcaacaaagcaaaagcaagactctgtctcaaaaaaaaaaggacaaggacaaggtcagaggcaaaacaggaggaacagaggaaggaagggacaaagagggaccccaatgcagactggacgagtgcagagggcagggatggaaagtcacgtcctgagctgtttgctgttgcagaatctcagcagctgggccataaagaagggacttgacgctgtcccagtctctacacttggcacccttgacctctctcatcccacctttccctaggccgaggtcacacctgctttcattttgtttttttttgttttttttttttaagacggggtctcgctagattgccctgacgggagtgcagtggctattcaagggcaccatgatagtgcactgcggcctggaattcctgggctcaagcgatcctcccaccccagcctctcgagttgctgggactacaggcgtgtgcccctgcacccagctgcgcccgtttttgtcctcctgtctggcttctcttcatgatccccacccctttattcggcctcaggggaaccccgtggtctattccgtgagaccgagcagagttttggggagccccgactcttggatctccctgctggctcacctttctctgttcggtctccaaaccagaccagcaatggccccaggaagaaggtggcgctgggagaagttccctaagctatgtatgcctacctgtccccttcctgacttttcggttccccaaacccgaggctggacctacctttaatcagatccacgatgcgcagctcgaagggaatgtcgttcttcttggcaaagatgtaaacagcgcggcagggctgggacagcaggtccaggtacagctccaggcccatagtggggaccgaccgacctgaccggaaaccagagggagtcagcaaactccagtgccaggactcgggtctcggacctcagaccacgcccctgcggctacgcaccccgaccgctgtgccccattgggcggcacggacgcctgggacactctttagtccaattgcgggcggcgggcggcctgtctcagggctgggcccgcctggctcctgtgggatcagggtgggtggccaagagaccgttgtctctcagggggacgcacagagaggccccagtcccatccctttcgtgcctggctcgctcatttcacttagcataatgtcttcaaggtgcatctgtgttgaagcgtgtgtcagaatttcccaccgtccgcattttagaggaggagacagacactgaatgattatagacccagaaagtctggctccaaagtccatcctcttggctcaacactgcagagtccttggtgccagcaagtggcaaagcctcagggcttacgttcagtgttttgtggtcactcgcttcactgcagtcgcactccctggaatgtcacagccttggtcttcctgcccctgccagcacagtgccatctatcgcattccctgggtttatttcttcctttctccaggcctgtgtttctccatctttaaaatgacagggaagctagagccctccagagtccttgcaagtccacccccctggattcatctgctgagccgtaagcccaggcctgccccttgctgccatggagcctgtcaaatagtatcagggtcacatgtcattttctaaaacgaatcccactgaaagtgtgtcagccaacgcataatgttttctagagaataaggaacatttctgcaaataaagtggaagtaacaactgttttattttatttagatagagtctcactctcttgcccagggtagaatgcagtggcatgatcacagctcactacagactccaactcctgggctcaagccatcctcccatctcagcctccccaagtagctgggactacaggtgcgcacaaagacgcccagctagttaaaaaaaatttttttctgtagaggcagggtctcactatgttgcctaggctgatcctcccacctctgccacctgctgggattacagatgtgagccactacaactggccagtaataatgatttttaactggaaaaaaaattaaggaaagatgagaaattcagatttccatgttaaagttttgaaaggaggtagacactcagagaaggcaatggctgccttatcctcacctctggataactccagtcagaggcccaaggaggagctgtcaggattctggttcaaggctcagcctgtcttttaagttcaaaacctaatttggggcgggagtggtggctcattcctataaccccagcaccttgggaggctgaggccggcggatcacctgagttcaggagtttgagaccagcctggccaacttggtgaaaccccatctctgctaaaaatataaaaattatctgggcgtggtggcatgcacctgtaattccagctactcaggaggctgaggcaggagaatcgttgaactctagaggcagaggttgccgtgtgccaagactgcgccattgcactccaggctgggcgacaagagagtaactccaactaaaaaacaaaacaactaatttggtccacgtttcaggattgatcattttctttgggtctgactcacataaaccaactcacaaaggctgtatttattaatttatagaaacaagataaaagtgagagtgtgtgggttggttcgtttgtttgttttttgactttgcccctctctgtcactcaggctgaagtgcagtggtgcaatctctgctcactgcaacctctgcctcctgggttcaagcgattctcgtgcctcagccacccgggtagctgggatttcaggcatgtgccaccatgctcagctaattgtatttttagtagagacagggtttcaccatgttggccaggctggtcttgaactcctggcctcaagtgacctgccagcctcggcctctcaaagtgctgggattacaggcgtgagccaccgtgcccggcctagaaagaagagaaaagtcatttagacagaatgctcccaaccattgctcagtgctctcttggcagtgtagtctcctaggaagcctcgtgggtgttactggccaggaccaggtccgttctgcccatgcacagtaaattaatcactgtgacatgagttttgcaaaagactaaagatttattcacaagggtgccaagcaaggaggtaggataatagctctcaaatccacctccccgaaaataaggcttagggataagccttgcttccaagcaataaagcacagaccccagtcacactcaaggggagggggctatacaaggatgtgaataccagtctgcctgcctcgtgggcctacaacgcagaagggccatgcacttggtttaaaactttgttgttgctgtcttgacattcttaacaatttaaaaataagggtccccacattttcatgtgtagccagtcctgtccaaggagtccaaagaggtcatgagggtggacaggtcactgtctcctctgggcagtgatggggccactagcagttgttctgtagtctcctagcccctaccccagggccacaccttccccatggtctctcacattcttttttttttttttttttttttttttgagacagggtcctgctgttgcccaggctggagtgagtgcagtgctgcaaactcagcttactatagcctcgacctcctgggctcaaacaatccttctgcctcaccctcctgtgtagttcggatcacaggcacatgccaccatgcttggctaattttttgactttgtagagagggcatcacactttgtttcccagggtggtcttgaattcctgggctcaagtgatcctcccacctcagcctcccaaagtgctaggattataaagatgtgatccgccgccccggcctctctcacattcttggcatttaaagttaccgtcattgacaaggaacatgggtacactccaatttactcaagaaaaaaactcttttctccattgaagagatatgtggcctggctgcttcctactctagttgaggtcttctttttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagcagcagccttgcctgggagcttgttagaaatatactaacaggctcccacccccaaacccagacctactgaatcagacagagtctgtattttcataagatcctcagatgatccaaatgcgccttaaactttgaggagctttgatccagaacctgggctggaggcccctgggggccactctgttcctcacagactgcaaggtatgtttttttcttgcctcttctctctgtcctaatgtctccttctctctgtgtctgaccctgaggaccctatgacatcttcccaggggagtttccactgtcaaagagctgattctctctctcttttttttttttttgagacggagtttcgctcttgttgcccaggctggagggcaatggcgtgatctcggcttaccgcgacctctgcctcccaggttgaagcgattctcctgcctcagcctcccgagtagctgggattacaggcatgcatcaccacgcccagctaattttttgtagttttagtagagacagggtttctccatgttggtcaggctggtctcgaactcctgaactcaggtgatctgcccacctcagcctcccaaaggcatgagccaccatgccctactgccagaggcctgattctctagaatctgatgggctcttctagacagcaatctctacctgggctcttgttgaagaagccaatcagctcattggttggaggtcacatgatataaaacatggccatcttccaagccctatgtgtggacaacgagatagggacaagtaggcatatcacgttctgatacctggacccacatctgtcgctgggcccacgtctgtcctcaggcccccaggatatacttttatggggagttttcctcccttcccccaatgtggtcactcataactttacacccaacagtcaaacaggagtggaagctacagagtttcacgcaaacaataggctaggctgtgggactgagtaaaaggcactggactgtggtaggtcttactccaagatggccaaatggaagggcttttagctttctttgtttttgttttatatcctgagacaaaatgttcaatttctacactttagaataaaaagagccatattttatgtttcatattttttgtatgcttcctttcatactcttttgaacaatgcaatcatattttcattatgaggtataattcacataccataatatccgctctttcaaaatatactttaaaattcaattggtttaaagccaattcattggtttttagtatattaacaaagttttgtcaccatcacaattatctaattctagatcattttcatcacccctaaaagaaactctgtacccattaaacagtcactccccatttccctcttctcctagcccctggtaaccattcatctactttctacctctgtggacagtaagtatctgcctattctggacatttcattcaaatttaataatgaaatatgtgagcttttatgactggcttctttcatttaacataatggtgtcaaggttcattcatggtgtagcatataacagtacttcatcccttcctgtggctgaattatattccattttatgtatacaccacattctgtttatccattcaccagttgatggacttttgcattgattctacttttcagctattgtgaatccccatgctgtgatgaacattcacgtacaagtttttgtctggacatatgtcttcagttgtcttgggtatacacctaggaatggaattgctggataatataattctatgttggccgggcacggtggcacatgcctgtaatcccagcactttggaaggctgaggtgggtggatcacctgaggtcaggagttcgagaccagcctggccaacatggcgaaaccccgtctctactaaaaatacaaaaactagctgggcatggtggtgcctgcctgtaattccagcctgtaattccagttactcaggaggctgaggcaggagaattgcttgaaaccaggagacggaggttgcagtgagccgagatggcaccactgcactctagcgtgggtgacagagcaagaatctgtctccaaaaaaaaaaaaaacaaaaaaaacaaaacaaaactaacccatatatatataatatgttatatatacataataatatattttatatatatgtgtatatatgtttaacttttggaggaactgcaagctgttttccaaagcggttatacattttacattctcagcagcagcacacaagggtttcaatttcttcacacatcctcaacaatacttttaatctgtcttttctgttatacccctcatagagtgtgtgaagtgatatctcattgtggtttgattggcaatgtcttgattatagtatctttgtactaagttttgaaattgggaagcatgagtcctacagctttttctttttcaaaattattttgaagattctgagtcactttaatttccaaatgaattttagggccaatttgtcagtttgtgcaaacaggccaagtggaattttaatgcagactgtgttgaatttgacatcttaacattactacaccttccaatcatgaacatgggatgtctttccatttattaaggtcttctttaagttttcccccaacttttaaattatgaaaacatttaaaatccagaaaatgaaaggactagtacaacagcactaatatatgcaaccccagtttcaacttactgttttttgaacataagataccaacatcatgacaccccacctaaggactttttagcaaaacattctaatttctctactgggattattgtttgttgtcttcctccacaataatgtgagcactaaaggtagagacttttgcgtactttgttcactactgcttcctctgcaccaaaaacactgcctggttgtgggtacttttctagttttaggaaggagaagacaagatataggtcctgactctggttctgcctctcattcatatgctactccgaggatcccttccccttgaagaacttgtttcttcatctacgaaatggggataatactactactcatcagggtggttgtgaggattaaacaaggtaagagatgtaaaattgcatgttagttatcagatagttttgttttcccatctagctccatgagggagaggatttgctctagtccgtccgtctgggctctgggcttctaatgggcagacaccttcctccatgatgtttgtagctgcaaagcctggcacagtccctcaagacaagctttttgacttgaactgctgatggtcttccatgcacaattcaacagaaacccagtagcatacacttccttgtatgcacttgcccctctttttacatttattacacattcattgctacctaataatccccgatacttatcttttactttatccaattattcaacagttttcaacagaaatacctagaagagagctattccgacttcattagaccctgagattctatttttaacatttcttccatggattgttgaatgtttccaatgattgatccaccttcccttggccttatctgcattccagatttggttgtgtgtccatctctgtgttgccagacttacctcacagacccagcttgaacacaagatgggtgcttgctgaagagcaggactcattctgttgaacctgcatgctttctcaggtcagattgcttggtggtgcttctttaatttctttcaacagcacattgtagtttgctgtgtttaagtgttgcttttctttggttaaagttattctaagtattttattctttttgatgctattgtaaatgaaagtgttgttttaattttgtttttgatcctttactgcaaatgtatactattgatttttgtgtattaatcttgtatcctgcaaccttgctgaacttgcttatgagctctaatggtttttaagtgagttccttaggagttcctataatgtcatctgtgactaaagatagttttacttctttctttccgatctggattccaccttgttcctttttcttgcctaattgccctaataaatagaagtagtatgaatgaacattcttgtcctgctcttgatcttgaggggaaacactcaatctttcacaaggaatgaagtatggtgtttataggtttttcatagatgctctttgtcaggctgaggaagttcctttctagtcttcatctgttgagtaattttatcataaaaggatgttagattttgtcaaatgccttctctgcattaggatgatcatgtgactttctattaatatgaagtgctatatggattggtttttgtacattgaaccacatttgtactcctgggataaatcctacctggtcaatgtgtataatcctcttaatatgctgctgaatttgatttgctaatattttgctgaggatatttacatctatatttataaggatattgctttgtaactttattttcttataatgtgtttttctgtctttggtatcagggtaatgctggcctcatagaatgagttgaaaaatatttcttcctgttctattttttagaagagtttttgaagggttggtgtcaattcttcaagcttttggttgaattcaccagtgaagctatctggtcctggacttttctttgtagggatttcatttattgatttattgatttattttttgagacggagtctcgctctgtcacccaggctggagtgcagtggtgcgatctcggctcactgcaagctccgccttcctggttcacaccattctcctgcctcagcctcccgagtagctgggactacaggtgcccaccaccacgccccatctaatttttttgtatttttagtagagatggggtttcactgcattagccaggatggtcttgatctcctgacctcgtgatccgcccacctcagcctcccaaagtgctgggattacaggcatgagccaccgcgcccggctttttggtaggattttaaaaaaattaatattttaatatctttacttttacaggtctattcaaattttatcttccttcttaagtccgttttggtagattgcatgtttctaaaattttctcatttcatcgaggttatctcatttgttcacatacaattattcatagtatttctttataaacctttgtacttctctaataccagtagtgatgtgtccattttctttctttctggtgtctggttttttggtttttgttttttttgtttttttttttgatataaggttttcctatgttacccagactagagtgcagtggtgcaatcacagctcaatgtaaccttgaattcctgggctaaagtgatcctcccaccttagccacccaatttgctaggactacaggcgcgcaccaacacactcagctaattttttctttcttttttttttttgagacgaaattttgctcttgtcacccagggtggagtgcagcagtgtgatcttggctcactgcaactctgcttcttgggttcaagcgattctcctgcctcagcctcccgagtagctgggattacaggcgcctgccaccatgcccagctagttttttatttttactagagatggtgtttcaccatgttggccaggctggtctgaaactcctgatatcaggtgatccgcccgtctcagcctcccaaagtgctgggattacaggcatgaaccactgggccttgcctcctagctaattaaaaaaaataaataactctttttgtagaaacaagtctcactatgttgcccaggctggtctcaatctcttggcctcaaatgatcctcctgcctcggcctcccaaagtcctgggattacaggtgtgagccattgcacccatcctccactttcttggtgaataatttgagtcttattttttcacttggccattctaactaaaggtttgccaagttttgttgatcttttcaaagatccaatttttggtttctttgattttctctattgtttttctgttttccatttcatttatctccattctaatctttattatttcctgtcttctattggtgttgggtttattttgctcttatttttctagttccttaaggtgtaaagttaggttattgattgaagattgttcttctttaacttaggtgtttacagctataaattttgctcttagcactgcttctgctgcatcctataaatttgggcatgttgtgttttcatttttattcattcaagatactttttaatttcccttgtggttttgtctttgacccattggttgtttaagagtgtgccgtttaatttctatgtgcttgtgagttttctagttttccttttgttcttgattttaaactttattccactgtgtccagagaacaccctttgtatgatttcaatcttcttaaatttgagacttaggaccaaatatatgctctatactggagaatattccatgtgctctttagaagaatgcttattctgctcctgtcgggtagaacgttctgttcatgtctagtgtgtgcaattggtttacagtgcttttcaagtcctctatttccttgatggtcttctgcagtttttctattactgaaagtgggggccaggtgtggtggctcacgccccgaatccctttggggattcagggtggctcagcactttgggaggctgaggcgggcgatttgcctgagctcaggagttcgagaccagcctgggcaatacaatgaaaccctgtctctactaaaatacagaaaaaaattagctgggcatggcggcatgtgcctgtaatcccagctactcaggaggctgaggcaggaggattgcttgaacctgggaggtggatgttgcagtgagctgagatcgcaccactgcactccagcctgagtgacagagtgagactccatctcaaaaaaaaaaaaaaaaaaaaaaaaaagtcaggtattgaagtcaccaactattattactgacaacgtaatcatatttaaccctttacttttaaaattctttttggaaactggaaggatctgtaaccaccacccacttccacatcagaccctatgcatacgccaactgtctgttgctcagcagctgtgatgttgttccagttctttattaggcaaagaacagttgtttttttagcatttcctttaaggaaggtggctcagatcattgagccagccaggccctgcaggatgggctgcgattagggtcacaagtacttctcccgaaactcacagattttcctcgtgaccattggatccaatgttgaaaagtcccagtcggccaactgcattagtcgatcatgggcctccctaaagaggccacagccaatattcagctccacccgcatacgccactcagctagcttggagctgttgaggaagacattatagttggctgccatgggctgtggatagacaaagacgaagatgtggtcagcctggggaccagccccacctgggtcctctcccacagcctctggcccacgtccctaacatctacctatggaaagaattaggctgctgacccccaaggcctgagcaaggggtcacagactatgtaatagatgtaggtggggatggaggatccagaatccctcagagtcctcagtcactggtcttcttgctccaagccttctgaaccacactgagagggctcctggcccaggcagctcccacttctccagcctgcgacctcgcatgaatcctgccttcttccagggaaaccccttatcccaggtgtgtatatgcggatgagggagagaactcaggttttttcctccatgtttagactcccactatgatcaagctcaggggctaagatgggagacctggcgggcagtctaccctgcagtttcgctggctcactaagacagtctaccctgtagttccgtttgcacccaagatctttgggaagccaaagaaggggtgggtcgttggtgaaatgtaaggggtggggacgaagtatatggctgaacccttggggcaggccagaatgatttttcctggtgctggtctgccctgcaaacagaccaaagagactaattttcgtatcaaccagagatctctgcaatagggaaaagaacactgtatttcctggtcaatccaccaggatcccaggtgcctcctcctggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttccttccctgttatctttgggatcagcaactggccagggttgggaagaggagggaagaggaggctgtactccagggccacctgccctgccaggtctctgtactcttgtctgctggatagatattgaacacttcccaggatataaagcagtttcacctcttttagcagttctgattggtggaaggtgccgggaaccatgcgttcacaaggatttggggagctcagcaggcataagtcctgtgattgattagtgatgccggtcacaggcatggaatttgaagtagagacacgtgtactggttatttgtcatcttccaattttcttttttcttctttttttttttttttttttttttttgagacggagtctcactctgttgcccatgctggagtgcagtggcgggatcttacctcactgcaacctccgcctgctgggttcaagaaattctcctgcctcagcctttggagtagcgtggattacaggcacatgccagcatgcctgggtaacttttatatttttagtagagatggggtttcaccctgttggccaggctgttattgaagtcctgaccttgtgatccgcccacctcggcctcccaaagtgctgggattacaggcatgagccactgtgcccggccatcttcaaattttctatgagccatttttttttttttttttgagatggaatctcactttgtcacccaggctggagtgcagtggcatgatctcggctcactgcaacatccacttccctggtttaagcgattctcctgcctcagcctcctgagcagctgggattacaggtgcccaccaccacaccagctaattttttttgtatttttagtacagacagtgtttcacaatgttggacaggtaggtcttgaactcctgacctcaagtgatccacctgcctcggcctcccaaagtattgggattacaggcgtgagcactgctcctggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcgggtctggcgggcaccagtgcgatggtgcgctgtacttgcggcacaggtagtaaaggatggccgcgctgcagaaggggccggtcaggggcactgcccttgccttcctgagtgccactacatcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacggagggtagcccctggaggtgcagggaggttatggacttaatgcttaagattaggcattatataagccagggcatgaaaggatccatctctctggtgctggatggagggtgagcccgagggggcagaatggacaatgagggggccagcaactatcgggaaggttgtggtgtctgggaatgttggaggccatggggacagagggaaggggatggaggggagacatgcttcggaggggatgtcctaggccttgctgattgatggctggtgtgggaacctccgcagcacaagggctcctttatcatcaccagcagcaaccatgccaaggtaaaaaggtcagggcatggagagagctatcggttaaaaagtggcaggagagacagcaactggctgcaagactcagaacttcttggctgggcacggtggctcacgcctgtaatcccagcactctgggaggccgaggcggggggatcatggggtcaggagatcgagaccatcctggttaacacagtgaaaccccgtctctactaaaaatacaaaaaaattagccaggcatggtggcgggcacctgtagtcccagctactcaggaggctgaggcaggagaatggcgtgaacccgggaggcggagcttgcagtgagccaagatagcgccactgcactccagcctgggcaacagagcgagactccgtctcaaaaaaaaaaaaaaaaaaaaacttctttggatcctgatccaaacaaactgccaagaaaatgtttaggagataatcatagagttttgaacaggagccacatattagatgaaatccaggaattattgttaattttatgaggtatcttaatggtatcgtagtgatgctacgctctatcctagcccaggctggagtgcagtggcgcaatcagagttcactgcagttctgaacttcctggcctcaagcgatcctcccgtgtcagcctctggaagtgctcggattataggcatgagccaccacacccagcctgttgctttttttttgtttgttttaagaactcttatctctgaaaagtatgttcctaaacatttattgatttatttacttatttatttttatttttgagatgggatctcactctgttgcccacgctgaagtgcaacgacgcagtcttggctcactgcatcctctgcctcctggctcaagcagtctttccgcctcagcctcccgagtagctgggactacaggtgcagaccaccatgctggctaatttttgtattttttgtagagatggggttttgccatgttgtctaggctaggctggtcttgaacacgtgagctcaggccatcccctcacttcagcctctcaaagtgctagaattacaggcatgagctggcttctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgcttgcactgaacctcccaggagaagcagagacagatggtgcaagggccccagggaagacttacctttcacttaagataaatttcccatctttgaggctgggcagcttcctgagggggttgatgtcaatgtatcctttgctgtggtggtgacctgggaggggcagggaaggtctgaggctgtgggactccaggggagagagaactgagactcccagagacccaaacgcctccctctctattttctcaagaagagggaactgaggcccggagggacattgcgtctcaccccaggtcacagggcaaggcagttgcagaaccggactgcgatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagcttttggagtccctctgtgctggggatggagttggagcccacccctctgaccctcactcagggttagtggagccctgagcctttctgaacactggggaggatgggtgtagacggactgtgcacttctgccccctttgccaacctggtgggcaggtgctgagttcacaaggtcctagaatcccacaaggaagccagggtgcctggtgggagcccagggagtcccagctactgttccttcccccttctcctcgaaaagcctgttcatctgtggcgtggggactgtcattagtgagcactgactaaggtaggctggacaaggatgcagcctacaagccgcgtggcatcttttccttccctgtggacctctggggtgattcccttgtctctgtctctgctcctcagaaacgcccctatcaggctgtgcgcggtggctcacgcctgtaatcccagcactctggaggctgaggtgggcagatcacttgaggtcaggagtttgagaccagcctggccaacatggtgaaacccctgttaaaaatacaaaaaattagctgggcgtggtggcatgcacctctaatcccagctactcgggaggctgaggcaggagacgcacttgaacccagcagaggttgcagtgagccgagatagcaccaccgtactccatgctgggcaacagagcgagactccatcaaaaaacaagaaaaaaagaaaagccgcaatctgtgtgtcctgcctccccccaggaccaggcctgccaggcagcagtgggagttgacctttcagcagatccacaaactgaaagttgaactggatgtcatgcttcttcgagaagatgtagacggcacggcagggtgctgacagcaggtccatgtagagctccagtgccatgttgagacacatgccaggccccacagccgcagttggccagccacagacctgggcctatgtctggccagagtccctggccctgtgccctctccgatctgggcccaggatcctgtgttccccagggaaacctcttgtttccctttgtgttgtcataaggccaggaagcctgcaattctcacagcatcaaggattctaaggaggcccaggagtaggctggggagaggcccgtggcaaaggtgtggcagccgtgaccctactctcccccttccacgtgtgcctgtgccccgtggtgccacctcacagacaccagtctgagaagggattatgcctgggaattcccacggctggattttcattgcagaacctgacgaaaggggctttgcagggtccagaatgaagaggaggcaatgagaattatccctggaggattctagaagtagaggctgggagtatccacaggtaaatcgagcctgaactatgactagaaaggaattgggagaaagagacacaggtgaatcgagcctgaactatgactagaaaggaactgggagaaagagacacaggaaactgtgagctttgggagcaatggggacaccaccaccaggaagtcagggggcactcagccggtgtgtgccacacagaggagcctagaaacttcctggccttggttggggctgcagtggccagactgtgtacctggtggccaaggaaggtaactagagccccacgtagaggactgagtgccactcactctatgctgtgatctaataggtctaggctgagaaatgggactgaccccacttctggtgacagagtaagcctggagacaagcgaagagcatgcagtgtgtttattgcagacagcagggtgcagtggagtgggctgcacccactgcacctgcttctgggccagctgggggtcccgccaagcctcactgtggttcagaggctggagtatgagcttgtgggcctccagcaagagctcagtaccaagggcagccgccacacgggcctgccacactgccagccggggcagtcttggaagaggtcgcagccaacggcagtgggctgggaagacagggcagctggggttggggctcagccccatgcccagagtccccccagagggcaggtgggtaggaaagcttcacctgcatcacctccgtcagcaccaagtcttccagggagatctgctccattgccaggaagggcctggccaccagcaccccccaatccaggtgctgcagggctggcatcagcctccccaacagccgctccagctgtgcagcatctgcaggctgtccggagaagtggggcaggagagactgggctgggaggagaggagcaacttaacccagactcttggaagcctcttgggcctcctctccatcccttcccggctgccactcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtgccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatccgggtgacctacgtcctttccccacctgggcagctccagctggctcagactctagccaggttccagcctccagctttagcccaaaggtgcccctgggtccagcctctgcatcggagctacacaggctgaaatgaggaaggggcctcagtgatttggaaagatctccaagccaaggaaagatctcccctctcgcctctgcctccccctacaactctgagccccagaacccaggcagatcctggctctgaccctgggtgggcaccaggtcaccattacctctttgctagtaggaagtcgccatctctgagggcaggcaccttccccagggggttcaccttcaggaactcaggcttcaggtgctcccttggtgggcagaaaggcgagaaggctcagtgtagggcctggtccttggcacccactccatggggcccagcccagccacctggctcaccccaagccaactccaccatccacagctcaaaagggatgtcattctgtcttgcaaaagtggatagtgtgtcaggtccaggaagagctcaagccccattgctgctcctctcacctgccctccccagaattctggacctccaggagttgctcagcccttctccactagttctgagctgtttcctgtccatagtctgctgtagtgggccagagcacagggcagatttgtcttcagggactttctctgggcattcctgggcagagaacttcatcttctctgttaactcttgctgataattctctgtagctaggcaccttgtaaaacccatgtcccagaatgccaaacctggaaatgcaatgtcagcgccgaaactgcattgaaactgaatgaatgaggtccccaccctcttatctaaatatcctatcagtctgttgaatgtcaaagtatgtaggggtggtgtgggggagcctatagggagtctccatttctgtagctttccacatgttccatgcagaattttcctctaatgacccttggacaccgtggtggtcactgtttccctgcataaacctttgatgatccttatctttagcgtaccagtgaaacaccaaattcagattttcagtctgtgcagtctatgtagttaataaaatcaatttctaatggaatatgcctgtgcctggtgtgtttgtacctaaccactgctaaggactttcattgatagctagaccttggagttccttcccctggacccctgacccaagtattttgcactcattcctctgccagtgtgtttcatggtgtcctgcttcccagagtgcctcagggaatgcttgcattggatataaatgaatcgttgcggtcaccatggatgggattcaggcctaactctcaccaagaccataaggccacagtctttgatatagattccccatgttaaatctgccatcctcagtgtagtgagagtgatattgagagagaaaagttaggtaattaaggtgggtccttggtaaaactcctttaaacagaggaacagcctgaaaaatcaggcttcaggcacagataaggaaacttgcacaaacctctggctcactcagataaaggaacaatgcccaacacagaaacacctttgatctttgtgcctaaggcatgcccacagctactttgataagggaacaagacccagcatagaaatgcctttgtcctttgtataaccagtgggcttccaggaaatagtctcttctccttttgtggacatgtacacggtgggctacagtgggttccagtgggcactttcctttcttggacgtgctttagaatgtgagcctctgattggtcctgggccaggctatcacttcagctcctgattggtccctcaaggtccaggggccaagctgagtagtgctttctccaagaccagtcagtacattccttcctttcccagtccataaaaccccctgacccagcctcataatgggcaacctgcttgggccccccgccagctgcaatgagctttcttcatttgcttattaaacttttgcttcaaccttaccctttgtgtccacactccctaattttcttggtcgtgagacaaagaattctgggtgataccccacaatgagagactggtacattgtggtgcacgggcaagactgcaacaatatgttttctgcttgcttgtttggactggcctcttcctaactctccagagtgctctctccccactgtggccctgagctttgcctcacggtaacactgtgctgcatgacactccagcatgatctgcatgtttctcacctccggaccttccccacacaactttcttgctgcttggaccacccttcccacctattttcaactgtttctctccagcgcatctttcatgataaggcttgagtggaagctgtatccgaggctgaaggttatccatgcagctttgaaaccatctgtttatgcttctgtttaccccccaaatactgtttaccccaatactcaaagtcaaggttggtgactcaacaattttcagaacttctagcttatcagtatagctttattgtactgaactgagtttttcaccatgctgttactgtctttgaggttaaaaagcccccaacattcactcctatttgaatcatctgtgcaagactcaagcagctatgaattcaaccacagtgtaaagttcttccctacaatgctttattgttattctagctcccaagagagtaccatctttcagcccaagacccttgacagaaccccttcaactctgtcgccttttttcatctctggaattctgacaccacccatgacccctcttcttgttcatttactaggttttgttcctttttttccttttgtttcaatatcctattgtatctgttccttttgggcttcacatcctttttggaaagagaggcacaggtaatataatgaatgaggatgctcctcctccctggttccctctaagtcaagtttctccaacgcgctggtctgcttggctttgaatgcggctcaacacaaattcataaactttcttacaacattttgagattttttggtgatttttatttttattatttatttatttattaacttatcagctatccttagtgttagtgtattttatgtgtggcccaaaacaattcttccaacgtggcccagggaaaccaaaagattggacaccccgctctaagtgttccccaagtttccactgttttcagagcacatgtcccaggtaataacacacagcccatcatttagtgactgctcagggtgcaagctgtggagaagagagtccgactacgagctggtgctctaagcctccagcacgctaggactgacgacggggatccggaaacaacaagctccactcccgcaacacacacacacacacacacacacacacacacacacacacacacgcacacgcacacgcacacgcgcacgcgcgcacacacgcgcacacacgcgcgcacgcgcgcgcgcgccgcccaagggtagccgtctgcagggccccagctaagcagcccgcggagagcgagcggcgcgtgcgcccccgctgattggctggcacaaccggcaccggagccaatgggagcacgccttgttgtcaggcgcgcagccggacggcgcggtggtcgggacagactggccgttgctgtggagacgcctggtgagttcctggaaggctggtttgaaggcggtgccggggtgggggtgaggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggtgagtgttgttattggtgccatttacaggggtggaaactgaggccgcgggtaggtgaaatgatttgctccaagtcacccagtgggtgagcgcgactccagactgaaaattttgaccgttctgcttcactgcctccccgcaagaggcgggccctggccagatggaactcacctggcattcccaaggtatctgcacaagtggctttgggagtcacttaactcttcaggacctgggttattacaggttataagtgtgggaccgtcggattccatgtggctaagattctttctatgtgattattgtggttagaaatagaatatgcttagaacagtctcgttcagcggtcggcaaacttttgttgtaaatatatcagtgtttacattgttatattgtaagtataatgagtataatagtattcataatagtagtttaggcttggggggtccatactctgtctacttaactgtagcgatgtagtgtggatacagccaaagacaatacataacagactagctgcgtcgcaataaaattttaattatagggaccgaagttttaattttatatattgttaatataattttcacgtgtcatgattttttttcccaaatatgaaaaaatgtaaaaaccattctttgctcgtgggctgtacaaaaagggtgggctggttagcttgcagaaccctcatctagtacaaagcctcatacatgaggggaaacagactgagagactgacatctatgtcaagtcagtcacacagccagggcactgccaccactgagcttaagacataggcttcccaccttccaggccaggaaacatccccagttatcactctggatcagggtgctgaggtctgaaggtgtgctactctttatcgtgttctgaggccatggaaactatattctaaggggtttggaaacttattagcttagactaataagcctggtgaatgtgctgctatctgaggaaatgcagctgctgggctgggagtcagaaatgaatagatatttttctttttcatgattattcaatagcttttttgtgtgtgtgtgtgacggagccttggtctgtcgcccaggctggagtgcagtggcatgatctcggctcactgcaatctccgcctcccgggttcaagcagttctcctgtctcggcctcccgagtagctgggactacagacacccgccaccatgcttggctaatttttgtatttttagtagagacggggtttcaccgtattggtcaggctgctctcaaactcctgacctcaggtgatccacccgcctcggcctctgaaagtgttgggattacaggcgtcagacaccgcgcccggcctcaatagcttttttttttttaaaagctccttttagtgagtttcttggatttatggtgaacaata

SEQ ID NO: 432 - DNA, 57078 bp, Homo sapiens
cataccccattctctagttaatcttaactaggcctcctgtttatattagccacatcaagcctagctgtctactctatcctgtgatcaggatgagcatctaatttgaaatatgcactcatcggtgcactatgtacagtggcccaaacagtctcatatgaagtcactctagctattatcctcctatcagtcctattaataagtggttcatttaatttgtatatactcattggaacagaagaatttctctggctgctcctaccatcatgacctctggccataatatgacttatttccacactagcagaaaccagccgagcctctttagacctaacagagggggaatcagaattaatctcgggctttaacgtcgaatatgctgcaggcccatttgccctgttctttatagcagactatataaatatcattataataaatgccctgaaggccgcaagaggttcgtgggtgcagtgcacaggagaccatatctggggacagcagctgcagcagaccccaagctgggccatccctgccacttgccaggtggtgcttggcgaaggcaagcagctcccacccgcccggggaatacagcgcgacccccggcggcatgctcttcagcaccaccccaggaggtaccaggatcatctaccactggaaattcctgatggagtgttgaaacttacccgtgaccaaaacactcccaagggatctgcccaccattcccggggtcaccagccctgccagtgatgatccccccaacggaagccagccagagccacctgagcaatagtccagaagataagcagggcgggcagtgaagaagcacagttttgagatggacatttaaagcaccagccatcgcatggagcactgccaagggacccctcaggcccttcctggaggagtcccaccagccaggccttatgaaagtgatcatactaggcaggcattggtgtggggccagtcaccccagccctctctccctcactcgcggcacctgccccctcctctttgtgaacaccagcaggtacctccttgtgcctccgctgatgcaggagcagctgccccaaggggagtaacccctgccagcacaccctgcagctgagggccaggaagtggacaagaatgaaccctttcttccaaatgatcagctcttccagcccctgctgggggccccacgaccccttccttaggttgacgtgcctgggaaagctcacctccccctcttccctaagagaggaaataaaagccaccttcgccctagggcaaaaaataaataaataataaatcccgtaatcactattgtcttcctaggagcactgcataacatatatataccagaactctataccacaaatttcgtcacccaaactctcattttaacaagtctttttttatgaattcgaacatcatattcctgattccattatgatcagctcatatatctccttgaaaaaattttctaccactcacactagtactttcatatgacatatcttcatgccagtcctaacctccagcatcccaccccaaacataagaaatatgtctcacaaaagagttactttgatagaataaattacagaggtttaaacccttttgtttctagaattacaggaattgaacctacccatgagaatccaaaattctccgtgctacataatacaccacatcctatcacaccccacagtaaggacagctaagtaagctattgggcccataccctgaaaatgttggttatacccttcctatactaattaatcctccagtgtatgccatgcagaggagcccagaaacttcctggcctgggttggggctgcagtggccagactgtgcacctggtggcccaggaaggtaactagagccccacgtagaggactgagtgccactcactctatgctttgtgatttaataggtctaggctcagaaatgggactgatcccacttccagtgacagagtaagcctggagacaagcgaagagcatgcagtgtgtttattgcagacagcagggtgcagtgcagtgggctgtacccactcagtggagccactcctgcagcaactgcacctgcttctgggccagctgggggtcctgccgagcctcactgtggttcagaggctggagtatgagcttgtgggcctccaggaagagctcagtaccaagggcagccttcatatgggcctgtcacactgccagccagggccagtcttggaagaggtcgcagccaacggcagtgggctgggaagacagggcagctggggttggggctcagccccatgcccagagtccccccgagggcaggtgggtaggaaagcttcacctgcatcacctccgtcagcaccaagtcttccagggagatctgctccattgccaggaagggcctggccaccaggacccccccatccaggtgctgcagggctggcgtcagcctccccaacagccgctccagctgtgcagcatctgcaggctgtctggagaagtggggcaggagagactgggctgtgaggagaggagcaacttaacccagactcttggaagcctcttgggcctcctctccatcccttcccggctgccattcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtaccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatctgggtgacctacgtcctttccccatctgggcagctccagctggcttagactctagccaggttccagcctccagctttagcccaaaggtgcccctgggtccagcctctgcatcggagctacacaggctgaaatgaggaaggggccacagtgatttggaaagatctccaacccaaggaaagatctcccctctcgcctctgcctccccctacaactctgagccccagaacccaggcagatcctggctctgaccctgggtgggcaccaggtcaccattacctctctgctagtaggaagtcgccatctctgagggcaggcaccttccccagggggttcaccttcaggaactcaggcttcaggtgctcccctggtgggcagaaaggagagaaggctcagtgcagggcctggtccttggcacccactccatggggcccagcccagccacctggctcaccccaagccaactccactgtctgcagctgaaaagggatgtcattctgcctggcaaaagtggatagcatggcagggggctgagtgcatgtccaggaacagcttgggccccattgctgctcctcccacctgccctccccagaggtctgtacctccaggagttgctcagcccttctcggccagtgccttcccccaaaatggggccagaactctgtactcctcctgaagcctattccctccatgactggctgggaggcctgccaagcccctctccccttttctccacctctgtagagtggaggcaggggtggccagtgtccctttgggggtttcagatagaaactcaatgacaattggcttagcaaaaacaaacaaacaaaaaaaaaacaacaaaaaaaaaacaaagggagtggggtgggtggggagatttctcagaaaacttctccagtcataggaggggaggggtgtagaagccactaagagaactggaatcagaacctgtttctgtctccccacttttcctcccctctcctcctctcccctccttcccctcctgtcccctcccctcctctcccctcccctcccttccctttccttccttcccttcctcctttcctcccttctttctttgagacaggatctctgtctccctacacttttttcttttaattctctgtctctttcttgacatagaatcttgctctgtcacccagcctggagttcagtggcacgatcatggcttactgcaatctccaagtcctgtgctccagcagtcattccactacagcctctggagtacctaggactacaggtgcacatgaccataccccactagttaaaaaaaacaaaaacaaaaacaaaaaaacccttgggcctggcagggcggctcgtgcctacaatcccagccctttgggaggccaagatgggctgatcacatgagcccaggacatcaagacgagcctgggcaacgtgccgaaacccagtctctacaaaaaatacaaaaattagctgggcatggtggcgcatgcctgtagtcccagctactcaagagactgaggtggcaggatcacttgagcccaggaggcagaggttgcagtgagccaagatcacgccactgcgctccagcctaggcaacagagccagactctgtctcaaaaaaaaaaaaaagagagagagacagatagggtctcactatgttgtccaagctgatcacaaactcctggcctaaagtgatccttgggtctcagcctcccgagctgattagctgggattgcaggtgtgggctaccacgccctgttatcactccctttctctgagtcagcttttctctctcagactagcctactccatgaactcaggaaatgtcactacaggtggccccagctcccatttacctccccatagggagctcctctctccagttccaatttcaaaactcccaaggaagcattctggttcactcgcttgggccactggccagagggatgggatactctgaaagattcagctagagtcccgggcccagccctggaccatcactgtgcaccctggttagatgccagggctgggattcagggagaagaaaggaggttcccggacagtcattcctgcctcctgcggctgcgggctccctgcacagtcattcctgcctcctgcggctgcgggctccctgcccccatcctgtgcacgaagtgggagctcccgctgtctggcagcagctgctctgcaggggacagtctggacggcagaaagttcatccttaaccccagccttccagtcaaggttcccacaagtctgggacacctgcaagtgtcatatcccgctgggtgaaagtctgagatcccttttagaggatcccattcgctccctcccttctgccaccttccagctccgagaaacagagctctgaacgaaccctcagatgtccatgcgctggggcctttccaggacggcggggcgcagtcctttctgggttggggtgacacctggaaacatgtaaggtccctggcacagggacccctcccagtttcaagcgattctcctgcctcagtctcccgagtagctgggattacaggcgcccaccactgcacccagctaattttttgtgtttttagtagagatggggtttcaccgtgttagccaggatggtcgcgatctcctgacctcgtgactagcccgcctcagcctcccaaagtgctgggattacaggcgtgagccaccatgcagggccaatttttgtattttcagtagagacagggttttaccatattggacaggttggtctcgaactcctgacctcaggtgatctgcctgcattggcctcccaaagtgctgggattacaggcgtgagccaccaagcctggtggtaatttataaggggtggacatttgttggctcatggtcctgaaggctggaaagtccaagatcgaggggccagcatctggccagagctttcttgctgtatcatcccctggtgaaaggataaagagagggtaagagagagcaagaggctgaactcacagcctcaaagtccttttataatccacatcaatccatctgtaacggtggaggcctcatgagataaacacctctcattaggccccacctcccaacactgttgcattggggattacatttccaacacatgctttgtgggggacccattcaaaccacagcacagggacaccttctctttccttcctgtgatatgctgaataatgacccctaaggatatacaagtcctgatctctggaacctgtgaatattaccttctgtggcaaaagggactttgcagaattgattaagaatgttgagatggaggcattgtcttggattatctgagtgagccctaaatgcagtcacaagtatctgtgtaagaggagacagacggagatttgaaacagaagacaggagaagatggaagcagagagatttgaagatgctacattgtgggctttgaagatggaagaaggggctacatgacccaagacaggcagctccaaaagctggaaaaattgaggaaaccaattcccctctcagagcctctggagggtgtgcaaccctattggcacctgggttttggcccagagaaatagattataaagttctggtctccataactgtaagagaatagatttatgttgttttaagccaccaaggtggtggtaatttgttataccatccagaggagaggaacacagattttggtgccaggaagcagggtgctgctataaaaaagaaaatctaggctgggcacagtggctcatgtctgtaatttcaacattttcggatgccaaggtgggtggattacttgagccctggagtttgagactagcctgggcaacatggcaaaaccccgtctctactaaaaatatataaattagctggggatgggccgggagcagtggctcacgcctataatcccagcactttgggtggcaaaggcaggcggatcacgaggtcagaaggttgagaccatcctggcgaacatggtgaaacccagtctctactaaaaatacaaaaaattaaccaggcgtggtggcgggtgcctgttgtcccagctactcaggaggctgaggtagcagaatggcatgaacccaggaggcggagcttgcagagagccaagatcgtgccactgcactccagcctggggaacaaagcgcgactccgtctcaaaaaaaaaaaaaattagttggggatggtagtgcatgcttgtagtcccagctactggggagaccgaggtgggaggattgcttgaggctgggaagtctaggctgcagtgacctgtgactgtgacactgcactccagcctgggcaacagagtcagaccctgtctcaaacaaacaaacaaacaaaaatctaaaaatgtggaagtagctttaaatttgggtgatgtgcagaggccagaaaaattatgaggcccatgatagagaaaacctagattgccttgcacagattgttggtagaaatatggatgttaaagactatagggagggctcacgagtatcaactaaacatggtcagagcaagtctacattgccttacagcatacctaagtcatcataggcagctgtaggtagatatatagatattggctgggtgcagtggctcacgcctgtaatgccagcactttgggaggctgaggtgggtggatcacctgaggtcaggagttcaaaccagcctggccaacatagtgaaaccccgtctctactaaaaatacaaaaattagctaggcgtggtggcatcccagctactagggaggcggaagcaggagaattgctcgaacctgggagacggaggttgcagtgagccaagattgcgccactatactccatcctgggcgaccaagcgagaatctgcctcaaaaaaagaaaaaatagatattaaaaatcctgctgctgaggactctgaagaaatgaggaacgtgtttctggaaactggaggaaggaggatcatttcccagaaaaggagcccgtagggaggtagaaagcttagttgaattgtgtccgatagttatatggtgggtgaacttaaagcaacgaagttggatatttagctgaggagacttccaagcaaagcgttgaaggtgaagcctcatttcttcttgctgtttatggtgaaaagcaagaggaaagtgataaaatgaggaaaaagctgttaagcaaaaagaaaccaaggtttgatgatttgggaaattatcagcctgtgcagattgcaaaagatgctaaaattagaagattcgctgtttggaaaacacaactctatccctgtcctggggatcactcaagacttgtatccatagacaaccagatttctatgggcttgaactctgtgtgtgtgtgtgtgtgtgtgtgtgtgtgtgtgtgtgtgtgtgtgtgtgtgtgtgtagcaaggttgggggagcacagtggaaagaccttgaatttatttgtttattttttagacggagtcttgctctgtcgcccaggctggagtgcaatggcacgatctcagctcactgcaacctccacctccagggtggttcgagcgattctcctgcctcagcctcccgagtagctgggactacaggcgtataccactatgcccagctaatttttgtattgttagtagagatggggtttcaccatgttggtcaggctggcctcaaattcctgacctcaggtgatcaggctggtctcaaactcctgacatcaggagatccaccagcctcggccttccaaggtgctgggattacaggcatgagccaccatgcccagccttattatttatttatttatttttgagacaaagtctccctctgtcacccagactggagtgcagtggcgcaatctctgctcactgcaacctctgtctcccaggttcaagtgattctcccagctcaacctctcaagtagctgggactacaggtgcgcaccaccatgacctgctaatttttgtatttttatttatttatgtattattttattttatttttccataagttattggggtatgggtggtatttggttacatgagtaagttcttttgtagcaatttgtgagattttggtgcacctgtcaccccagcagtatacactgcaccatatttgtagtcttttatccctcaccctcctcccactcttcccctcaagtccccaaagtccattcttatgcctttgcgtcctcatagcttagctcccacatatcagtgaaaacataagatgtttggttttccattcctcagttacttcacttagaataatagtctccaaactcatccaggtcactgcaaatgctgttaattaattccttttcatgactgagtagtattccacatatacatattccatatatattcattccatatatatattccatatatgctcattccatatacatattccatatatgctcattccatatacatattccatatatactcattccatatacgtattccatacgtatgtactccatatacgtattccatacgtatgtactccatatacgtattccatgtatgtattccatacgtatgtattccatgtatgtattccatgtatattttccatatgtatatattccatgtatatattccatatgtatatattccatatatattccttatgtatatattctgtatgtatatactccatgtatatattccgtatatctatattccatatatgtattccgtatgtatatattccatatgtactccatatgtattccatatgttccatatatattccatatattccatataaattccatatattccatatatatcccatatacattccatatattccacatatattccatatacattccatatattccacatatattccgtatattccatatagattccatacatttattccatatatattccatatagattccatatatattcagatatattccatatttatattccatatatggaatatatatgtattccatatatatgtattccgtatatgtatgtattccacatatatattccatatatgtatgtattccacatatatattccatatacgtatattccagatatatactccatatgtatatcccagatatatatattccagatgtatatattccacatatatattccagatgtatatattccatgtgtgtatattccatatatgtatattccatgtgtgtatattccatgtgtattccatatatatattccatgtgtgtattccatatatatagtccatgtgtgtattccctatatatattccctatatatatattccctatatatattccccatgtacattccatatatatattccccatgtacattccatatatattccccatatatattccatatatattccccatatatattccatatatatattccccatatatattccatatatatattccccatatatattccatatatatattccccatatatattccatatatatattccctatatatatattccctatatatattccctatatattccatatatatatatatatatatatatatatatacaccctatatatatattccctatatattccatatatatatggagtctcgctctgttgcccaggctggagtgcagtggcgcgatctctgctcattgcaagctccacctcccaggttcacgccattctcctgcctcagcctcctgagtagctgggactacaggtgccagccaccatgcccagctaattttgttttcgtatttgtagtagagacggggtttcaccatgttagataggatggtctcgatctcccgacctcgtgatccgcccacctcggcctcccaaagtgctaggattacaggcttgagcctccgcgcccggcctctgaattctttttcaggtaaatcagggatttcttcttggtttggatccgttgctggtgaactagtgtgatatttgggggtgttgacgacccttgttttgtcatgttaccacagttggttttctggttccttctcattggggtaggctctgtcagagggaaggtatagggctgaaggttgttgttaagattttttttgtcccagggctattcccttgatgtagtctctcccccttttcctgtggatgtggcttcctgtgagccaaactgcagtgattgttgtttctcttctgggtctagctgcccagtgagtctagtcagctccaggctggtactgggggttgtctgcacagagtcctgtgatgtgaaccgtctatgggtctctcagccatggataccagcacctattctggtggaggcggcggacggtgcagtgcactccgtgagctttggtggtttaatgctctatttttgtgctggttggcctcctgccaggaggtggctctctccagaaagcatcaactgtagtagtgtggagaggggccagtggtgggtggggccctaggactcccaagattatgcgtcctttgtctaccactactagggtgggtaggaaaggaccctcaggtgaggacggtgctaggcatgtctgagatcagactcttcttgggcaggtgttgctgtagctgctgtggaggatgggggtgagatgcccaggtcattggagttgtgtgcctaggagaattatggctgcctctgctgagtcatgcaggttgtcagggaagtgggggaaagccggaagtcacaggcctcatccagctcccatgcaaactgaaggggcggtctcactcccaccatgtcctgcaaacagccctccatctggaaacagcaaacagtgtgtttccagatggagggccagacgaattgaaaacttgcctgaggctttccacctcccagctgccaaagaaaagggctttagttcttcctccgcctgtgaaatctgcaagccagattcacaccctcccctgggttctggcccagaggcttctcaccccattcaaattgttacaaagttcagctagagaattccttctccctgtggagctgtggagttttaccccttgctttctggccaccctcctgatggatccctgtggtgccaggcaggaatgggctgcttggggatccagtgagctcccagggcctttctgctgcttcctctgaccctgtattttgctcggctgagttttgtaacttgactcagctccaggaaaagtcggaaacttcttccacaaacaggccttcagcttctccagtgggggtgtgtgctcaggagaagcgggtctccctttcccacttccacagctggggcactcacagtatttggggtgtctcctgggccctacaggagcaagtctgcttccttcagagggtctgtggatcctctcaggattgctggtttgttctttcagtggatctgcagctaaaattcacaatgcaagcctccacatgctgctctgtccggagctgcaatctggctatgcctcccgtctgccatgatcccgaaatccctctccaatttttatatttttagtagagttggggttttgccatgttggccaggctggtattgaacttctgacctcaagttatctgcccatctcggcctcccaaagtgttggtgtaccaggacaagctgcagacaaaacctctgagacaccaagttaaagaaggaagggctttattcggccgggaacttcagcaagactcacgtctccaacaaccgagctccctgagtgagcaattcttgtcccttttaagggcttacaattctaaggggtctgtgtgagagggtcatgatcaattgagcaagcagggggtacacgactgggggctgcatgcaccagtaattagaatggaacagaacaggacagggattttcacaatgcttttccatacaatgtctggagtctatagataacataactggttaggtcaggggtggatctttaaccaagcccaaggtgcagcgccgggctgtctgcctgtggatttcatttctgccttttagtttttacctctttctttggaagcagaaattgggcataagacaatatgaggggtggtctcctaccttattggggttacaggcatgagccaccgtgcccagccaagaccctgaatttaaatcctgactctgtcattcattagctcctgacctcaagtatgccattaactactttgaatcctggtatccttgctgtcaaaggagatgagagttctgacacttataggtccactgtaagacataatttttaaaatatctgtaaaaactgggccgggcatggtggctcatacctgtaatcccaatactttgggaggtcaaggaaggcagattgcttgagcccaggagtttgagaccagcctgggcaacatgatgaaaccccgtctttaccaaaaattcaaaaaaatttagctaggcattggcacgtgtctgttagtcccatctgctcgggaggctgaagtgggaggatcactggagcccaggaggcagaggttgcagtgagccgagattgtgccactgcactccagcctggcagagtgagaccctgtctctacaaaaatgtaaaataaacttaaaaaatgtcaaagcatgataaagtacaggacataaagaccatgattaatctaacacccatcactacaatctttgcctctgttctggcattcccctatgtgtcttcgcatcaccctccttctgggtgactcctttatgttgtatttttttgtttggtttggtttttttggttagtttgttctgagacagagtcttgctctgttgctcaggctggagtgtagtggtgtgatcttggctcactgctacctctgcctcccaagtttgtacctcagcctcccgagtagttgggattacaggcatgcgccaccatgccctgctaatttttgtatttttagtagagacggggttttgccatgttggccaggctggtctcagactcctggctcaagtgacctgcccacctcagcctcctaaagtgttgggactacaggcatgagccaccacgcccggccaccccactcattttgaatgtaagtagattaccaattctgaaatgggttttgagcagtagcaacattgacacaaatttataatattttcaagaagatacttccttcaatatgtaaaatgcaacagatatcatttgcaatcatacatatgtacatatatacatacacacatataatatatatatctcaccatggaataagtctgagctgaaacatgcattacttaaaaaagaaaacacttacagacaggatcttgctccgtcatccaggctgaagtacagtggcacgattgtggctcactgcagcctcgacctcctgggctcaagtgatcctcccacctcagcctcccaagtagctgggactacaggcatgagctacctcgcctggcctgcatgatctttatgaagaatgtcatagaaagtttttgaaagcgattaaagttcacctaaacaagcagggatctatgctgtatgccatgctattattggggaggaaaaaaattctcctctacattcttagggtctctggagatctggaactaagaataaaactgaaataagacagattaacagaagaaaatcattcaagttttgctaaattttcagtgtacatgggtactttcacaagagaatgaaggcctaaagaagtcactaaagtagaaaaacaataccttttttttttttttttttaagacaaggacgggtgcggtggctcatgcctataatcccagcactttgggaggccaaggcgggcagatcacaaggtcaggagattgagaccatcctggccaacatggtgaaaccccatctctactaaaaatacaaaaaaattagccaggtgcggtggcgggcacctgtagtcccagctactcaggaggctgaggcaggagaatggcatgaatcctggaggcggagcttgcagtgagcggagatcgcaccactgcactccagcctgggtgacagagcaagactctgcctcaaaaaaaaaaaatgacaagacaaagcggcttggattatagggagtaaattgtggagaagggactaggacatacatgcggagcaaaattagaagataaggattatttttagtcgtgtgtttatacagatccattggaaccttgattcacagtcacttgtgatgacaatgttcttctcttcctggtaaagggagggtgctttcttatgggaaattgtgtggcctattcttagatagaaaagggcaggtcagagagtctttcctgcatgtgctatttctcaagtgccttcaactcaaaataattaatactccaaagcagcatatttggggtgacgtgtttttaattccttcatttcccctgctgcagactttcctagaagtttcagatattaaaagctgagttggtggctatggagataagagccagattcataacgagggatctacaaatggggagaagaacatagataagaataggaatgaataagctgaaaggaacaggtctgagcacatttccccttatcctgttaaacacacatcccattgctgggacaaggtcagtacagcagaaggaatgcacctcttttgtttgatggagagtgtttagcttgttctttaacaggtgcagcttaggcactatttgtcccagtggatttacacagaccagccttatccaccaatgatcacacaaactcctccttttgaggctgtcagtgtgtccagggtgcaacaattttggaatacagcagaagctaagctattaacttcttttgttgtggttgctgttgttgttttgagacagaatctcactttgttgagtgcaggctggagtgcagtggtgcgatcatggcttgctgcatccccagcctcctgggctcaagtgatcctcccacctcagcccccagagtagctggaactactactatgccctactaatttttaaactttttgtagagacagtctcactatgctgcccaggctggcctcgaacttctgggctcaagtgatcctccctcctcagactttcaaagtgctgggattagaggcctcagccaccatgcccagattgctttgacatcttgaggccttactgatccaggagagactgcccctccctgggccagctaattcctacagagaataaatgatttgcttatggtgtgccttcgatgggccaatcaaccgattcgtatctccaacataactttaccagccacctttcagcaggttcctgccccaaatcactccagggacaggtaccaggtaacaaaggaccactcctataacccagagcccatcacaattattaaaactagccagtcctaagtctgtttaccctgtcttgccttcttgcaaaaaacacagtaaagccttttgtccaccttttgccctcactcattctgccacctgactgaccctggtgcttccccatggccctgcatggtgtggcatgtcccccctattgtcttgggaactgtgagtaacaaactttcttttacatggctatcacctctgatctgtggcctcgccatacctgaataaagccaaaatcccaggtacattttaaaacaagtctacaagtcaaggaataccaaggatttccagcaacaccagagaggccggcccacgcccggcctgactcttactgttaatcactagttttgcatttctcttgaggaactagtcaggaggagaaaacctagacagcagctctcctggtcaagacccagtcattcagaagcctaaatggcatgcctaggtgcttggctttaaactgttagcaggtatggagtgctctgattgtgttttagaataatattctgggctgggcacggtggctcacgcctgtaatcccagcactttgggaggcggaggcaggcggatcacgaggtcaggagattgagaccatcctggctaagatggtgaaaccccgtctctactaaaaatagaaaaaattagccgggcgtggtggtgggcgcctgtcgtcccagctactcgggaggctgaggcaggagaatggcgtaaacccaggagtcggagcttgcagtgagccgagattgcgccactcattccagcctgggcaacagagcgagactccatctcaaaaaaaaaaaaaaaaaaaaaaagaataatattctggctgctgctggaaggcagccagggaggaagcaaggacattggatactgcagtaatcctggccaaaggcgacttgtgaaaaggggtgggcaactgaaggggcaggagaatgtggcccctctcagtctggagagagctgcagcactaggccaggaaggcactcttctgcggggggataggtcttaaatggggaccatgggattgggtgcagtggctcatgcctgtaatctcaacacttcaggagtctgaggcaggaagaccacttgagcccaggagttggagaccagcctgggcaacatagtgagaccctgtctcaaaaaaaaaaaaaaagacaatttaaaaactagccagatgtgatgcctgtggtcccagctacttgggaggctgaggtgagatgatcacttgatcacttgagccctggaggtcaaggctacactgagccatgatcatcccactgcactccagcctgcgcaacaaagtgagactcttatctcaaaaaaggcgacaggtgggaaccatggggaaccagagaagcaaagctattctcaagttttccagtaaccatcctcttgccaatggtctttctctgaatcttggatttgggaataggattttcctgccttgggaggctcccttgggaaatgggagtgtcacagccacaggcatcaaaagccctagagttgcacttgaatagtgggtagaaagttctgtgcaatgccaggcactgttggaaacctctgggtagggcttacagggccttagccatctgtgggaggcattagctggagtgtaataaatatgaccctcaggactggggagaaacagctcattccttcatgaggtgtggggctggcagccttgcaggcagccagccacccttcccctctggcctccatcctgggcactgagccaggcactgggtaagaaggctgctgcacctcctttctcctcttcccttttagagagaaagatacccccagccgaggatcccagaaaggcgagagcagacgcgccattgattggcccaaagttctccggagccaacctttgagcaaggagggcgtggctgggctccagtctcctagtgaggtgcaccactgcaggcttggtgacccagccgttcctgcccgctgcccccaaccagccgttcctgcccacagttcctgttcccgggcctgtccccgggtttgtccccagggcccgtcccctgggtttaggtctaccctccctcgccccaccccatcgccctcgccatgggtctggagctgtacctggacctgctgtcccagccctgccgttcagtctacatcttcaccaagaacggcatccccttcgagcttcgcaaagtggagctgaccaaagctgggctgggcaggcaggcccaggggatattggctgcggatccccacctgtccccactgctttgcagtcgggccgagaatgcagactaacatgaagaatcagactctctggtgtggaaactattacgtaattatctatgttattatttttactttttggagacaggagctaactctgtcactcaggctggagtgcagtggcacaatcatggctcactgcagcctcgaccttccaggctcaagcgatcctcccatctcagcccctcaagtagctgggactacagatgcccaccgatatgcccggccaatttattattattattattattattattactattgagaggaggtcttcctgtgttgcccaggcaggtctcaaactcctgagctcaggcgatcctctttccttggcctcccaaagtgctgggattacaggcatcagctgtcatgccctgctggttgtttattttaaaagaggcttcatctttgcttagtgaatacaaagcattcttcaaaatacaggttaagagggggcagagcagatgcagcaggagggcagggaaatggagtggggctagaatatcttcaccccatgtgcttggaaaaaacaatgaaactacctccttgtttcctaagtggagtagtccttgtttacctctgcctgggtctcttcccttcttgcctcttctttttttgacacggtctcactctgcagcccaggtagagggcagtggcatgatcccggctcactgcagccttgacctctcaggctcaagtgatcctcccacttcctcctctcaagtagagtagttgggaccacaggcacgcaaccacatccagcaatttcttttttttcctttttttttttttttttggtatttgtggagacgggattttgccatgtagaccaggctgaccttgaactccagagctcaagtgatcctcctgcctcctccttctaaagtgttgagattacagacatgcactaccatgtctggccctgggtctcttccacttttatgtatttcttggcattcttctgccttttcttttcctgcatctgacttgctctatcccatggggcttctcacccagctgaaggggctgctcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagaaggaggaacctgctcagctgactcttcccaactgctgcccttggtacaaccagcttgagtcacctgctacagaacaggggctggacacagaagcagtctgtggagggagaatgggcaggggtgtgcatgtccattcagtagaaggccagagaggcccacatgtaggcctatgatcagactggagcctggcttgactgatgccctctgatccaaacaccaggcacctaatgcggcctctagcactggcctagagtgctaaagtgagtcagacctgggaacccccagtggggagggagccttgagagtttggcacaagaaaggaagaagagctgagccaccgggggctgagtggctgaatggggcagggattcccagcaagaatgaggttggtctgagggttgggaacatgtttggctgggactctggggtattgacaggtcacccagcctggccagtagggcctaaggccccagctgggataggaagctgaatcagagggggcaagcctagagcccagggaggaggctggaggggtctgacctatggatggaactggctgggggtggggtgtgaattacagctccagggaattgtccttgagccatgcttcaaggaactggacacaggaaaggtggccctctgatagggtcagggtctgtgacccagtgactaacagagaggcttcctcttccctgatgcctcccagataggggcctcagaaagctgctgctgggagtttggagtgggggtgggcagagacatcagagaactcagggttctccccactcacctctctgatctcgcctgcaggccagcagcacagtgatgcctttgcccaggtgaatgccctgaggaaggtgccaggccttgaaggatggggacttcaccttggctgagaggtaaccggtccctgggctgctgccgggccttgtggggccagtcagtcagctgtctgtttactgctgatggcttggatcatggactgtgggccctgcaccagccccagggtgaagaatgggtggaggcaggcagaggtgcccagtgttgacaagggctatagaagtcccctcctgcattgtacaagtgaggaaactgaggctggaggaggggagggacttgcacaaggccacagggcccagtctgcttccgggcctcctcaccgccagtcttcccctccgaaaaaaagagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctacgtccttctcctcatggagctcacattccattaatagaagggggagctgacagtaacccatgtaaacatggaacatatcggatgttgatggatgccatggaaaaaataaacagggtaagagtgggggtgtgtgtcattatgagtaggatgttgagggaagactccctggaggaggtggcatctgagcagagagctgtaggaatgtgcaaggcatgaggggaagggtgttctcactggagggaagagtgagggcgaaggctccaggtgggacaatgcatggggttcagactggagagcaacgggccagggtgggtgcagtgagcaggaagagcaggaggtcatgacagaggggagcatgggacactgggaaggctttggctcttaccacaggtagattgagtcgctggagggttttgagcagaggagaactgtgatctgacttacgtcataaaggatccccctggcaggggtgagaaagccactgcagtcatctggcatgcagcgctggagccccagaccaaggtggtggtggtgcagggttggtggggattgtggtcagttctgacttttattgaaatctaactgcagggtttgctgaagggttggaggtgggtgggaaaaatgaaagccaaaaccagcctctaggttggtggctgcatggtggcgtcctttaccgaggccaaatagtgcctccttggtggagctggattcacattcagagcctgggatcactggatggtccaacacccatagaggcatgatgagctctgggggtcagactgcacaacccttcaccataggtgaacaggagatgggacagggtggggagcaatgctgccatgtcacctggaaggctctctccctgctggccttgctcctggccctgtccacgctttggatatgttggggagatatccaacatgctctcgttcttcagactcacagtggatgccccttcctcctggaagccttccctgagcccctgctgaagttcatgacattttgtttcttacttgctgcccttagttgagatgatagtctggccccgtgtagggctgtgtgaccctgggcacttacctaacctctctgagcctcacatccctcctctgcatcatggggatagtgaaaatgccccagaaaatggctgaagagtgttcagggcatgttttctgcccctgccatgtccccccagtgtggctagcttgctgtgtatgaactgcatgtacaaagcacctgaccactggtacccccaggacctgcaggcccgcgcccgtggggatgagtacctgtcatggcagcacatggccctgcagagtagctgctgctgggccatgtggcagaaggcgagccatggagggcagggacatctcccaagatgccaagggatgctgctttcactttacaaaatcctgtttagacctgagaccaaatcctggaatgccagagactgcctaattcacccaacttgtttcctaggagggaaaccaaggaccagagccaaggaaggattcccctaatatgccttaattccagagctatgagcagttaatcctatgctcttttgcatactccaggttgcctgggaatcttgcctttagggggagaaaataaacaaaccctcactttgctacacacataattcgtagatggagaagtatgaagtgaaaaaagtcaaactaggaagaagtgaggagacatttcaataaacgtttgtctgatgtctcggtatgaaaggactttctaaccctcagaacagtgggagaactcaacaaagaaataaccactacatgccagctgcggtagcatctgtaatgagcacacctgtaatcccagcactttgggaggccgaggcaggcagatcacctgagattgggagtttgagaccagcgtgaccaacatggagaaaccccgtctctaccaaaaatgcaaaattagccgggtatggtggcgcatgcctgtaatcccagctactcgggaggctgagtcaggagaattgcttgaatctgggaggcagagattgcagtcagctgagatcacgccattgaactccagccttggcaacaagagcaaaactctgtctcaaaaaacaaacaaacaaaaaaacatatacaaggacatgttgtgtaagaaaaaatggattaaacataaaacaagcaaaaaaccgggaaggatcttgataaaagatatgtcagaaggaggtaatgttctttaagatgctcttagaaacccttaagagaggcctggtatggtggctcacccctgtaatcccagcattttgggaggccaaggtgggcagatcacttgaggtcaggagtttgagaccaccctgggcaacatgatgaaaccccatctatattaaaaatacaaaaattagttgggtgcggtggcacactcaggagactgagacaggagaatcacttgaacctgggaggcggaggttgcagtgagctgacatcataccactgcactcaagctccacttagagcgagactgtctcaaaagcaaacaaagaaaaataagagaaacccatcagacaagagacaggaaaaaaatgagtcatagctcactgcattctagatctcctgggctcaagcgatcctcctgcctccgcccaggtagctagaactacaggtgcacaccacaacactgggattctttttttttttctttttttttgtagaaaacaacgaagggaatcttgctatgttgcctagcctggtcttgaactcctgggctcaagcaatcctcccttcttggcctcccaaagagctgagattacaggtgtcagccactttgcgtgaccacaatttcaatcatatttaaaatgtacaattcaagtgattttgccacactaaccacagactcatgtttaagccacaccaacggatttccatgttttaaataacatattttgccaccccctagtggacagtggctcaccaccggcacaaggggctacataggcagtcaatgggaaccaggcggggacgggaaatgtcgtgaacccaacggtccctgcccagccccacccgcgtccgcaacgtgtaaccacatctcctgactgcccaagagaagcgcagatttccatactgaacatgaaattgcctgacttcgaaatggtggcaaatcattaaaaaaaattttaaactcactttgcattggttattagggtcgaacttggggaagacccctacaggtgtgtgtgtgtctgtatgttaggggtgttcagacctttaatagggctagaaaccaggcaaccacaccgcggaaagcttgaggagagggaaatccaccagacgccaagcaggagggtcagggaagagacagggtggggccactaccgggttaaagacttgtagtgggtggggctacacgtagggccgagacgaccggatttccggaaatcagagccggcacacgtgacttttgtttgcagaagtgggaaggtaccctaggcagccaatcggggagcgctgagtctctgtccagccaatgagaagccaggttgttttagcgcctcgcccctcctctccggtccgcgagccttgggtatctccagcttttttccgccagagctgtttccgttcctctgcccgccatgccgttcctagagctgcacacgaatttccccgccaaccgagtgcccgcggggctggagaaacggctgtgcgccgtcgctgcctccatcttgggcaaacctgcagacgtgagcgtgggccgggcagcactgggcgaggggaagttggtgggccaggggtccggccttgtccctgctctgcctccgcaacagcgaccccgatccctttccccagggaccaccccccaccccattccgcaggccaagctctgactttccgtgcttcacgatcccgcggctccccctccgcacgtctttcccttgtcgccctccccagtcatgacccggacgtgaccttcagggacctcggcctgtactgggatccctgtccccgcgaacactgcgcgtttcggctttcgcgcgctcgggtcgggaccccagacgtagcccgactggctccagcttcgggtaaaacttttcatgttcccctcagcttgtgaacgtgacggtacggccgggcctggccagggcgctgagcgggtccaccgagccctgcgcgcagctgtccatctcctccatcggcgtagtgggcaccgccgaggacaaccgcagccacagtgcccacttctttgagtttctcaccaaggagctagccctgggccaggaccggtgcgcaggggtagtaggcccggaatattattctaaaacacaatcagagtactccattcctgctaacagtttaaagccaaacacctaggcaggccatttaggcttctgaatgactgggtcttgaccaggagagctgctgtctaggttttctcttcctgaccagttcctcaagagaaatgcaaaactagtgattaacagtaagagtcaggcagggcgcggtggctcacgcctgtaatcccagcactttgggaggccgaggcgggcggattatgaggtcaggagatcgagaccatcctgactaacacggtgaaactccgtctctactaaaaatacaaaaaactagccggacgtggtgggcgcctgtagtccccgctactcgggaggctgaggcaggagaatggcgtgaacccgggaggcggagcttgcagtgagccgaaattgcgctactgcacaccagccggggcgacaaagcgagactgtctcaaaaaaataccaaaaaacaagcaaaagaaaacaaaacaaaaacagtaagagtcgtcccaacgcagtggcttatgcctgtaattccagcactttgggaggccgaggcaggcagatcacctgtggttgggagttcgagaccagcctgaccaacatggagaaaccctgtctctactacaaatacaaaattagctgggcgtggtggtgcatgcctgtaatcccagctactcagaaggctgaggcaggagaatcactttaacccgggaggcggaggttgtggtgagctgagattttgccactgaactccagcctgggcaaaaagagcaaaactccttctcaaaaaaacaaacaaacaaacaaaaaaaaaaaacacacacacacacaatccaaaaaccagtaagggtcatgtcctgggaggctaactcagccgactgttaggtcaccatgcttatagccaagaaatgtgggatgctgctgggccctgagcggtcagataaactactttctctgataattagaaggctacaggaaatgttttgttttgttttgttttgggtttctttgtgtgtttttagagacaggatcttgttctgttgccccaggctggagtgctatggctcaatcagagctcactgcagcctcgaactcctgggctcaagcaatcctcccacctcagcctcccaagtagctagaactacaggtatgcatcaccacgcctgactaattaaaaaaaaaatttcttttggttgcgtgtggtgtcttggcacccgtaatcccagcactttgggaggtagaggtgggagcatctcttgagcacaggagtgcagggctagcctgggcaacatggcaagaccctgtctctacaaaaataaaaaagaaatgagctgggcgtggtggggtgcacctgttgtcccagcttcttaggaggctgaggtgggaatattgcttgagcctgggatgtcaaggctgcagtgagccatgactgtgccactgcactccaggctgggcaacagagtgagaccccatctctgaaaaaatatttttttggggagccaggcacagtggctcatggtaatcccagcactttcagaggtggaggtgcacagatcatttgaggtacagagtttgacaccagcctggacaacacggtgaaaccctgtttctactaaaaacacaaaaattagccaggtgtgatagtgcgtgcctataatcccagcttctggggagactgaggcaagagaatcgcttgaacctgggaggtggaggttgcagtgagctgtgatcatgccattgcactccagcctgggcaacagagcaagacactatctcaaaaaaaaaaaaaaaaaagtttgttttgaaatcctggactcaagcaatccccccaacctggacctcccaaagtactaggattataagtatgagctaccacactcagccactttttttttttttgagatggagtctcgctcggttgcccaggctggagtgcagtggcgcgatctcggctcattgcaaggtccgcctcctgggttcatgccattctcctgcctcagcctcccgagtagctgggactacaggcacccaccaccacgcccggctaattttttgtatttttagtagagacggggtttcaccgtgttagccaggatggtctcgatctcctgacctcgtgatccccctgccccggcctcccaaagtgctgggattacaagcgtgagccaccgcacgcggcctcagccacatttattaatttcactcttggcaaacatcagggggaagctgacccacacggcctgggaagggggttgtcttttgcatagagaccatgaccaggtctgggacagaggaaagtcaaataaatcacacattagagttagaagcagaggctcaggctgagcccaggtttattatccaaaatcaaaatgaaatgcagtgattaaaggacacaaggcctcagtgtgcatcattctcattgtggctttcaggcggctgtggaagacagggtggggatggtggcttcgggaggtgaggtgctctgggacttgggcaagtcttaggcaagccattcctgctttctgggcctggctcccatgggccattagaaatgaaaatgctttgtggactgctgaggacggtgcaagggtgaggtttcccagctcaccggatcatggccagcacccagggcatcagcttctgctttatggtggggtctgcaggtgggaagtccttggccttcagaatgacctcatgggcctcctggaagaggtcctcccccactgctgcctccacgcgctgccgccatgtggccagcttgggtcggccttcgaagacttggcagccagcacccacgggctgtggggaaaagggtacagactggggatggatggttgtgagggcagggatgggcagcatctgatttggggaccacagatctccaggaggtgtttgcacacacacttaagcacagtgccatagcccggtgtggcagcataagcaggacttcagcaactagccagggccccctgcctagtgggttcacctgcccacagcactcacatgcatcagctccgtgatggctacgaggtcagctaaggagatgtgaggaccagtaaggaaggccttgttctggaggaacttgtcctcgagcaactgcagggtcacatccaactctgccagggtggctgccagtgtctggggagatactggctcacccaggaaaacagggaacatcacctggggattgggcaggcaaagtcgggagttactggagtagggagttagttttgatttgcatttccctaatgattagtgatgctgagcatcttttcttttttttttttttttgagactgagtcttgctctctcgcccaggctggagtgcagtggggtgatctcggctcactgcaagctccgcctcctgggttcacgccattctcctgcctcagcctcccgagtagctgggactacaggtgcccgccaccacgcccagctaattttttttttatttttagtagagacagggtttcactgtgttagccaggatggtctcaatctcctgaccttgtgatctgcctgcctccgcctcccaaagtgctgggattacaggcgtgagccaccgcgcccggccaagcatcttttcttgtacttgttggccaaaatgataatattctcaacacattgggttaagtaaaatatatcaatttccttttactttttttttttcttttgagacagtgttcagctctgtcacccaggctggagtgaagtggcaccatctcggcacactgccaactttgccccctgggttcaagcaattctcctgcctcagcatcctgagtagctgggattataggcacaggccaccaagcctggctaatttttgtggttttagtagagacaaggtttccccatgttgaccaggctggtctcgaactcctgacctcaggtgatccactgccttggcctcccaaagtgctaggattattggcatgagccactgtgcctggactctttttactttttaaatgtgcctactagaaaatttaaaattacgtatgtggctcactttatacttctatcggacagcacttgactaaatgaactaaattccagagaggcataagccgttcctagatgagctactttcattccaatttcatttccttgggcccaagcaggctgggagaaagactgtcacaggcatgggcttttctgactgagcagcagtttgggaactgggggcagggatgaaaagcagagagatcttacaggcaacatcgtagttggtgattagattccaaagccatgctagactgagctagtgacctgatctcacattcaagatatttgaaaccaaagataaactgaaaccaactaaacctgcaacccagcccacctcctgattagcttagaagagaacagcctcacatcctggctacctgacacagggaagtgcaagccctttcttgggggtgtttattatgcaattcaatctctgctcttcttttatcataatgtctggcacacaaggatacatcatgaggccgggcatggtggctcatgcctacaatcccagcactttgggaggccgagatgggaggatcacctgaggtcaggagttcaagaccagcctggccaacatggtgaaaccctgtctctacaaaaatacaaaaattagccaggcatgatggcaggtgcctgtaattctagctacttgggaggctgaggtgggagaatcgcttgaacccaggaggcggaggttgcagtgagccaagatcgtgccattgcacgccagcctgggcaatggagtgagagtccgtctcaaaaaaataaaaaataatgataatacatcatgagacatgcaaagaagcaggcaaatgtgacccataatcaagagggagaaaacaacaatcaatagaaatagacccgtaggctgggtatggtggctcatgcctgtaatcccaacactttgggaagccaaggaggacgaatcacttcaggtggagagttcgaaaccagcctggccaacatggtgaaacccggtctccactacaaataacaaaagttagccaggtgtgctggtgggtgcctgtaatcccagctacgcaggaggctgaggcaggagaatcgcttgagcctgggaggtggaggttgcagtgagctgagatcgcaccattgcactcagcctgggtgacagagtgagaccccatctcaaaaacaaaacaaaacaaaaaaaccagacccacagaacacctacgtgttgaaattagttgacaaagatttttaggtaacagtgataaatatgttaaagaatttacaagaaaagacagataaaatggatgaacagatggtgaatttcatcagagaagtggaaattctaaaaaacaaccaaatggaatttccagagctgaaaaatacatatctcaaacaaagaatgtattggatgggcttaatagcaatttggcacaacagaggaaagaatctgtgaaggcaaagacaggtcagtagaaataatccaaaactgaaaagaagagactggtgcctgaacacctttggggaatgctctcgctgccgccccccacattcccagcctcaccttatgccacaaggcccggaggcagcttctccgcagagtcgtgtgctgccatgccaggtactcatccacacgggcacgggcctgcaggtcctgagggtaccagtagtcagggaccttatatttgcgcgtcaggtagagcaggatggccacactgtgggtgtgggggtcatgatgggtaagggaagggcactgtgctgggtatttcatacatagtcgcttttttttttttttgatacggagtctcgctctgtcgctcaggctggagtgcagtggtgcgatcttggctcactgcaacctccacctcccgggttcaagtgattctcctgcctcagcctcccaagtagctggaactacaggtgcgtgccaccatgcctggctaattttttgtagttttagtagagatggggtttcaccatattagccaggatggtctcgaactcctgaccttgtgatctgcctgcctcggcctcccaaagtgctgtgattacacgtataagcaaccgcacctggccttttttttttttttttttttttttttttttggagacaaggtcttcctcagtcacccaggctggagtgcagtggtgcagtctcagctcactgcagcttcaatttttataggagtgcaccaccatgcctggctaccttttttcttttttgtagagatgggatctcactgtattgccaggctggtcttaaactcctatcctcaagcaatcctccagccttggcatcccaaagcgctggcattataggcatgaaccactgtgcccagcacacttctttaacctttctgacaatttgccaaagtattagcctcattttccagagaagaaaaccaggcttagaaaggcagagacttgccctagggcacacagctcttaatggcagagctgagaatctttctgaggctaatacccaagcttttcctaccaccaggcaaaatcccacaacagaatgtcttgccaaatgtttagagacagtttctgatcagagaaccagagagagcttccaggagaacggggcatcaaagctgagctttaaagaagctcagttctttccattcggtatccactctcatctgctgggattccgaccagcctctgatggcctgactgttcaaaaaggcttccgtgtccctttgttctttctgtcattctttctgccaagaatcagctcctatctaagctgactggggtagtttggcttcctaaagtaccactcaggaagcactcctgcagctgcaggatcctagaacaacagaacagacaaggccccctggcactctcctccttccctgggttttgagggccgccatggtgatgagatgagcatggacctggaaggacacaggatgtgtccatttggagacacagaaaagctttcaggaacttggggtttcccaaaggttgggcatgcaggccaaaagggcagaaaacctctgtatctgccacgggcctatattctcttttaagctggggctacacacgtgtcccagcttaacgactccgttgtctgtgcagggtgcccaggagctccttttgctcccagccaattgttcaagccacctctgaggagggctgcaggtctctgtgagccacagacctgaaggtgagagtagtgacagaggcagagattgcacattgactctggctggtacctgggggtcacaacgctgagtgacacaaggactcaggacacctggggcaccagggaggaagacgggccctggcagaatgtcagaggaattcatcggaggtgcgtccatcctgagatttcagagatgagctttaaagcacaaactccaggttcttgttaggggaagggtgactctggtgacaaaaggggcagaactggggaaagattggcttttcctgaagaggattcaacttcttgggaccagctgtgatgtaagacgtccatatctggtggctcttccatggggaagacccatcctgggaagctgcagcccagagatggagccaccgggcagcccagatgccactgagccatcgccacacaagcttggccagaggcctgccccacggtgggcaaagctgccatcgtcctctggcctaccctgtctcaaggatactctcaccactcaccagcaaccaaagcactggtgtggaagtaaagtagatatttgcttttctaatcatcagggtgaactggaatagcaggaaggcaagggcctggggtccagtactgactctctgcaggatgcggggcacagagactctctgcctctgaagactttagtttccttgtctatgaaatagagggttagaacaggatggttccagcaggcctggcagcagtcctagggtcccagttacctctccgtcaaggtgaagtccccgtccttcaaggctggcaccttcttgagggggttcacctgggcaaaggcatcgcttaagtgctgacctgggaagagtccagcatggtgggtggtgggaggagaacgctgagcccgccatggcctgtgcccctccctgcaatgctctggccccagtttcacagttcttcttcccaccagtctgcactcctggttggcaaagactggaagggcccctgcgggaggaggaggagaccactccaccggctggtacaaaatagacaacaccccttgctaagtcctgtaggcacagcctcctcccacaggctgcccctctgcaacagagctcactgtgcagggtgtggttcctggacctttgcatgcaccctacccatctcctctttccactattgccagcttcatgaactcacaatcagagcaccccaagctgcacgataggtcacctgaggggactgactaccttgtcccttccaccattaattctaaggcagggtcatgaaacacagagaagtggtctttttctggtatctacctacttagaagcaacttctactggccccaccatgtccctttgttcaccctgccctgggcactgtggagctgtgtgtagcatacctgctaccaccccctgtgccccaaacttttattccccttacagttggggtctcactatgttgcccaggctggtcttgaactactggcctcaagtaatcttcctacttcggcctcccaaagtgctgggattacaggtgtgagccaccatgcccagcctgctaccctctcttcaccctcccttcagactgttccttcaccaggaaaaccctcctctgtctcctgggaaaacacacttccctctgcaccactacatttgacaaccagcttggacgtcctcttgtcccccattccctttcctctactccacactctgcagaggaagtccttgcgcaggacagtgggcagtttgcagaagagattatgtggagaagtttcaggcagagggccagccatggagtgggagccctgggcagaaggcttagccaagtagagtcgccttacttgccccaccagccatacctggattctgcttccaacccctcctactaccccaccctgcactgggcctgggcctgggcctgccagctgagtcctcaagggccttggaggcatgctagagaaacaaaacagggtgtagggctcatcaagccccagggtccccctgctgcttccagcatcagcagcctggggcaacctacctccccagcaggaacaagaggcagaggacaaggtttcgggcggcagaggttgcagtgagctgtgatcctgccactgcactccagcctgggcgacagagcgagactccgtctcaaaaacaaacaaacaaataaacaaaatgccttgggccaggcacagtggctcatgcctgtaatcccagcactttgggaggctaagccggcagatcatttgatgtcaggagttcgagaacagcctgaccaaaattgtgaaatcccatctctgttaaaaatacaaaaaaattagccagacatagtggcacacatttgtaatctagctactcaggaggctgaagcaggagaattgcttgaacccgggaggtggtggttgcagtgattcgagatccgtgccactgcactgcaacaaagcaaaagcaagactctgtctcaaaaaaaaaaggacaaggacaaggtcagaggcaaaacaggaggaacagaggaaggaagggacaaagagggaccccaatgcagactggacgagtgcagagggcagggatggaaagtcacgtcctgagctgtttgctgttgcagaatctcagcagctgggccataaagaagggacttgacgctgtcccagtctctacacttggcacccttgacctctctcatcccacctttccctaggccgaggtcacacctgctttcattttgtttttttttgttttttttttttaagacggggtctcgctagattgccctgacgggagtgcagtggctattcaagggcaccatgatagtgcactgcggcctggaattcctgggctcaagcgatcctcccaccccagcctctcgagttgctgggactacaggcgtgtgcccctgcacccagctgcgcccgtttttgtcctcctgtctggcttctcttcatgatccccacccctttattcggcctcaggggaaccccgtggtctattccgtgagaccgagcagagttttggggagccccgactcttggatctccctgctggctcacctttctctgttcggtctccaaaccagaccagcaatggccccaggaagaaggtggcgctgggagaagttccctaagctatgtatgcctacctgtccccttcctgacttttcggttccccaaacccgaggctggacctacctttaatcagatccacgatgcgcagctcgaagggaatgtcgttcttcttggcaaagatgtaaacagcgcggcagggctgggacagcaggtccaggtacagctccaggcccatagtggggaccgaccgacctgaccggaaaccagagggagtcagcaaactccagtgccaggactcgggtctcggacctcagaccacgcccctgcggctacgcaccccgaccgctgtgccccattgggcggcacggacgcctgggacactctttagtccaattgcgggcggcgggcggcctgtctcagggctgggcccgcctggctcctgtgggatcagggtgggtggccaagagaccgttgtctctcagggggacgcacagagaggccccagtcccatccctttcgtgcctggctcgctcatttcacttagcataatgtcttcaaggtgcatctgtgttgaagcgtgtgtcagaatttcccaccgtccgcattttagaggaggagacagacactgaatgattatagacccagaaagtctggctccaaagtccatcctcttggctcaacactgcagagtccttggtgccagcaagtggcaaagcctcagggcttacgttcagtgttttgtggtcactcgcttcactgcagtcgcactccctggaatgtcacagccttggtcttcctgcccctgccagcacagtgccatctatcgcattccctgggtttatttcttcctttctccaggcctgtgtttctccatctttaaaatgacagggaagctagagccctccagagtccttgcaagtccacccccctggattcatctgctgagccgtaagcccaggcctgccccttgctgccatggagcctgtcaaatagtatcagggtcacatgtcattttctaaaacgaatcccactgaaagtgtgtcagccaacgcataatgttttctagagaataaggaacatttctgcaaataaagtggaagtaacaactgttttattttatttagatagagtctcactctcttgcccagggtagaatgcagtggcatgatcacagctcactacagactccaactcctgggctcaagccatcctcccatctcagcctccccaagtagctgggactacaggtgcgcacaaagacgcccagctagttaaaaaaaatttttttctgtagaggcagggtctcactatgttgcctaggctgatcctcccacctctgccacctgctgggattacagatgtgagccactacaactggccagtaataatgatttttaactggaaaaaaaattaaggaaagatgagaaattcagatttccatgttaaagttttgaaaggaggtagacactcagagaaggcaatggctgccttatcctcacctctggataactccagtcagaggcccaaggaggagctgtcaggattctggttcaaggctcagcctgtcttttaagttcaaaacctaatttggggcgggagtggtggctcattcctataaccccagcaccttgggaggctgaggccggcggatcacctgagttcaggagtttgagaccagcctggccaacttggtgaaaccccatctctgctaaaaatataaaaattatctgggcgtggtggcatgcacctgtaattccagctactcaggaggctgaggcaggagaatcgttgaactctagaggcagaggttgccgtgtgccaagactgcgccattgcactccaggctgggcgacaagagagtaactccaactaaaaaacaaaacaactaatttggtccacgtttcaggattgatcattttctttgggtctgactcacataaaccaactcacaaaggctgtatttattaatttatagaaacaagataaaagtgagagtgtgtgggttggttcgtttgtttgttttttgactttgcccctctctgtcactcaggctgaagtgcagtggtgcaatctctgctcactgcaacctctgcctcctgggttcaagcgattctcgtgcctcagccacccgggtagctgggatttcaggcatgtgccaccatgctcagctaattgtatttttagtagagacagggtttcaccatgttggccaggctggtcttgaactcctggcctcaagtgacctgccagcctcggcctctcaaagtgctgggattacaggcgtgagccaccgtgcccggcctagaaagaagagaaaagtcatttagacagaatgctcccaaccattgctcagtgctctcttggcagtgtagtctcctaggaagcctcgtgggtgttactggccaggaccaggtccgttctgcccatgcacagtaaattaatcactgtgacatgagttttgcaaaagactaaagatttattcacaagggtgccaagcaaggaggtaggataatagctctcaaatccacctccccgaaaataaggcttagggataagccttgcttccaagcaataaagcacagaccccagtcacactcaaggggagggggctatacaaggatgtgaataccagtctgcctgcctcgtgggcctacaacgcagaagggccatgcacttggtttaaaactttgttgttgctgtcttgacattcttaacaatttaaaaataagggtccccacattttcatgtgtagccagtcctgtccaaggagtccaaagaggtcatgagggtggacaggtcactgtctcctctgggcagtgatggggccactagcagttgttctgtagtctcctagcccctaccccagggccacaccttccccatggtctctcacattcttttttttttttttttttttttttttgagacagggtcctgctgttgcccaggctggagtgagtgcagtgctgcaaactcagcttactatagcctcgacctcctgggctcaaacaatccttctgcctcaccctcctgtgtagttcggatcacaggcacatgccaccatgcttggctaattttttgactttgtagagagggcatcacactttgtttcccagggtggtcttgaattcctgggctcaagtgatcctcccacctcagcctcccaaagtgctaggattataaagatgtgatccgccgccccggcctctctcacattcttggcatttaaagttaccgtcattgacaaggaacatgggtacactccaatttactcaagaaaaaaactcttttctccattgaagagatatgtggcctggctgcttcctactctagttgaggtcttctttttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagcagcagccttgcctgggagcttgttagaaatatactaacaggctcccacccccaaacccagacctactgaatcagacagagtctgtattttcataagatcctcagatgatccaaatgcgccttaaactttgaggagctttgatccagaacctgggctggaggcccctgggggccactctgttcctcacagactgcaaggtatgtttttttcttgcctcttctctctgtcctaatgtctccttctctctgtgtctgaccctgaggaccctatgacatcttcccaggggagtttccactgtcaaagagctgattctctctctcttttttttttttttgagacggagtttcgctcttgttgcccaggctggagggcaatggcgtgatctcggcttaccgcgacctctgcctcccaggttgaagcgattctcctgcctcagcctcccgagtagctgggattacaggcatgcatcaccacgcccagctaattttttgtagttttagtagagacagggtttctccatgttggtcaggctggtctcgaactcctgaactcaggtgatctgcccacctcagcctcccaaaggcatgagccaccatgccctactgccagaggcctgattctctagaatctgatgggctcttctagacagcaatctctacctgggctcttgttgaagaagccaatcagctcattggttggaggtcacatgatataaaacatggccatcttccaagccctatgtgtggacaacgagatagggacaagtaggcatatcacgttctgatacctggacccacatctgtcgctgggcccacgtctgtcctcaggcccccaggatatacttttatggggagttttcctcccttcccccaatgtggtcactcataactttacacccaacagtcaaacaggagtggaagctacagagtttcacgcaaacaataggctaggctgtgggactgagtaaaaggcactggactgtggtaggtcttactccaagatggccaaatggaagggcttttagctttctttgtttttgttttatatcctgagacaaaatgttcaatttctacactttagaataaaaagagccatattttatgtttcatattttttgtatgcttcctttcatactcttttgaacaatgcaatcatattttcattatgaggtataattcacataccataatatccgctctttcaaaatatactttaaaattcaattggtttaaagccaattcattggtttttagtatattaacaaagttttgtcaccatcacaattatctaattctagatcattttcatcacccctaaaagaaactctgtacccattaaacagtcactccccatttccctcttctcctagcccctggtaaccattcatctactttctacctctgtggacagtaagtatctgcctattctggacatttcattcaaatttaataatgaaatatgtgagcttttatgactggcttctttcatttaacataatggtgtcaaggttcattcatggtgtagcatataacagtacttcatcccttcctgtggctgaattatattccattttatgtatacaccacattctgtttatccattcaccagttgatggacttttgcattgattctacttttcagctattgtgaatccccatgctgtgatgaacattcacgtacaagtttttgtctggacatatgtcttcagttgtcttgggtatacacctaggaatggaattgctggataatataattctatgttggccgggcacggtggcacatgcctgtaatcccagcactttggaaggctgaggtgggtggatcacctgaggtcaggagttcgagaccagcctggccaacatggcgaaaccccgtctctactaaaaatacaaaaactagctgggcatggtggtgcctgcctgtaattccagcctgtaattccagttactcaggaggctgaggcaggagaattgcttgaaaccaggagacggaggttgcagtgagccgagatggcaccactgcactctagcgtgggtgacagagcaagaatctgtctccaaaaaaaaaaaaaacaaaaaaaacaaaacaaaactaacccatatatatataatatgttatatatacataataatatattttatatatatgtgtatatatgtttaacttttggaggaactgcaagctgttttccaaagcggttatacattttacattctcagcagcagcacacaagggtttcaatttcttcacacatcctcaacaatacttttaatctgtcttttctgttatacccctcatagagtgtgtgaagtgatatctcattgtggtttgattggcaatgtcttgattatagtatctttgtactaagttttgaaattgggaagcatgagtcctacagctttttctttttcaaaattattttgaagattctgagtcactttaatttccaaatgaattttagggccaatttgtcagtttgtgcaaacaggccaagtggaattttaatgcagactgtgttgaatttgacatcttaacattactacaccttccaatcatgaacatgggatgtctttccatttattaaggtcttctttaagttttcccccaacttttaaattatgaaaacatttaaaatccagaaaatgaaaggactagtacaacagcactaatatatgcaaccccagtttcaacttactgttttttgaacataagataccaacatcatgacaccccacctaaggactttttagcaaaacattctaatttctctactgggattattgtttgttgtcttcctccacaataatgtgagcactaaaggtagagacttttgcgtactttgttcactactgcttcctctgcaccaaaaacactgcctggttgtgggtacttttctagttttaggaaggagaagacaagatataggtcctgactctggttctgcctctcattcatatgctactccgaggatcccttccccttgaagaacttgtttcttcatctacgaaatggggataatactactactcatcagggtggttgtgaggattaaacaaggtaagagatgtaaaattgcatgttagttatcagatagttttgttttcccatctagctccatgagggagaggatttgctctagtccgtccgtctgggctctgggcttctaatgggcagacaccttcctccatgatgtttgtagctgcaaagcctggcacagtccctcaagacaagctttttgacttgaactgctgatggtcttccatgcacaattcaacagaaacccagtagcatacacttccttgtatgcacttgcccctctttttacatttattacacattcattgctacctaataatccccgatacttatcttttactttatccaattattcaacagttttcaacagaaatacctagaagagagctattccgacttcattagaccctgagattctatttttaacatttcttccatggattgttgaatgtttccaatgattgatccaccttcccttggccttatctgcattccagatttggttgtgtgtccatctctgtgttgccagacttacctcacagacccagcttgaacacaagatgggtgcttgctgaagagcaggactcattctgttgaacctgcatgctttctcaggtcagattgcttggtggtgcttctttaatttctttcaacagcacattgtagtttgctgtgtttaagtgttgcttttctttggttaaagttattctaagtattttattctttttgatgctattgtaaatgaaagtgttgttttaattttgtttttgatcctttactgcaaatgtatactattgatttttgtgtattaatcttgtatcctgcaaccttgctgaacttgcttatgagctctaatggtttttaagtgagttccttaggagttcctataatgtcatctgtgactaaagatagttttacttctttctttccgatctggattccaccttgttcctttttcttgcctaattgccctaataaatagaagtagtatgaatgaacattcttgtcctgctcttgatcttgaggggaaacactcaatctttcacaaggaatgaagtatggtgtttataggtttttcatagatgctctttgtcaggctgaggaagttcctttctagtcttcatctgttgagtaattttatcataaaaggatgttagattttgtcaaatgccttctctgcattaggatgatcatgtgactttctattaatatgaagtgctatatggattggtttttgtacattgaaccacatttgtactcctgggataaatcctacctggtcaatgtgtataatcctcttaatatgctgctgaatttgatttgctaatattttgctgaggatatttacatctatatttataaggatattgctttgtaactttattttcttataatgtgtttttctgtctttggtatcagggtaatgctggcctcatagaatgagttgaaaaatatttcttcctgttctattttttagaagagtttttgaagggttggtgtcaattcttcaagcttttggttgaattcaccagtgaagctatctggtcctggacttttctttgtagggatttcatttattgatttattgatttattttttgagacggagtctcgctctgtcacccaggctggagtgcagtggtgcgatctcggctcactgcaagctccgccttcctggttcacaccattctcctgcctcagcctcccgagtagctgggactacaggtgcccaccaccacgccccatctaatttttttgtatttttagtagagatggggtttcactgcattagccaggatggtcttgatctcctgacctcgtgatccgcccacctcagcctcccaaagtgctgggattacaggcatgagccaccgcgcccggctttttggtaggattttaaaaaaattaatattttaatatctttacttttacaggtctattcaaattttatcttccttcttaagtccgttttggtagattgcatgtttctaaaattttctcatttcatcgaggttatctcatttgttcacatacaattattcatagtatttctttataaacctttgtacttctctaataccagtagtgatgtgtccattttctttctttctggtgtctggttttttggtttttgttttttttgtttttttttttgatataaggttttcctatgttacccagactagagtgcagtggtgcaatcacagctcaatgtaaccttgaattcctgggctaaagtgatcctcccaccttagccacccaatttgctaggactacaggcgcgcaccaacacactcagctaattttttctttcttttttttttttgagacgaaattttgctcttgtcacccagggtggagtgcagcagtgtgatcttggctcactgcaactctgcttcttgggttcaagcgattctcctgcctcagcctcccgagtagctgggattacaggcgcctgccaccatgcccagctagttttttatttttactagagatggtgtttcaccatgttggccaggctggtctgaaactcctgatatcaggtgatccgcccgtctcagcctcccaaagtgctgggattacaggcatgaaccactgggccttgcctcctagctaattaaaaaaaataaataactctttttgtagaaacaagtctcactatgttgcccaggctggtctcaatctcttggcctcaaatgatcctcctgcctcggcctcccaaagtcctgggattacaggtgtgagccattgcacccatcctccactttcttggtgaataatttgagtcttattttttcacttggccattctaactaaaggtttgccaagttttgttgatcttttcaaagatccaatttttggtttctttgattttctctattgtttttctgttttccatttcatttatctccattctaatctttattatttcctgtcttctattggtgttgggtttattttgctcttatttttctagttccttaaggtgtaaagttaggttattgattgaagattgttcttctttaacttaggtgtttacagctataaattttgctcttagcactgcttctgctgcatcctataaatttgggcatgttgtgttttcatttttattcattcaagatactttttaatttcccttgtggttttgtctttgacccattggttgtttaagagtgtgccgtttaatttctatgtgcttgtgagttttctagttttccttttgttcttgattttaaactttattccactgtgtccagagaacaccctttgtatgatttcaatcttcttaaatttgagacttaggaccaaatatatgctctatactggagaatattccatgtgctctttagaagaatgcttattctgctcctgtcgggtagaacgttctgttcatgtctagtgtgtgcaattggtttacagtgcttttcaagtcctctatttccttgatggtcttctgcagtttttctattactgaaagtgggggccaggtgtggtggctcacgccccgaatccctttggggattcagggtggctcagcactttgggaggctgaggcgggcgatttgcctgagctcaggagttcgagaccagcctgggcaatacaatgaaaccctgtctctactaaaatacagaaaaaaattagctgggcatggcggcatgtgcctgtaatcccagctactcaggaggctgaggcaggaggattgcttgaacctgggaggtggatgttgcagtgagctgagatcgcaccactgcactccagcctgagtgacagagtgagactccatctcaaaaaaaaaaaaaaaaaaaaaaaaaagtcaggtattgaagtcaccaactattattactgacaacgtaatcatatttaaccctttacttttaaaattctttttggaaactggaaggatctgtaaccaccacccacttccacatcagaccctatgcatacgccaactgtctgttgctcagcagctgtgatgttgttccagttctttattaggcaaagaacagttgtttttttagcatttcctttaaggaaggtggctcagatcattgagccagccaggccctgcaggatgggctgcgattagggtcacaagtacttctcccgaaactcacagattttcctcgtgaccattggatccaatgttgaaaagtcccagtcggccaactgcattagtcgatcatgggcctccctaaagaggccacagccaatattcagctccacccgcatacgccactcagctagcttggagctgttgaggaagacattatagttggctgccatgggctgtggatagacaaagacgaagatgtggtcagcctggggaccagccccacctgggtcctctcccacagcctctggcccacgtccctaacatctacctatggaaagaattaggctgctgacccccaaggcctgagcaaggggtcacagactatgtaatagatgtaggtggggatggaggatccagaatccctcagagtcctcagtcactggtcttcttgctccaagccttctgaaccacactgagagggctcctggcccaggcagctcccacttctccagcctgcgacctcgcatgaatcctgccttcttccagggaaaccccttatcccaggtgtgtatatgcggatgagggagagaactcaggttttttcctccatgtttagactcccactatgatcaagctcaggggctaagatgggagacctggcgggcagtctaccctgcagtttcgctggctcactaagacagtctaccctgtagttccgtttgcacccaagatctttgggaagccaaagaaggggtgggtcgttggtgaaatgtaaggggtggggacgaagtatatggctgaacccttggggcaggccagaatgatttttcctggtgctggtctgccctgcaaacagaccaaagagactaattttcgtatcaaccagagatctctgcaatagggaaaagaacactgtatttcctggtcaatccaccaggatcccaggtgcctcctcctggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttccttccctgttatctttgggatcagcaactggccagggttgggaagaggagggaagaggaggctgtactccagggccacctgccctgccaggtctctgtactcttgtctgctggatagatattgaacacttcccaggatataaagcagtttcacctcttttagcagttctgattggtggaaggtgccgggaaccatgcgttcacaaggatttggggagctcagcaggcataagtcctgtgattgattagtgatgccggtcacaggcatggaatttgaagtagagacacgtgtactggttatttgtcatcttccaattttcttttttcttctttttttttttttttttttttttttgagacggagtctcactctgttgcccatgctggagtgcagtggcgggatcttacctcactgcaacctccgcctgctgggttcaagaaattctcctgcctcagcctttggagtagcgtggattacaggcacatgccagcatgcctgggtaacttttatatttttagtagagatggggtttcaccctgttggccaggctgttattgaagtcctgaccttgtgatccgcccacctcggcctcccaaagtgctgggattacaggcatgagccactgtgcccggccatcttcaaattttctatgagccatttttttttttttttttgagatggaatctcactttgtcacccaggctggagtgcagtggcatgatctcggctcactgcaacatccacttccctggtttaagcgattctcctgcctcagcctcctgagcagctgggattacaggtgcccaccaccacaccagctaattttttttgtatttttagtacagacagtgtttcacaatgttggacaggtaggtcttgaactcctgacctcaagtgatccacctgcctcggcctcccaaagtattgggattacaggcgtgagcactgctcctggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcgggtctggcgggcaccagtgcgatggtgcgctgtacttgcggcacaggtagtaaaggatggccgcgctgcagaaggggccggtcaggggcactgcccttgccttcctgagtgccactacatcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacggagggtagcccctggaggtgcagggaggttatggacttaatgcttaagattaggcattatataagccagggcatgaaaggatccatctctctggtgctggatggagggtgagcccgagggggcagaatggacaatgagggggccagcaactatcgggaaggttgtggtgtctgggaatgttggaggccatggggacagagggaaggggatggaggggagacatgcttcggaggggatgtcctaggccttgctgattgatggctggtgtgggaacctccgcagcacaagggctcctttatcatcaccagcagcaaccatgccaaggtaaaaaggtcagggcatggagagagctatcggttaaaaagtggcaggagagacagcaactggctgcaagactcagaacttcttggctgggcacggtggctcacgcctgtaatcccagcactctgggaggccgaggcggggggatcatggggtcaggagatcgagaccatcctggttaacacagtgaaaccccgtctctactaaaaatacaaaaaaattagccaggcatggtggcgggcacctgtagtcccagctactcaggaggctgaggcaggagaatggcgtgaacccgggaggcggagcttgcagtgagccaagatagcgccactgcactccagcctgggcaacagagcgagactccgtctcaaaaaaaaaaaaaaaaaaaaacttctttggatcctgatccaaacaaactgccaagaaaatgtttaggagataatcatagagttttgaacaggagccacatattagatgaaatccaggaattattgttaattttatgaggtatcttaatggtatcgtagtgatgctacgctctatcctagcccaggctggagtgcagtggcgcaatcagagttcactgcagttctgaacttcctggcctcaagcgatcctcccgtgtcagcctctggaagtgctcggattataggcatgagccaccacacccagcctgttgctttttttttgtttgttttaagaactcttatctctgaaaagtatgttcctaaacatttattgatttatttacttatttatttttatttttgagatgggatctcactctgttgcccacgctgaagtgcaacgacgcagtcttggctcactgcatcctctgcctcctggctcaagcagtctttccgcctcagcctcccgagtagctgggactacaggtgcagaccaccatgctggctaatttttgtattttttgtagagatggggttttgccatgttgtctaggctaggctggtcttgaacacgtgagctcaggccatcccctcacttcagcctctcaaagtgctagaattacaggcatgagctggcttctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgcttgcactgaacctcccaggagaagcagagacagatggtgcaagggccccagggaagacttacctttcacttaagataaatttcccatctttgaggctgggcagcttcctgagggggttgatgtcaatgtatcctttgctgtggtggtgacctgggaggggcagggaaggtctgaggctgtgggactccaggggagagagaactgagactcccagagacccaaacgcctccctctctattttctcaagaagagggaactgaggcccggagggacattgcgtctcaccccaggtcacagggcaaggcagttgcagaaccggactgcgatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagcttttggagtccctctgtgctggggatggagttggagcccacccctctgaccctcactcagggttagtggagccctgagcctttctgaacactggggaggatgggtgtagacggactgtgcacttctgccccctttgccaacctggtgggcaggtgctgagttcacaaggtcctagaatcccacaaggaagccagggtgcctggtgggagcccagggagtcccagctactgttccttcccccttctcctcgaaaagcctgttcatctgtggcgtggggactgtcattagtgagcactgactaaggtaggctggacaaggatgcagcctacaagccgcgtggcatcttttccttccctgtggacctctggggtgattcccttgtctctgtctctgctcctcagaaacgcccctatcaggctgtgcgcggtggctcacgcctgtaatcccagcactctggaggctgaggtgggcagatcacttgaggtcaggagtttgagaccagcctggccaacatggtgaaacccctgttaaaaatacaaaaaattagctgggcgtggtggcatgcacctctaatcccagctactcgggaggctgaggcaggagacgcacttgaacccagcagaggttgcagtgagccgagatagcaccaccgtactccatgctgggcaacagagcgagactccatcaaaaaacaagaaaaaaagaaaagccgcaatctgtgtgtcctgcctccccccaggaccaggcctgccaggcagcagtgggagttgacctttcagcagatccacaaactgaaagttgaactggatgtcatgcttcttcgagaagatgtagacggcacggcagggtgctgacagcaggtccatgtagagctccagtgccatgttgagacacatgccaggccccacagccgcagttggccagccacagacctgggcctatgtctggccagagtccctggccctgtgccctctccgatctgggcccaggatcctgtgttccccagggaaacctcttgtttccctttgtgttgtcataaggccaggaagcctgcaattctcacagcatcaaggattctaaggaggcccaggagtaggctggggagaggcccgtggcaaaggtgtggcagccgtgaccctactctcccccttccacgtgtgcctgtgccccgtggtgccacctcacagacaccagtctgagaagggattatgcctgggaattcccacggctggattttcattgcagaacctgacgaaaggggctttgcagggtccagaatgaagaggaggcaatgagaattatccctggaggattctagaagtagaggctgggagtatccacaggtaaatcgagcctgaactatgactagaaaggaattgggagaaagagacacaggtgaatcgagcctgaactatgactagaaaggaactgggagaaagagacacaggaaactgtgagctttgggagcaatggggacaccaccaccaggaagtcagggggcactcagccggtgtgtgccacacagaggagcctagaaacttcctggccttggttggggctgcagtggccagactgtgtacctggtggccaaggaaggtaactagagccccacgtagaggactgagtgccactcactctatgctgtgatctaataggtctaggctgagaaatgggactgaccccacttctggtgacagagtaagcctggagacaagcgaagagcatgcagtgtgtttattgcagacagcagggtgcagtggagtgggctgcacccactgcacctgcttctgggccagctgggggtcccgccaagcctcactgtggttcagaggctggagtatgagcttgtgggcctccagcaagagctcagtaccaagggcagccgccacacgggcctgccacactgccagccggggcagtcttggaagaggtcgcagccaacggcagtgggctgggaagacagggcagctggggttggggctcagccccatgcccagagtccccccagagggcaggtgggtaggaaagcttcacctgcatcacctccgtcagcaccaagtcttccagggagatctgctccattgccaggaagggcctggccaccagcaccccccaatccaggtgctgcagggctggcatcagcctccccaacagccgctccagctgtgcagcatctgcaggctgtccggagaagtggggcaggagagactgggctgggaggagaggagcaacttaacccagactcttggaagcctcttgggcctcctctccatcccttcccggctgccactcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtgccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatccgggtgacctacgtcctttccccacctgggcagctccagctggctcagactctagccaggttccagcctccagctttagcccaaaggtgcccctgggtccagcctctgcatcggagctacacaggctgaaatgaggaaggggcctcagtgatttggaaagatctccaagccaaggaaagatctcccctctcgcctctgcctccccctacaactctgagccccagaacccaggcagatcctggctctgaccctgggtgggcaccaggtcaccattacctctttgctagtaggaagtcgccatctctgagggcaggcaccttccccagggggttcaccttcaggaactcaggcttcaggtgctcccttggtgggcagaaaggcgagaaggctcagtgtagggcctggtccttggcacccactccatggggcccagcccagccacctggctcaccccaagccaactccaccatccacagctcaaaagggatgtcattctgtcttgcaaaagtggatagtgtgtcaggtccaggaagagctcaagccccattgctgctcctctcacctgccctccccagaattctggacctccaggagttgctcagcccttctccactagttctgagctgtttcctgtccatagtctgctgtagtgggccagagcacagggcagatttgtcttcagggactttctctgggcattcctgggcagagaacttcatcttctctgttaactcttgctgataattctctgtagctaggcaccttgtaaaacccatgtcccagaatgccaaacctggaaatgcaatgtcagcgccgaaactgcattgaaactgaatgaa

SEQ ID NO: 433 - DNA, 131598 bp, Homo sapiens
ctcaccaaaaactgtatgtcatgatattcttaagtcgaagttgaaacatgatgtttcacattaaatttaagatatgcagcttggcgaggtggctcatgcctgtaatcccagcactttgggaggccaaggcagatggatcatgaggtcaggagttggagaccagcctggccaacatgatgaaaccccatctctactaaaaatgtaaaaattagctgggcatggtagtgcacgcctgtaatcccagctattcaggaggctgaggcaggagaatttcttgaacccaggaggcagaggttgcagtgagctgagattgtgccactacactctagcctgggtgacagagtgagactccatctcaggaaaaaataaaataaaaacaaataaatttaagatatgcaaatttaaatagagaaaataaacgttatataccctataatgttatttcacctaattagtacttaattatatggatttattttatattataaaagatgttttgattttttcttttgatattgacaacattgtttggatattcttatgttgtcaaggctgcacctgcctcccctgccttatttcttatgttttgccacagttaacccattgtgcttctttgtaatcaaacggtttggggaggggggagaaagggcttactgaatgtctaaaaaaacaagtttaaagtgtttgttacccaaagtttggtgcatttgtaaactctaattacatatgtgaatgttaataccctcagtgaattgttattgtttgcaaaaatgcactgggcagtaacattttgtgataaatcctacaatgcaagatataagtaaaagaaaatacttatcattgtgttacaccatgtacattattcagtatactaacatgctgtatgggtttgtagcctaggagcaggtgggctacacaatatagcctaggtgtgtagtaggctatatcatctaggtctgtgtaagtacactctgtgatgtctacacaacgacaaaagtacctaaagatgcatttctcagaatgcatccctgtcattaagcaatgcctgactgcactgctaaccacctacactgccatcaagttggggaaaagtcctcctggattcatgtgaattacaccaagatagacccagatcagcactctgaggacaactggaagaccctccctacaggtgaccttaaagtaacgatttcccagactggttcccaggcctcagaagcagatgacattttaaagtagacagctttcctcaagatcatggatcaagaaacttcacttccacctgttttctcacattgggcctccttgtccaaaaagcaaaaaccaaaagaacctcttccttttaatgaagcctcctttttctctggccatttattaaaaagctgactggaaattgcttgtctcaatcctgtcctctgattctccctctgatcctacactatgggttctctttgaggtggtgtctcattcttagtaacccttactgttttctcaacaggtcaaaaacagagctgacaccccgttacaccaactctccaaatcttgtccactttaattaatctgattactggttatgtcaacatctagatcatgcagaagaacttgaaccgattttcattcctgccaatgccaggactcggtgggccaactatgaaaactgggtatgtgacagggtgtggcatccacaactgagaaaacaacatcactttacttcttcttttgatggattaattggacatggacaaacctctatggaagctcaaggtctgtcctgtgctcaggtagtcattaaatgaaggaaatttgctgggtatggtggctcaagcctgtaatctcaacactttggcaggcagaggtgggcagattgcttaagctcaggagttgagaccagcttgaccaacatggtgaaaccctatctctacacaaaacacacaaaaaattagtagagtgtggtggtgggcacctgtggtcccagctactcaggaggctgaggtggaagaatcgcttgagcccgggaggtggagaatgcagtgagctgtgatcacaccactgcacttcagcctgggcaacagagcaagaccctatcttaaaaaaaaagaaaatgttccctttgttttaaaaacaagtatagtgctgaatgatttataggtgacatagcaagatgatattacagttgaatcctgtgatttggttccacaggtggcatcctcaagcctcccatgaaggttatagaaggttctggcactgactcttatggtacaaacacttgtcatatcactggatgttacagtaagctcacaagccacccttgtataatatggggtagctcatctgctctcttcattaggctgccaaacactagacattaaatacgggtagaccaaaaatctggacaaacttggtcacataacaaaaccaagccacagacatgtcaaggccaaactgcaggcctcctatattagatattttgcaacccattctcctacagactgacaaagacacatggaagatggatgtgtgcagatgcctacatgataggtgacaagacaccagcccccaacctggtgggtcatgagttccactctgaacttatctgtgaacaacattggtctttttatcttatgtggcaacagattatataaaggttctcacctaaatggtcaggtcaatgtagaattggatacccaacaccttctatcaccaggtgtcactttaaatgtcagccaaattacaaacttgggctcttttatacacaaagtaataccacatgaacatactagatatgacatcagggaaaacccacttgtatgttacaattctaagttattttcagtattgagatccttttttccaggcgttggaaattatgtgacagaaagggcagttctaaatctttccataataatagaacaagagttcaatattactctgcaaaaattggtagcactcggccgggcgcggtggctcactcctgtaatcccagcactttgggaggccgaggcaggtggatcatgaggtcaggagatcgagaccatcctggctaacatggtgaaaccccgtctctcctaaaaatacaaaaaattagccaggcgtggttgcaggcacctgtagtcccagctactcgggaggctgaggtcagagaatggcctgaatccgggaggtggagcttgcattgagctgagatcacgccactgcactccagactgggtgacagagtgaaactccatctcaaaaaacaaacgaaaaaaaaattggtagcactccaattagaagttaatagtttaggaatttatggcccaggtaggggcagtctctcttggatcagcaagtcctcaggatgtcaaagcagtccgggcgcggtgatccacacctgaaatcctagcaccttgggagactgagatgggagactcacttaaggccagcactgggcaacatggcaagacaccagctctacaacaacaacaacaaaaaattaaaaattagatgggtgtggtggtacatgcctgtagttccagctgctcaggaggctgaggcaggaggatcactagagcccagaaggtcaaggctgcagtgagctataactgcaccactgactccagccttggtgacagagcgagaccctgtctcaaaaaacaaaacaaaatgtatgaatgaacctaggaaatcaatcaaccataataaaaagtttaattaaaagtaatggcaaatcaggcgttgtggctcacgcctgtaatctcagcactttgggaggccaaggcaagtggatcacttgaggccaggagttcaagaccagcctggccaacatggtgaaatcctgtctttactaaaaatacaaaaattagctgggcatggtggcctgcacctgtactcccagctacttgggaggttaaagcaggagaatcgcttgaagccaggaggtggaggttgcagtgaggtgagattgcgccactgcactccagcctgggtgacagagtgagaccctgtctcaaataaataaataaataaataaataaaataaaagtaatggcaaaaaccatgattacttttagaccaacctaatataattgcaccactgcactccagcctggcagagtgagaccctgtctctacaaaaatgtaaaataaacttaaaaaatgtcaaagcgtgataaagtacaggacataaagaccatgattaatctaacacccatcactccaatctttgcctctgttctggcattcccctatgtgtcttcgcatcaccctccttctgggtgactcctttatgttgtatttttttgttttgtttgggtttttttgttagtttgttttgagacagagtcttgctctgttgcccaggctggagtgtagtggtgtgatcttggctcactgttacctctgcctcccaagttcgtacctcagcctcccgagtagttgggattacaggcatgcgccaccatgccctgctaatttttgtatttttagtagagacggggttttgccatgttggccaggctggtctcagactcctggctcaagtgacctgcccacctcagcctcctaaagtgttgggaatacaggcataagccaccccgcccggccaccccactcattttgaatgtaagtagattaccaattctgaaatgggttttgagcagtagcaacattgacacaaatttataatattttcaagaagatacttccttcaatatgtaaaatgcaacagatatcatttgcaatcatacatatgtacatatatacatacacacatataatatatatatctcaccatggaataagtctgagctgaaacatgcattacttaaaaaagaaaaaacttacagacaggatcttgctctgtcatccaggctgaagtacagtggcacgattgtggctcactgcagccttgacctcctgggctcaagtgatcctcccacctcagcctcccaagtagctgggactacaggcatcagctacctcgcctggcctgcatgatctttatgaagaatgtcatagaaagtttttgaaagcgattaaagttgacctaaacaagcggggatctatgctgtatgccatgctattattggggaggaaaaaaattctcctctacattcctagggtctctggagatctgggcctaagaataaaactaagacagattagctctctccctctccctctccctctccctctccccatggtctccctctccccatggtctccctctccctctctttccaccgtctccctctcatgccgagccgaagctggactatactgctgccatctcggctcactgcaacctccctgcctgattctcctgcctcagcctgccgagtgcctgcaattgcaggcacgcaccgccacgcctgactggttttcgtatttttttggtggagacggggtttcgctgtgttggccgggctggtctccagctcctaaccacgagtgatccgccagcctcggcctcctgaggtgccgggattgcagacggagtctcgttcactcagtgctcaatggtgcccaggctggagtgcaatggcgtgatctcggcttgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgccctgccgccatcccatctgggaagtgaggagcgcctcttcccggccgccatcacatctaggaagtgaggagcgtctctgcccggctgcccatcgtctgggatgtggggagtggctctgccccgccgccccgtctgggatgtgaggagcgcctctgcccggccgccaccccgtctgggaggtgaggagagtctctgcccggccgccccatctgagaagtgaggagaccctctgcctggcaaccgccccgtctgtgaagtgaggagcccctctgcccggcagccgccccgtccgggagggaggtgggggggtcagccccccgcccggccagccgccccgtccgggaggtgaggggcacctctgcccggccgcccctactgggaagtgaggagcccctctgcccggccaccaccccctctgggaggtgtgcccaacagctcattgagagcgggccaggatgacaatggcggctttgtggaatagaaaggggggaaaggtggggaaaagattgagaagtcggatggttgccgtgtctgtgtagagagaggtagacatgggagacttttcattttgttctgtactaagaaaggttcttctgccttgggatcctgttgatctgtgaccttacccccaaccctgtgctctctgaaacatgtgctgtgtccactcagggttaaatggattaagggcggtgcaagatgtgctttgttaaacagacgcttgaaggcagcatgctccttaagagtcatcaccactccctaatctcaagtacccagggacacaaacgctgcggaaggccgcagggtcctctgcctaggaaaaccagagacctttgttcacttgtttatctgctgaccttccctccactattgtcctatgaccctgccaaatccccctctgtgagaaacacccaagaatgatcaataataataaaaaaaaaaagacagattaacagaagaaaatcattcaagttttgctaaattttcagtgtacatgggtactttcacaagagaatgaaggcctaaagaagtcactaaagtagaaaaagtttctatcctttaaatagaaaaacaattttttttaagacaaggtcgggcacggtggctcacgcctgtaatcccagcactttgggaggccaaggcgggcagatcacgaggtcaggagatcgagaccaccctggctaactcggtgaaaccccgtctctactaaaaacacaaaaaaattagctgggcgcagtggcgggcacctgtagtcccagctactcgggaggctgaggcagaagaatggcatgaacccgggaggtggagcctgcagtgagcagagatcgtgccactacactccagcctgggtgacagagcaagactctgcctcaaaaaaaaaaaaaaaaaaaaaagacaagacaaagcggtttggattataggcagtaaattgtggagaagggactaggacatacatgcggagcaaaattggaagataaggattatttttagtcgtgtgtttatacagatccattggaaccttgattcacagtcacctgtgatgacaatgttcttctcttcctggtaaagggagggtgctttcttatgggaaattgtgtggcctattcttagatagaaaagggcaggtcagagagtctttcctgcatgtgctatttctcaagtgccttcaactcaaaataattaatactccaaagcagcatatttggggtgacgtgtctttaattccttcatttcccctgctgcagactttcctagaagtttcagatattaaaagctgagttggtggctatggagataagagccagattcataacgagggatctacaaatggggagaagaacatagataagaataggaatgaataagctgaaaggaacaggtctgagcacatttccccttatcctgttaaacacacatcccattgctgggacaaggtcagtacagcagaaggaatgcacctcttttgtttgatggagagtgtttagcttgttctttaacaggtgcagcttaggcactatttgtcccagtggatttacacagaccagccttatccaccaatgatcacacaaactcctccttttgaggctgtcagtgtgtccagggtgcaacaattttggaatacagcagaagctaagctattaacttcttttgttgtggttgctgttgttgttttgagacagaatctcactttgttgagtgcaggctggagtgcagtggtgcgatcatggctcgctgcatccctggcctcctgggctcaagtgatcctcccacctcagcccccagagtagctggaactactagtacaccctgctaatttttaaactttttgtagagacagtctcactatgttgtccaggctggcctcgaacttctgggctcaagtgatcctccctcctcagccttccaaagtgctgggattagaggcctcagccaccatgcccagattgctttgacatcttgaggccttagtgatccaagagagactgcccctccctgggccagctaattcctacagagaataaatgatttgcttatggtgtgccttcgatgggccaatcaaccgattcgtatctccaagataactttaccagccaccttccagcaggttcctgccccaaatcactccagggacaggtaccaggtaacaaaggaccactcctataacctagagcccatcacagttattgaaactagccaggcctaagtctgtttaccctgtcttgccttcttgcaaaaaacacagaaaaccctttgtccacctttcgccctcactcattctgccacctgactggccctggtgcttccccatggccctgcatggtgtggcgtgtcccccctatcatcttgggaactgtgagtaacaaactgtcttttaaatggctatcacctctgatctgtggcctcgccatacctgaataaagccaaaatcccgggtacattttaaaacaagtctacaagtcaaggaatgccggggtggttgacgtagtggcactcaggaaggcaagggcagtgcccctgaccggccccttctgcagcgcggccatcctttactacctgtgccgcaagtacagcgcaccatcgcactggtgcccgccagacccgcacgcacgtgcccgtgtggatgagttcgtggcttggcaacacacggcctttcagctgcccatgaagaagatagtctggctcaaggtgagcagggccacttctggggcttggggacacgggcacagggaagtcaggaaggctggaggccagttctggccctgctgactgccggcgacctcaagcaagtctccctccctctctgggcctcatttcctcagctccttctcctgcccgccttacagagccgtcaggagtgtggactgaaacaatgggcatgaaagagtcttattagggcgaggggaagggcatacgggaggggctgatgtgactcacccaggacagcattcgaggcatttcattctgaactagagaatctcagcgtcaaaaggcccacagaaggccgggtacggtggctcacaactgtaatcccagtactttgggaggccgaggcgggcggatcacttgaggtcaggagttcaagacctaccttgccaacattgtgaaacaccatctctactaaaaatacaaaactattagctgggtgtggtgatgggcacctgtaatcccagctactcaggacgctgaggcaggacaattgcttgaacccaggaggtggagttggcagtgagccaagattgtgccactgcactccagcctgggcgacagagtgagactccatctcaaaaaacaaaaacaaaaaagagtaaaggcctatagaaaattggaagatgacaaataaccagtacatgtgtctctactttgaattctatgcctgtgacagacatcactaatcaatcacaggacttatgcctgctgagctccccaaatccttgtgaacacatggttcccggcaacttccaccaatcagaactgctaaaagaggtgaaactgctttatatcctgggaagtgttcaatatctatccagcagacaagagtacagagacctggcagggcaggtggccctggagtgcagcctcctcttccctcctcttcccaaccctggccagttgctgatcccaaagataacaggggaggaagtttcagctgagaagatggagcatgcagtggaagaggtgaagaacagcctgcagctcttcgaggagaagtttctgcaggataagatgttcatcaccgggaaccaaatctcactggctgacttggtggccgtggtggagatgatgcaggtgtggagtgggttggaggaggggtagaccctgggcagaggtaggactcctctgtgaccaatggggccatcacttgaggataggctggtgaggtgggaaaggcaagcagagctgtcatgggggctgcgggagcgaggtctggggccctggactcaatctgggggcaacaggaagcacagaatgttatgaatcaggaaggatcacagttctccacacttgacaaagattcttcggtgtgggaggacctggagggtgagcctgggatagagaagaacactgcatttcctgctcaatccaccagcatcccagatacctcctcctcttgctggactctccaggaaatgttcactggcttcctgggtgtccttctggccctgcctgtttcccagagctccagacagacagctctggaggacagctctcgtggctgggtctgaggggcatccactgtgcatttggaggcacacctgagtgtggggcatttatgtggcctctacatgcaggggagggtgaccagttctgcttgtcaagacactggccagggtctcaactggccatcctgcacaccagctagggcactgcacactgaccaaagagactaatttgcatatcagccagagatatgcccgagaggagggacctggggtcctggtggattgaccagaaaatgcagtattcttttccttatcccagagatctctggctgatatgaaaattagtctccttggtctgtttgcagggcagaccagcaccaggaaaaatcattctggcctgccccaagggttcagccatatgcttcgtccccaccccttacatttcacccacacacacccattcttggccttcccaaagatcttgggtgcaaaccaaactacagggtacactcttagtgagccagccaaactgcagggtagactgcccgccaggtctcccatcttagcccctgagcttgatcacagtgggaggctaaacatggaggaaaaaacctgagttctctccctcatccacatatacacacctgggataaggggtttccctggaagaaggcaggattcatgcgagatcgcaggctggagaagtgggaggtgcctgggccaggagccctctcagcatggttcagaaggcttggagcaagaagaccggtgactaaggactctgagggattctggatcctccatccccacctacatctattacatagtctgtgaccccttgctcaggccttgggggtcagcagcctaattctttgcataggtacatgttgggcgcatgggcctgaggctgtgggagaggacacgggtgaggctggtccccagactgaccacgtctttgtcttcgtctatccacagcccatggcagccaactataatgtcttcctcaacagctccaagctagctgagtggcgtatgcgggtggagctcaatatcagctctggcctctttagggaggcccatgatcgactaatgcagttggccgactgggacttttcaacactggattcaatggtcaaggagaatatttctgagttgctgaagaagagcaggtgaccctaggcgcagcctgtcccgcagggcctggctggcttagcaatctgagccaccttccttaaaggaaatactaaaacaaaaacaaaaacaaaaacaaaaaactgttctttgcctaataaagaactggaacaaccatcacagctgctgagcagcagacagttggcatatgcatagggtctgatgtgggagtgggtggtggttacagatccttccagtttccaaaaagaattttaaaagtaaagggttaaatatggttacattgtgagtaataatagttggtgacttcaatactccactttcagtaatagaaaaactacagaagaccatcaaggaaatagggaatttgaaaagcacgattaaccaatcgcatacactagacatgaacagaacgttccacccgacaggagcagaataagcattcttctaaagagcacatggaatattctccagtatagagcatatatttggtcctaagtctcaaatttaagatgattgaaatcacacaaagtatgttctctggacacagtggaataaagtgaaaaatcaagaacagaaggaaaactagaaaattcacaagcacatagaaattaaacagcacactcttaaacaaacaatgggttaaagaagaaatcacaagggacatcaaaaagtatcttgagcgaataaaaatgaaaacacaacatgcccagatttataggatgcagcagaagcagtgctaagagcaaaatttatagctgtaaacacataagttaaagaacaacgatcttgaatcaataacctaactttacaccttaaggaactagaaaaataagagcaaacctaacccaacaccagtagaaaacaggaaataataaagattagaatggagataaatgaaatagaaaatagaaaagcaataaaatcaataaaaccaaaaattggatctttgcaaagatcaacaaaattggcaaacctttacttagaatagccaagtgaaaaaaataagggtcaaattattcaccaagaaagaaagtggaggctgggtgcaatggctcacacctgtaatcccagcactttggaaagcagaggcagaaggatcacttgaggccaggagattgagaccagcctgggtaacacaatgagacttttttctaaaaaatatatatttttaaaaaattagctgggtgtggtggtgcatgcctgtagtcttagctaactgggtggatgaggtgggaggatcactcgcgtccaagagttcaaggttacaccgagctatgattgcaccactgcactccagcctgagcaacatagaagaaccttatctcaaaaaacaaacaaaaacaaaaatgaagaaactaaaaggaaaccagaaagaaagaaaatggagacatcacattggtcatagagaaatacaaaagtttagaaagaaatactatgaataattatatgtggacaatttagacaacctagatgaaatgggaaaattttagaaacacacaatctaccaaaactgacttaagaaggaagataaaattgtaatagacctgtaacaaataaagagattaaaatattaattatttttaaaaattccacaaagaaaagcccaggaccagatggttttactggtgaattcaaccaaaagcttgaagaactaacacaaagccttcacaaactcttccaaaaaatagaacaggaagaaatatttttcaactcatactatgaggccagaattactctgataccaaagacagaaaaagacattacaagaaaataaagttacaaagcaatatccttataaatatagatgtaaaaatcctcacaaaatattagcaaatcaaatccagccgcatattaaaaggatcatacaccttgaccaggtaggatttatcccaggagtacaaatgcagttcaacatacaaaaatcaatcaatgtagcataccatgttaataaaaagtcacatgatcatcctaatgcagagaaggcatttgacaaaatctaacatccttttacgataaaattactcagcagatgaagatgagaaaggaacttcctcaacttggcaaaaagcatctatgaaaaacctataactaacaccacacttcactcattgtgaaagatggagcatttcccccctaagatcaggaacaggacaagaatgttcattcacactacttctacttattagggcaattaggcaagaaaaaggaacaaggtggaatctagatcagaaagaaagaagtaaaaccatctctattcacagatgacattataggaattcttaaggaactcacttaaccattagagctaataaacaagttcaaggctgggcacagtggctcacacctgtaatcccagcactttgggaggctgaggcaggcagatcatgaggtcaggagtttgagaccggcctgtccaatatggtgaaaccccgtctctactaaaaatacaaaaattagctgggcgtggtggcgcatgcctgtagtcccagctactcgggaggtggagacaggagaatcactagagcccaggaggtggaggttgcagtgtgccaagattgtgccactgctctccagcctgggtgaccgactgagattccatctcaataaaataaaataagttcagcaaggttgcaggatacaagattaatacacaaaaatcagtagtatacatttgcaataaaggatcaaaaacaaaattaaaaccacacttccatttataatggcatcaaaaagaataaaatagttagaataaatttaaccaaagaaaagcaacacttcaacacagcaaactacaatgtgctgttgaaagaaattaaagaagtgccaccaagcaatctgacctgagaaaacatgcaggttcaacagaatgagtcctgctcttcagcaagcacccatcttgtgttcaagctgggtctatgaggcaagtttggcaacatagacaaggacatgcaaccaaatctgtaatgtagaaaaggccaagggaaggtggatcaatcattggaaacattcaacaatccatggaagaaatgttaaaaatagaatctcagggtctgatgaagttggaatatcactcttctatgtatttcggttggaatctgttgaatgattggataaagtaaaagataagtatagggaattattaggtagcattaaatgtgtaataaatgtaaagagagggagcaagtgcatacaaggaagtgtgcgctactgggtttctgttgaattgttcatggaagaccatcagcagttcaaatccaaaagcctgtcttaaaattagctgagtgtggtggcgtgtgcctgtaattccagctacttgggaggctgaggcaggagaatcacttgaacccaggaagcggcgattgcagtgagccaagatcgcaccactgtactccagcctggtgatagagcgatactccgactcaaaaaaaaaaaaaacttgtcttgagggactatgccaggctttacagctacaaacatcatggaggaagctgtctgcccattagaagcccagagcccggagggacagactagagcaaatcctctccctcgttggagctagatgggaacacaaatctatctgataactaacatgcaattttacatctcttaccttgtttaatcctcacaaccaccctgatgagtagtagtattatccccattttgtagatgaagaaacaagttcttcaaggggaagggatcctcagagtagcatatgaatgagaggcagaaccagagtcaggacctatatcttgtcttctccttcctaaaactagaaaagtacccacaaccaggcaatgcttttggtgcagaaaaagcagtagtgaacaaaataggcaaaaatgtctgcctttagtgctcacattgttgtggagaaagacaaacaataagcacagtagagaagtaaaaattagaatgttttgctaaaaagtccataaaattgaatattattcagccataagaagggatgaagtaccgttatatgctacaacatggatgaaccttgacaccattatgctaaatgaaagaagccagtcataaaaggtcacatatttcattattccatttgaatgaaatctccagaataggcagctacttcctatccacagaggtagaaagtagatgaatggtaaccaggggctaggggaagaggggaatggggagtgactctttattgggtacagagtttcttttttgggtgatgaaaatgatctagaattagataactgtgatggtgacaaaactttgttaatatactaaaaaccactgaattggctttaaaccaattgaattttaaagtatactttgaaagggtggatattatggtatgggaattatatctgataatgaaaatatgattacattgttcaaaagcatagggaagcagctacaaaaaatatgaatcataaattgtggctctttttattctgaagtgtagaaattgaatattatagctcaaaatataaaacaaaaacaaagaaagctaaaagcccttccatttggccatcttggagtaagacctaccacagtccagtgccttttactcagccccacagcctagcctattgtttacatgaaaccctgtagcttccactcctgtttggtgggtgtaaagttatgagtgaccatattgggggaagggaggaaaactccccataaacgtgtatcctgggggcctaaggagagacgatggcccaggtatcagaacatgatatgcctacttgtccctatctccttgtccacacataaggcttggaaggcagccatgttgtatatcacgtgatctccaaccaatgagctgattggcttcttcaacaagagcccaggtagagattggtgtctagaggagcccatcagattctagagaatcaggcctttggcagtggaaactcccctgggaggatgtcatagggtcctcagggtcagacacagagagaaggagacattgggacagagagaagaggcaagaaaaaaacatatcttgcagtctgtgaggaacagagtggcccccaggggcctccacctcaggttctggatcaaagctcctcaaagtttaaggtgcatttggatcacctgaggatcttatgaaaataaactctgtctgattcagtaggtctgggtttgggggtgggagcctgttagtatatttctaacaagctcccaggcaaggctgctactgctgctgatctaatgaccacagtttgaggctggacagagtggctcacacctgtaatcccaacactttgggaggacaaggcaggagggtctcttgagggtagaactttgagaccagcctgggcaacacagcaggacctcgtctctaaaaaacaagagagaagaagaaaaaggaaacaacaagaagactcaactagagtaggaagcagttaggccacatatctcttcaatggagaaaagagctttttcttgagtaaattggagtgtacccatgttccttgtcaatgatggtaactttaaatgtcaagaatgtgagagaggccaggggtggtggatcacacctataatcccagcactgtggggggctgaggtgggaggatcacttgagccaaggaattcgggagcaccctgggaaacaaagtgcgaccccgtctctacaaagtcaaaaaattagcccagactggtggcatgcgcatgtggtctgagctacatgggagggtgaggcagaaggattgtttgagcccaggttgaggctgcagtaagctaagtttgtaccactgcactcattccagcctgggcaacagcaagaccctgtctcgaaaaaaaaaaaaaaaaaagaatagtagagcccaggggaaggtgtggccctggggtaggcgctgggagactggagaacaactgttagtggtcccatcactgcccagagcagacagtgccctgtccaccctcatgagatctttgaactccttggacaggactggctataaatgaaaatgtggggacccttatttttaacttgttaagaatgttaagatggcaacagcaaagctttaaaccaagtgcatggcccttctgcgttgtaggcccacaaggccgacactgctattcacatccttgtatggtcccctaccctggagcgtggctggggcctgtgctctactgcttggaagcaaggcttatccctaagccttattttcgggaaggtggatttgagagctactatcccacatccttgcttggtgccctgtgaataaatcttttctcttttgcaaaactcgtgtcatggtgattaatttactgtgcaatgccaggcactgttggaaacctctggataggcctcacagggcctcagccatctcggggaggcgttagctagagtgtaacaaatatgaccccagcaactggggagggacagctcattccttcatgaggtgtggggctggcagccccgcaggcagtcagccacccttcctctctggcctccgtcctgggcactgggcccaggcactgggcaaggaggctgctgcacctcctttctcctcttcctttttttttattttttgagacggagtatggctctgccgcccaggctggagtgcagtggcgtgagctcggctcactgcaagctccgcctcccgggttcacgccattctcctgccccagcctcccgagtagctgggactacaggcgcccgccaccccgcccggctaattttttgtatttttagtagagacgggtttcaccgttttagccagtatggtctcgatctcctgacctcgtgatccgcccccctcggtatcccaaagtgctgggattacaggcgtgagccaccgcgcccagcctctcctcttcccttttagtgggaaatatacctgcagcctagattcccagaaaggggtggtgagagagcagacacgccactgattgacccgaagttctaggagccaagggatgagtgaagagggcgtggccggactcggggctcctggtgaggtgcaccgctgcaggctcggtgacccagcagttcctgcccaaccctcacctacccccagccgttcctgtccgccgcccccaaccagccattcctgcccgcagttcctgttcccgggcctgtccccgggtttgtccccagggcccgtcccctgggtttaggtctgccctcccacgccccaccccattgcccccgccatgggtctgctgtcccagccctgccgttcagtctacatcttcgccaagaatggcatccccttcgagcttcgcacagtggagctgaccaaagctgggctgggcaggcaggcccaggggatattggccgcggatccctgcctgtccccgctgctttgcagttgggccaagaatgcagactaacacgaagaatcagactctccggtgtggaaactattacataattatctatgttattatttttactttttggagacagcatctaactctgtcactcaggctggagtgcagtggcacaatcatggctcactgcagcctcgaccttccaggcttaagcgatcctcccgcctcagcccctcaagtagctgggactacaggtgcccaccgacatgcctggccaatttattattattattattattgagaggaggtcttgctgtgtttccgaggctggcctagaactcctgggctcaagtgatcctcttgccttggcctcccaaagtgttgggattacaagcatgagccgccatgccccactggttgtctattttaatagaggcttgatctttgcttgtgaatacaaaacattcttcaaaatacaggtttagagagggcacagcaggcacagaacgagggtagggaaatggagtggggcaagaatatcttcaccccatgtgcttggaaaaaacaatgaaactgcctcgttgtttcctaagtaaaatagtccctgtctacccctgcctgtgtctcttccacttttgtattatttgtttgtttatttatttatttatttatttatttatttatttatttatttattacagtgtctcaatctgcagcccaggctagagggcagtggcatgatcccggctcactgcagccttgacctctcaggatcaagtgatcctcccaacttactcctcctaagtagaatagttgggactacaggcacgtccccgtgcccagctacttttttctttggtgtgtgtagacgcatgattttgccatgtagaccaggctgaccttgaactcctgagctcaagtgatcctcctgcctcctccttctaaagtgttgagatcacagacatgcaccaccatgtctggccctgggtctcttccacttttatgtatttcttggcattcttctgccttttccttttcctgcatctgacttgctctatcccatggggcttctcacccagctgaaggggctactcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagagggaggaccctgctcagctgactcttcccaactgctgcccttggtacaaccagcttgagtcacctgctacagaacaggggctggacacagaagcagtctgtggagggagaatgggcaggggtgtgtatgtccattcagtagaagggcaaagaggcccacatgtaggcctatgatcagactggagcctggcttgactgaggtcctctgatccaaacaccaggcacctaatgcggcctctagcactggcctagagtgctaaagtgagtcagacctgggaacccccactggggagggagccttgagagtttggcataagaaagcaagaagagctgagccaccggaggctaagtagctgaatggggcagggattcccagcaagaatgaggttggtctgagggttgggaacatgtttggctgggactctggggtattgacaggtcacccagcctggccagtagggcctaagtccccagctgggataggaagctgaatcagagggggcaagcctagagcccagggaggaggctggaggggtctgacctatggatggaactggctgggggtggggtgtgaattacagctccagggaattgtccttgagccatgcttcaaggagctggacacaggaaagatggccctctgatggggtcaaggtctgtgacccagtgactagcagagaggcttcctcttccctgatgcctcccagataggggcctcagaaagctgctgctgggattttggggtgggggtgggcagagacctcagagaactctgggttatccccactcacctctctgatctttcctgcaggccagcagcacagcgatgcctttgcccaggtgaaccccctgaggaaggtgccgggccttgaaggatggggacttcaccttggctgagaggtaaccggtccgtgggctgctgccgggccttgtggggccagtcggctgtctgttcactgttgatggcttggatcatggactgtgggccctgcaccagccccagggtgaagaatgggtggaggcaggcagaggtgcccagtgttgacaagggttatagaagtcccctcctgcattgtacaagtgaggaaactgaggctggaggaggggagggacttgcacaaggccacagggcccagtctgcttccgggcctcctcaccgccagccttcccctccgaaaaaaggagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctgcgtccttctcctcatggatctcacattccattaatagaagggggagctgacagtaacccatgtaaacatggaacatatcggatgttgatggatgccatggaaaaaataaacagggtaagagtgggggtgtgtgtcattatgagtaggatgctgagggaagactccctggaggaggtggcatctgagcagggagctgtaggaatgtgcaaggcatgaggagaagggtgttctcactggagggaagagtgagggcgaaggctccaggtgggacaatgcatggggttcagactggagagcaacgggccagggtgggtgcagtgagcaggaagagcaggaggtcacgacagaggggagcatgggacactgggaaggctttggctcttaccgcaggtggattgagttgttggagagttttgagcagaggagaactgtgatctgacttacgtcgtaaaggatccccctggcaggggtgagaaagccactgcagtcatctggcatgcagcgctggagccccagaccaaggtggtggtggtgcagggttgcgggggattgtggtcagttctgacttttattgaaatctaactgcagggtttgctgaagggttggaggtgggtgggaaaaatgaaagccaaaaccagcctccaggttggtggccgcatggtggcgtcctttaccgaggccacatagtgcctccttggtggagctggattcacattcagagcctgggatcactggatggtccaacacccataaaggcatgatgagctctgagggtcagactgcacaacccttcaccataggtgaacgggagttgggacagggtgggaagcaatgctgccatgtcacctggaaggctctgtccctgctggccttgctcctggccctgtccacactttggatatgttggggagatatccaacatgctctcgttcttcagactcacactgggtgccccttcctcctggaagccttccctgagcccctgctgaagttcatgacattttgtttcttccttgctgcccttagttgagatgacagtctggccccgtgtagggctgtgtgaccctgggtagttacctaacctctctgagcctcacatccctcctctgcatcatggggatagtgaaaatgccccagaaaacggttgaagagtgttcagggcatgtcttctgcccctgccatgtccccccagtgtggctagcttgctctatatgagctgcatgtacaaagcacctgaccactggtacctccaggacctgcaggcccgcgcccatggggatcagtacctgtcatggcagcacatggccctgcagagtagctgctgctgggccatgtggcagacggtgagccatggagggcagggacacctcccgggatgcccaagggatgctgctttcactttacaaaattctgtttagacctgagaccaaatcctggaatgccagagactgcctaattcacccaacttgtttcataggagggaaaccaaggaccagagccaaggaaggattcccctaatgtgccttaattccacagctaccacctgcacacttacactcacacactgttcgacacacagccacactcacacacacatccacccacgtccacccacagtcacacgatgtatcacattcacacgtatacacccacacacacaatcataacatttacacacagtcacacagttaactcctatacacacatatacacccacacaatcacacaactcactcatattcaacaaagtcacacaactcactcacattgacacacatacacaccaaccccacacacaattcacatacatacacacacatatacacccacatacacaaccacaccattcactgacattaatacaaagtcatcacacagttcactcccacacacacacatacacctcacacacacaggcacacaattcacaccaacaaaatcacacagttcactcattcacacacatacacccacatacacaaattcacactgctcagtcacatttacacaccattcaaattcacacacatatacacctacatacacacagttcactcacatcacacacatatacacccacatacacacagttcactcacatcacacacatatacacccacacataaacacagtcacacaattcactcacgttcacacacacagttcactgacattcgcacacatacacacacaccacacacaggcaattcagtcacatggccgaaagccagtccttaccttcctatagttcctttcccagtgtcacctcagcctttggccctcagcgtccccttcccatgcctggactgcggaagagccctgaacacaccccatcttcatgcctccagcgctagcccgagcccttccctctgccaagagcactaagtgcaactcaagatcacttctagggacccttccctgcccctgctgccaggtgacctgaggatcctgctggtcccgcttgacaatgatgcacagcatggttagttcagctgaggtcgctctcccagacttactgccacctacacagcactaggactgactgtttaactttattctttatttcgtgtactttattggagtgtctgttgaaagcaaaaccatccaataaggaacaatcccaaggcagccagcatggatcaagaaggcacaggctgtggccgccatccccagtgcctgatggggagagggggtggtaatggaaaaggcccaggaaagcaggccagagtgtccctcaaaatatgagaaatcactggaagagagagccagaatgggacctaagacagaagccaccaccaggcacccttaaggcaggacagttgcaatggttacttggaatacttccggctaggagtggtgttgcgggaagtcagggaccccaaacagagggaccggctgaagccatgacagaaaaacgtggattgtgaagattttatggacatttattagttccccaaattaatacttttataatttcttatacctgtctttactgcaatctctaaacataaattgtaaagatttcatggacacttatcacttccccaatcaataccgttgtgatttcctatgcctgtctttactttaatctcttaatcctgtcaaccaaggaggatgtatatggcctcaggaccctgtaataattgcattaactgcacacattgtacaggatgtgtgtttgagcaatatgaaatgtgggcaccttgaaaaaagaacaggataacagcaattgttcagggaataagagagataaccttaaactctgactgctggtgagccaggcggaacagagccacatttctcttctttcaaaagcaaataggagaaatatcgctgaattctttttctcagcatggaacgtccctgagaaagagaatacgcaccaggaggtatcagcttataaacagcacccctgggcgtggcctgtctcttatggtcgagactgcagagatgaaatatactccagtctcccatagcactcccaggcttattaggaagaggaaattcccacctaataaattttggtcagaccagttggtctcaaaaccctgtctcctgataagatgttatcaatgacaatggtgcccgaaacttcattagcaattttaattttgcctcggtcctgtggtcctgtgatcttgccctgcctccacttgccttgtgatattctattaccctcttaagtacttgatgtctgtcactcacacctgttcgcacactccctccccttttgaaaatccctaataaaaacttgctggtttttgtggcttgtggggcatcacggatcctaccaacgtgtgacgtctcccccggatgcccagctttacaatttctctcttttgtactctctccctttatttctcaagccggctgacggttaggaaaaataggaaagaacctacgtgattattggggcaggtcccccgatagagtggcacatgatgggcacagggcaggcttgggaaatggggggccgtaaggccacaagacatgtgggcaggtagcccagagtgtgtctggaacatcctgtttattggtcggcagtgacatctactgtcacatttgagaactgcatccacagccacatgacctcctgtgaagacctcagggcaaactggggaaacctgcccttcttggaaggtgatactaggggggatgagcaacacctttcttggaggtttgaattcttcagggcccctccagcatcttggtcttcctaattcctcccttgatcccccagccctaggggtggtagcttcttgcagtgtttacctccgtgttaatctggattctctctgtcttcggagttctctaatgcctggttaccaattctttatatcaagttctctccgttaaaatcattgtggtggggtccatcccatggatatacatggaggtctgtgtgacaatgtataatcttactatttgcagttattacaaaactgtcctagaagacatgaatgcttgttaaaagaaatcttttaagtttcctagacttcaaagaccgttgctatgccctgtgaaacatcgcctatatcctttaacagtttgcaattcgaattggttacttacttaacattttgttgccctggtgatacaattatgttgactcgttattgtgaggttactttgttattaaccatgatgaggattactagcacatacttttactccatatgtataacacaacaatgtagtaaaaccaataactcttggttctctattcaaagtgtttggaatctttattctgtttaaaacactgatgacatttgccaatttttgagtgttcttcatgttactgatttgtaggagctctttatatattgcagatttagtctcttactggttatgtatgctgcacctgaggagtagcagcactgccaaggacactgagtgtcttgtctgtgcagagcttcacatgaagctggagagaagggactggggcaagagggaaagataaaaaggggcaagtaagtaacagaatgaatccttgttgctaatctcctggcccccatcccagacccttcaggggatcctggcgattcgaagcagcatagcctgataggcctctggtgagggtgttgggagggttttcttggccgcctgttccaggatgctcaagatgatgctgtgggcctcctggcatagctcagcacccaggaaagcctccactcgtccacgccatgctgccagtcgtggccgtccctcaaacagttcatagccgagagccaccggctgtagggacaaggatgaaaaagttgtgggcatacaactttcccagttgtcactgccgacccgaatgctggaaccatgggcagaagtatcagagacatggtccattccccagcccctaagtgaatggaccacaggggcccaggcagtatgttcagccttagagcccaagagcagccagggtgagaccccacacccaggcaggaggcagaagttcagggttctggccccagatcatccagagacttgctctatgattctgggcaaagttctggctttctccaggcctcagtgtttctgtctgcctcatgggtgtgacacgaagagggacactgcccacaggctgagctcacacctgcatcagctcctccagggccatgagatcagccagtgtcacctgctggccagcgaggaagggcctgtcccccaggaacttgtcctccagccattgcagggcctggtccatggcagtcctgttgcgttccaccttctcctcgggcacctggaccccaatgaggggccccaacacctgatgggggcagagagtgggtcagtctatggccccggcctactgccaactactccctgatggccaatcactctccagatggctctcctcacctggacccacaggggtataccaaaggtgccacggatgcagtcggcatgccagcccaggtactcatgaacacgggcacgagcctgcaggtcagatggataccagtggtccggcgtctggtacttacagctcaggtaaatcaggatggccgagctgggaacaaatgggcagtggctataaggacactggcaccaggcatttacccctaactgctcccatctgccagtggggcccgggggcttctctgcatttgaaggactgccctccagcctcgccctccatctccagctccccaacaccaccccctcctcctacgagtctcctcctgtctttgttgccttgggcaccgactcttggctggaccttctgctttgcattttgagaacctcatctctgtgatatgccagcagccgccctgtgaggtagacactcctgttagccttttagcacaagagaaaactcaaggtcagaatggtcaagtgacttgtccgaggcggtgcagctcagaataggctccctggacccctggaaccctgcatggggctggcacacagtggatgctccgtggagtcccttgcatgtccacgcgcttgggtcagggatcacgaggggaggaatgtctttggcccccgtctgacaggcccccagccatcacttctgcagccacctgacctcttgtccttttcctgcccagcagctggacctcaccatgagctgtgcccttgggccatggcattggcctctaggcccggcctgggtagattgggtagtctgcgacaagtcactagaggctcttttcagctagcatttgttgaacaaatgcgcaacagtggaaaaatgttcccttgtcttctcttctaatacccttcagtctgggagtggagaggccctgcggctcagaaaaggctggaagatgagaggtggggggacatgttctgtcagcccctgctcatcccggtcacaccccaagctgtaccttctccccagatacctctcctttctttctttcctttttttttgagacggagtctccctctgtcgcccaggctggagtgggctccctctgtcacccaggctggagtgcagtggtgctatctctgctcattgcaagctccgcctcctgggttcacgccattctcctgcctcagcctccccagtagctgggactacaggcggccgccaccacgccctgctaatgttttgtatttttagtagagacagggtttcaccgtgttacccaggatggtctcgatctcctgacctcgtgatccgcccacctcggcctcccaaagtgctgggattacaggcgtaaaccaccgcgcccggcctttttgagacggagtctagctctgtcgcccaggctggagtgcagtggcgcgatctcagcacactgcaagctccgcctcctgggttcacaccattctcctgcctcagcctccagagtagctgggactacaggcgcccgccaccacgcccggttaactttttttccatttttagtagagacggtgtttcacggtgttagccaggatggtctcggtctcctgacctcgtgatccgcccgccttggcctcccgaagtgccgggatgacaggcgtgagccaccgcgcccggccagatccctcgcctttcccctccctcgctgccccatggggtatgggagggccactggggcccggggccagtggggagagccaaggtcacatgggctccggatgcggtgaggggtgagggaaggagggcacctttcagtcaagatgaaatcaccatccttgagcgtcggcagtttccccaggctgttgatctgcaagaactccttgctcttgtgctgccctgaagaggaagaagtcagaaaaggtcttcagaataaaaacgctgcacctctacaccctccctcctcctccccaagcggagccccacagccctgagaaacagcaaggtctgggactagaggcctggatcagcctcactccctggctgggcctccctgccctgccacattccggggcagctggggggttttggtgggtggggccaggtgcagcaggtggataaagagaagttttctagccggactctggtgggccaggggaggggaggcaaactggggtggctcatctcttcccatctcttaattctcacaacagtatgtccttcttcccgaggtcttctgggctttgtgaatttatatgcgtgcattccacgcaagaactctgtcaactccattcagtattttctttccatccctacagagcagaaggtaacgttatcctccttttcagaaggcaagctaaggttcagagaggctgtgatcccttcaaggccactcagtccacagcattctctggtggcagacgctgcaggaggaggtgagggggctgtgcgggcggcgagacgctcagggcagagcagggcgggggcctgggggtgcactgggtttgtggacacgcggggaaacgggctgggcccacctttgaccaaatccacggtgcgcagctctaaggggatgccattcttcttggcgaagatgtagacggcgcggctgggctgggacaccaggtcaagaaacagctctaggcccatggcgggggcggcaaggacagcggggatggcagtgaaggcgctgagcgcggtgtgggcagcagctgtggcaggatcccggcgcgccgggaaataggggatcaggccccaccccctggggacagcacccaattggagcgcaccacccccggacccgcctcgccccttcggttcctgtccagtcctgccggccaagactccaccaccagatccgtgcgtccctacagggagggcggtcgctatgaacgcacagctgggagggtggagttggagctggggaccctcgactggcagggaggacgcggatgcagggggccgactgcaaggggaaggggaaccggctggacagggagaagcaggtctgcttttcgggatcccggtgccagggaccctgcccagttccaggcgtcgccctgacccagaaacgactgggcgccgccgtcctggaaaggccccagcgcacggacatctgagggttcgttcagagctctgtttctcggcgctgcatggtggcggaagggagggagcgaatgggatcccctaaaagggatcttagagtttcacccagtgggatgtgacacttgcaggtgtcccaaactggtgggaaccttgactggaaggctggggttaaggatgaactttctgccgtccagactgtcccctgcagagcagctgctgccagacagcgggagctgccagacagcgggagctcccacttcgtgcacaggatgggggcagggagcccgcagccgcgggaggcaggaatgactgtccgggaacctcctttcttctccctgaatcccagccctggcatctcaccagggggcacagtgatggtccagggctgggcccgggactctagctgaatctttcagagtatcccatccctctggccagtggcccaagcgagtgaaccagaatgcttccttgggagttttgaaactggaactggagagaggagctccctatggggaggtaaacgggagctggggccacctgtagtgacatttcctgagttcgaggagtagacgagactgagagagaaaagctgactcagagaaagggagtgataacagggcatgctggcccacacctgcaatcccagttactctcacgggatctgtttctctgatgtctgggtatgaaaggactttctaagcctcagaacagtgggagaactcaacaaagaaaaaaccaatacatatacaaggttactttgtggaggaaaaaatggattaaccttaagcaaaaaactgggaaggatctcggtaaaagatacgtcagaaggaagtaatgtcctttaagatgttcttagaaacccatcagacaggtggggtgtggtggttcacgcctgtaatccctgtactttgggaggcagagatgggcggatcagttgaggtcaggagtttgagaccagcctgggcaacacggtgaagccccgtctctactaaaaatacaaaaattagctgggtgcggtggcacactcgggaggctgagacaggagaatcacttgaaccttggaggcagaggtttcagtgagctgagatcataccactgcactccagccgggccactgagcgagactgtctcaaaacaaacaaacgaacaaacaaaaagaagagaaactcatcagacgaagacacaggaaaaaaatgagcgaaggaaatcagcagaggtttcattgaaggacaaagagaaatggtcaatacatggatgaaaacatgtttaacttcagtaataatcaaggaagcacacaccaacacaacatgcacatactgtttttatttatcaaaggcacacatatttttgaaatgagtactcctaattaatatgtacagagcacttacccagtgcccagcacaggggtggcaccctgtgtgtgagacagcatgaaacaggtagacacgcgccctgctgaaagtaagggaccgcctctctggaggatccatcgggcaataaggaggtttccacaccttaactgtgtctgccttgacctctggggcctgggagcagagccccctccagctggtggggaaggaagcgtggtgtgtttgaggacagaatggagagaagttgagtagagcaagtgtagactcttcctatccaaagtgtggtcaatggactgggagtatcagcatcaccagggagcttgttggaaatgcagaggctcaggccccactctgaccttactgattgggagcataaactgtaaccagattccagggaggattcatacacacattcccgtttgataagtggggggtagtaggaggtgaggtgaaaagtggggaggggatggctaccgcactggagaaggctggctttgtgttgaggcctttctcatgagggcagtggggagccatggaaggctttatgcaagagagggtacgggcagattgagattacagaaggatcccactggttgccttgtgtgaggacccagggagaagggggaggctgtccctgtttgagtaggagatgagagctactggtggctatgagtggaaagaagtgagcagaggtgagcagaaatcccaaggactggtgatgataggatgatggtgggaaccaggatgggctttgggcagaccctgacccctctctctgcctgtcggcccaccagataataatccctgtgttcctgggcgagtcagtgccacccgagatgttggcggccactttggctgagctggacggatgcctgcagctgctcgaggacaagttcctgcgggaccaggccttccttactgggccccgtatctctgtggctggcttggtggcaatcacggagctgaggcatgagagtgccatggggtgcggtggcccgctgggcagtggtgtatccgggaagggagctgacatcccagctcatgttgtcttttctggctgtgggaccctgtgtgagtcacttctccttctgagcctcagtgtcctcatctataaaatggggctttacaaacccctcaccgcagctatattaagaggcttccaagtgtccccagggagggggacatcctagcccatcacacacatggtggaggagggaaaatccaatcagagaacccctaaagcaggtcatgctgccttacacttggctatgcccagcccctccgctgactctgtcttcccctagcccatcagtgctggctgctgagtctttgaaagcggacccacggtggcagcatggtgcccaacacgtggaggctgcagtgcgggaggacctcttccaggaggccctcccagctgtcctgaaggccaaggacctgcctccagtagaacctgctgttaaagagaatctgaagaccttaatgcagcttttcttgctgtgagtgcgtgtcccacacttgctgagccactgaggggatgctgtgttggtagaataaagacatggagctgtccgtctccttggttgaagagaagacatatctgcaaaggctctggtccacagttcctccagatatcatgcctgcattccttttgtctcctaccccattccattctagcttccatgtgacctctgaaaagagcttgggcaaacgcttacttgaccctgaccttctgtgtggaactttgtatggttcctcactgcccagaagctaaagtacaagtcattgaactttgcattcaaggccttgctcccactcctccaggtggccccttctgcctgcacactcctaacccctctctgggctcccaccttggcctcttggcctccgctcatgctgttccctcctcatcttcgcctggtgcccttcctggtcttttggcatttggcaccctgtctcttctccagggagacttccctgacctccccagccccagtccaggtcaggcgacctctctgggctcctcagccccagtgtttccttgcgggggatacccccggactgagcatgtatcatcgatgaggggtgacctggtggaaagatgtctgaatcaggatcagccttggtctcctcggtctctctcctcactgtggggcgatgttgtgttccacaagtggggtgcagggctggttcatgaacctccttgcaggaagggaagtccctggttatttcctggccctctcccatgcctcctcataaccttgaccacagtcttctctacaccccactcccggaccactggcttgtccatgccccacacctggtcccagacttgccacctgtccctgccctctccccttaggactgtcatatttacctgtcgtgtgtctcagaccttctgatatctgagtcatctaataaacaaactgctaataggacaagatcatgacagacagagactctgtcggcctttcagtggaggctcctttaagtatgcacacttatagagaattttatacacgtagttgaaattgtacatataaacttgcaaattttttctttcttttttgtgggggaggggggagcctgggtctcactctgtcatctagggtggagtgcagtggcacagtcatagctccctgcagcctagatctcctgcgctcaagcaatcctcctgcctcagccgcccaggtagctaggactacaggcacacaccacagcacccagatttctttctttttttttttttttttgtagaaaataaagaagagaatcttgctatgttgcctagcctgatctttaactcctgggctcaagcaatcctcccttcttagcctcccaaagtgctgagattacaggtgtgagccacattgctcgaccacaacttcagtcatatttgtaatgtacaattcaagtgattttgccacactgaccacactcatgtttaagccacgccaacagagttccatgttttctgatgttttttcgagatggagtctcgctctgtcacccaggctggagtgcaatggcgcgatctcggctcactgcaacctccacctccccggttcaagcgattctcctgcctcagcctcccgagcagctgggattacaacgtctgccaccacgcccggctaatttttgtatctttagtagagacggggtttcgtcatgttggccaggctggtctcaaactcctgacctcaggtgatccgcccgcctggacctcgcaaagtgctgggattacaggcgtgagctaccgtgcccggcctttccatgttttaaagaacatattttgccaccccctggtggacagtggctcaccaccggcacaagaggctacacaggcagatgtcaatggggaccaggcagggacaggtattgtcgtgagcctagccctacccgcgcccccgcgagtaaccacatctcctgactgcccaagcgcagatttccatactgaacatgaaattgcctgacttcgaaatggtggcaaatcattcaaaaaaactttaagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggacgtaagcgtgggccgggcagcacggggcgaggggaggttggtgggccaggggtccggccctgtccctgctccgcctccccgacagtgaccccgaatcttttccccagggaccactccccactcctttcctcacgccaagctctgactttccgtgctccacgatcccgcggctccccctccgcacgtctttcccttgtcgccctccccagtcatgacccgggcgtgaccttcagggaccgcggcccgtatcgggatccctgccccgcgaacactgcgcgtttcggctttcgcgcgctcgggtcccgtccccagaggtagcccggccggctccaacttcgggcaaaacttttcatgtccccctcagcgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggtgcgtaggggtagtaggggatccatgtgggactgccgcagactggagccactgatcctgcctcagggggaaaaacccatttcttgccctgcccagtaaggacacatcagggtctggagctttggggccccctgaccccttaggttcctgctgttaggaccatcttcaaagtgcgagcaggattgaatgaatttctggctctgctcctcagtgtgtaagtctgtgaaccgggaaggctctcttttaacacccccggggcagtgcaagggtcatgtgggattgtctgtgtgctgtacctgccttggcacctgacagggtaggtacacgtggctgaagtgtgattttctagaacttttccaggctggtcagaaggaattctgggtatgttctgaagttacgtattttggacctgtgtcccagccaggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaagaagcgtctgcaacccaaacctggcgttctgtgaccgagttaaagtttcctcttgggtaaaagatattcttgagccacatccatgtctaggaggaagtaagggcatgagaagcttgaaaggacactgtccaggcacggtggctcatgcctgtaatcccagcactttgggagaccaaggcgggaggttcatttgacccaggagttgtagaccagtctgggtaacatagtgagatgccatcccccaaaacagttttaaaaattaaccggacatggtggtgtgcacatgtagtctcacttagttggcaggctgaagtgggaggatggtttcagcccaggaggttgaggctgcagtgagctatgattgcgcattgcactccatcctgtgtgacagtgagaccttggctcacaaaaaaagaccttctgaaatggagcctttgttagtccatgaaggtcgatgaggaatggctgatcctgctgggtcctccctcaagctacagaggaataatacagtcagccccctgtatcactgggttacgcatctgttgattcaaacaaccatggattgaaatattagaggaaaaaaaattgataattgcatctatactgaaaatacgtatagactttattccttgtcattattccctaaacaatacaactatttacatagtacgtacattatattaggtattataagtaacccagagattatttaaagtatatgagaggatgtgtgtaggttacatgcaaatattacaccattttatgtaagggacttgagcaaatgtagattctggtttcctctggggattctagaacaaatctcccacggatactcagggaaaactgttactctaacaacaagtgttatacacttaccatgtgctaggtcctctacaggtactttacactcatgatcccatttgatccttacaatccctatccactctccctttgctcagacaagacatgctatccccatgaggtagataatctccattatgccaattttatgatgagaagactaaggctcttcatactcccccgccctcagccaggctgtcccaagctgtggcgctcctcactgaaaactgctgtcacctctgagaggggcatgttggcttatggcacagacattagtggtgggggggccaccctgtgcccaacctttgagaaaacaggtgtctgaggtactgtgtccttagggagtctgcaattaggaggaggcagattgcccctcagcccacagactgacagagatgatggagtgtgcagcacacacgatgaggctactgtgttgagtgtctgtcctaggtgggtcatgctgatgtgcagccaccattccacacctgagtgtcccactgccctgctgggggttggggaatgctcattaccgggatgagcacttttgcaaaatgggctgaggtgggaggatcacttaagcccaggaattcaagaccaccctgggaaacaaagtgcgaccccatctctacaaagtcatacaattagcccagcatggtggcatgagcctgtgatccaaactacatgggaggctgaggcagaaggtttgtttaggcccaggaggtcgaggctgcaataatctgagtttccaccactgcactcactccatgctggctgcctttggattgttcctaattggatggttttgctttcaacagacactccaataaagtacacgaaataaagaataaagttaaacagtcagtcccagtgctgtgtaggtggcagtaagtctgggagagcgacctcggctgaactaactgtggtgtgcatcattgttaagcagggccagcaggatcctcatgtcacctggcaggaggagggacagggaagggtccctagaagtgaccttgagttgcacttagtgctcttggcagagggaagggcttgggctagtgctggaggcatgaagatggggtgtgttcagggctctccagcagtccaggcatgggaaggggacgctgagggccaaaggcggaggtgacactgggaagggaactagcaaggtgaggactggcttttggccatgtgactgaattgcctgtgtggtgcgtgtgtatgtgtgcgaatgtcagtgaactgtgtgtgagtgaattgtgtgtttatgtgtgggtgtatatgtgtgtgatgtgagtgaactgtgtacatgggtgtatacgtgaattttagtgaattgtgtgtaaatgtgagcagtgtgaatttgagtatgtgggtggataagtgaattgtgattttgttggtgtgaattgtgtgcctgtgtgtgacggggagtatgtgtgtgtgtgagtgaactgtgtgatgactatgaatgtcagtgaatgctgtgattgtgtgtgtgtgtgtacgtgtgtggggatttggtctatatgtgtgaatttgagttgtgtgactttgttggatgtgagtgaattatgtgactgggtgtatatgtgtgtgtacacgagttaactgtgtgtaaatggtatgattgtatatgtgtgtgaatgtgatgaatcgtgactagatgcgggtggatgtgtgtatgtgcatggtgtgtccatgagtgtgtaagtgtgcaggtggcacagttgcaacaggagagaagacacaggaagccttacctgccattcatccccccagctgtcctcccagcctggggacccctgggctggaaaggttatgaaaagtggtgctactgccaggaaggggtgatggggcagctgggaggacggtttgagtcttgccaaagggagggagtcgaagcttgcaaccctggggaggaggaggggcagactggggaccctgcttctggaaaaccagcgaccaacccccaaagggacacaggcaacccctgcctccactctacagtggggaaaaggggagagtggcgtggcaggctgcccagccagtcatggagggagtagacttcaggaggagtacagaggtctggtcccattttggggctgaggacaggagcctcaggtcagcagtctgcaggaaggccccagctggaccagctgctcacaccttcccacaggcctgcagatgggtgtggagagcagagcctccaggctgagtctcccagccccagatctgagcagtctaaatcatccccctccaggttccctacggtcttatccaccagccctgctgcccatggtggccccagatgcccaggagagataatagaaggtaagaagtcatgtttgaatgaggaagctctcttcatttatttcatatgaggatgaagaagaggattatgtgatcacaggaatgttgcatgcgggataatccaaagctggttatctccaggccctcactctgccaagagatctctctggaagaagcagccagttcacagatgccctggatccctccgtgcccaatcataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggaggtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacagggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatgcaattatcaattttttttcctctaatatttcaatccatggttgtttgaatcaacagatgcgtaacccagtgatacagggggctgactgtattattcctctgtagcttgagggaggacccagcaggatcagccattcctcatcgaccttcatggactaacaaaggctccatttcagaaggtctttttttgtgagccaaggtctcactgtcacacaggatggagtgcaatgcgcaatcatagctcactgcagcctcaacctcctgggctgaaaccatcctcccacttcagcctgccaactaagtgagactacatgtgcacaccaccatgtccggttaatttttaaaactgttttgggggatggcatctcactatgttacccagactggtctacaactcctgggtcaaatgaacctcccgccttggtctcccaaagtgctgggattacaggcatgagccaccgtgcctggacagtgtcctttcaagcttctcatgcccttacttcctcctagacatggatgtggctcaagaatatcttttacccaagaggaaactttaactcggtcacagaacgccaggtttgggttgcagacgcttcttgtgggggagggaggtcttttcccctgtattcacagaagaggaggttgccaactggagatggttcatttccaagtttgtctggggtcccccagctatgcaggacccagaaagcagatgtctagacatccaggccaatggtctttcactactctgtgagtctcccgtgaacttcacctggaacctggctgggacacaggtccaaaatacgtaacttcagaacatacccagaattccttctgaccagcctggaaaagttctagaaaatcacacttcagccacgtgtacctaccctgtcaggtgccaaggcaggtacagcacacagacaatcccacatgacccttgcactgccccgggggtgttaaaagagagccttcccggttcacagacttacacactgaggagcagagccagaaattcattcaatcctgctcgcactttgaagatggtcctaacagcaggaacctaaggggtcagggggccccaaagctccagaccctgatgtgtccttactgggcagggcaagaaatgggtttttccccctgaggcaggatcagtggctccagtctgcggcagtcccacatggatcccctactacccctacgcaccggtcctggcccagggctagctccttggtgagaaactcaaagaagtgggcgctgtggctgcggttgtcctcggcggtgcccactacgccgatggaggagatggacagctgcgcgcagggctcggtggacccgctcagcgccatggccaggcccggccgtaccgtcacgttcacgcgctgagggggacatgaaaagttttgcccgaagttggagccggccgggctacctctggggacgggacccgagcgcgcgaaagccgaaacgcgcagtgttcgcggggcagggatcccgatacgggccgcggtccctgaaggtcacgcccgggtcatgactggggagggcgacaagggaaagacgtgcggagggggagccgcgggatcgtggagcacggaaagtcagagcttggcgtgaggaaaggagtggggagtggtccctggggaaaagattcggggtcactgtcggggaggcggagcagggacagggccggacccctggcccaccaacctcccctcgccccgtgctgcccggcccacgcttacgtccgcaggtttgcccaggatggaggcagcggcggcgcagagtcgtttctccagccccgcgggcactcggttggcgggcaaattcgtgtccagctccaggaacggcatggcgggcagaggaacggaaacagctctggcggaagaaaagctgggggtacccaaggctcgcggaccagggaggaggggcgaggcgccacagcaacctggcttctcattggctggacagagactcggcgctccccgattggctgcctagggtacctcccgcttctgcaaacaaaagtcacgtgtgccggctgatttccggaagtcccatcgtctccgccctacgtgtagccccacccactacaggtctttaacccggtagtggacccaccctgtctcccccgaccctcctgcctggcgccaggtgggtttccctctcaagcttccgcgctgtggtcgcccggttcctagccctattagaggtctgaacaccacacccccgacacacaaggacacacacacacctataggggtcttccccaggctcgaccctaataaccaatacaacgggagcttaaagtttttttgaatgatttgccaccatttcgaagtcaggcaatttcatgttcagtatggaaatctgcgcttgggcagtcaggagatgtggttactcgcgggggcgcgggtagggctaggctcacgacaatacctgtccctgcctggtccccattgacatctgcctgtgtagcctcttgtgccggtggtgagccactgtccaccagggggtggcaaaatatgttctttaaaacatggaaaggccgggcacggtagctcacgcctgtaatcccagcactttgcgaggtccaggcgggcggatcacctgaggtcaggagtttgagaccagcctggccaacatgacgaaaccccgtctctactaaagatacaaaaattagccgggcgtggtggcagacgttgtaatcccagctgctcgggaggctgaggcaggagaatcgcttgaaccggggaggtggaggttgcagtgagccgagatcgcgccattgcactccagcctgggtgacagagcgagactccatctcgaaaaaacatcagaaaacatggaactctgttggcgtggcttaaacatgagtgtggtcagtgtggcaaaatcacttgaattgtacattacaaatatgactgaagttgtggtcgagcaatgtggctcacacctgtaatctcagcactttgggaggctaagaagggaggattgcttgagcccaggagttaaagatcaggctaggcaacatagcaagattctcttctttattttctacaaaaaaaaaaaaaaaaaagaaagaaatctgggtgctgtggtgtgtgcctgtagtcctagctacctgggcggctgaggcaggaggattgcttgagcgcaggagatctaggctgcagggagctatgactgtgccactgcactccaccctagatgacagagtgagacccaggctcccccctcccccacaaaaaagaaagaaaaaatttgcaagtttatatgtacaatttcaactacgtgtataaaattctctataagtgtgcatacttaaaggagcctccactgaaaggccgacagagtctctgtctgtcatgatcttgtcctattagcagtttgtttattagatgactcagatatcagaaggtctgagacacacgacaggtaaatatgacagtcctaaggggagagggcagggacaggtggcaagtctgggaccaggtgtggggcatggacaagccagtggtccgggagtggggtgtagagaagactgtggtcaaggttatgaggaggcatgggagagggccaggaaataaccagggacttcccttcctgcaaggaggttcatgaaccagccctgcaccccacttgtggaacacaacatcgccccacagtgaggagagagaccgaggagaccaaggctgatcctgattcagacatctttccaccaggtcacccctcatcgatgatacatgctcagtccgggggtatcccccgcaaggaaacactggggctgaggagcccagagaggtcgcctgacctggactggggctggggaggtcagggaagtctccctggagaagagacagggtgccaaatgccaaaagaccaggaagggcaccaggcgaagatgaggagggaacagcatgagcggaggccaagaggccaaggtgggagcccagagaggggttaggagtgtgcaggcagaaggggccacctggaggagtgggagcaaggccttgaatgcaaagttcaatgacttgtactttagcttctgggcagtgaggaaccatacaaagttccacacagaaggtcagggtcaagtaagcgtttgcccaagctcttttcagaggtcacatggaagctagaatggaatggggtaggagacaaaaggaatgcaggcatgatatctggaggaactgtggaccagagcctttgcagatatgtcttctcttcaaccaaggagacggacagctccatgtctttattctaccaacacagcatcccctcagtggctcagcaagtgtgggacacgcactcacagcaagaaaagctgcattaaggtcttcagattctctttaacagcaggttctactggaggcaggtccttggccttcaggacagctgggagggcctcctggaagaggtcctcccgcactgcagcctccacgtgttgggcaccatgctgccaccgtgggtccgctttcaaagactcagcagccagcactgatgggctaggggaagacagagtcagcggaggggctgggcatagccaagtgtaaggcagcatgacctgctttaggggttctctgattggattttccctcctccaccatgtgtgtgatgggctaggatgtccccctccctggggacacttggaagcctcttaatatagctgcggtgaggggtttgtaaagccccattttatagatgaggacactgaggctcagaaggagaagtgactcacacagggtcccacagccagaaaagacaacatgagctgggatgtcagctcccttcccggatacaccactgcccagcgggccaccgcaccccatggcactctcatgcctcagctccgtgattgccaccaagccagccacagagatacggggcccagtaaggaaggcctggtcccgcaggaacttgtcctcgagcagctgcaggcatccgtccagctcagccaaagtggccgccaacatctcgggtggcactgactcgcccaggaacacagggattattatctggtgggccgacaggcagagagaggggtcagggtctgcccaaagcccatcctggttcccaccatcatcctatcatcaccagtccttgggatttctgctcacctctgctcacttctttccactcatagccaccagtagctctcatctcctactcaaacagggacagcctcccccttctccctgggtcctcacacaaggcaaccagtgggatccttctgtaatctcaatctgcccgtaccctctcttgcataaagccttccatggctccccactgccctcatgagaaaggcctcaacacaaagccagccttctccagtgcggtagccatcccctccccacttttcacctcacctcctactaccccccacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggcggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcatgttgtgttggtgtgtgcttccttgattattactgaagttaaacatgttttcatccatgtattgaccatttctctttgtccttcaatgaaacctctgctgatttccttcgctcatttttttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttaaccccagccttccagtcaaggttcccaccagtttgggacacctgcaagtgtcacatcccactgggtgaaactctaagatcccttttaggggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatcccgaaaagcagacctgcttctccctgtccagccggttccccttccccttgcagtcggccccctgcatccgcgtcctccctgccagtcgagggtccccagctccaactccaccctcccagctgtgcgttcatagcgaccgccctccctgtagggacgcacggatctggtggtggagtcttggccggcaggactggacaggaaccgaaggggcgaggcgggtccgggggtggtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaaggtgggcccagcccgtttccccgcgtgtccacaaacccagtgcacccccaggcccccgccctgctctgccctgagcgtctcgccgcccgcacagccccctcacctcctcctgcagcgtctgccaccagagaatgctgtggactgagtggccttgaagggatcacagcctctctgaaccttagcttgccttctgaaaaggaggataacgttaccttctgctctgtagggatggaaagaaaatactgaatggagttgacagagttcttgcgtggaatgcacgcatataaattcacaaagcccagaagacctcgggaagaaggacatactgttgtgagaattaagagatgggaagagatgagccaccccagtttgcctcccctcccctggcccaccagagtccggctagaaaacttctctttatccacctgctgcacctggccccacccaccaaaaccccccagctgccccggaatgtggcagggcagggaggcccagccagggagtgaggctgatccaggcctctagtcccagaccttgctgtttctcagggctgtggggctccgcttggggaggaggagggagggtgtagaggtgcagcgtttttactctgaagaccttttctgacttcttcctcttcagggcagcacaagagcaaggagttcttgcagatcaacagcctggggaaactgccgacgctcaaggatggtgatttcatcttgaccgaaaggtgccctccttccctcacccctcaccgcatccggagcccatgtgaccttggctctccccactggccccgggccccagtggccctcccataccccatggggcagcgagggaggggaaaggcgagggatctggccgggcgcggtggctcacgcctgtcatcccggcacttcgggaggccaaggcgggcggatcacgaggtcaggagaccgagaccatcctggctaacaccgtgaaacaccgtctctactaaaaatggaaaaaaaagttaaccgggcgtggtggcgggcgcctgtagtcccagctactctggaggctgaggcaggagaatggtgtgaacccaggaggcggagcttgcagtgtgctgagatcgcgccactgcactccagcctgggcgacagagctagactccgtctcaaaaaggccgggcgcggtggctcacgcctgtaatcccagcactttgggaggccgaggtgggcggatcacgaggtcaggagatcgagaccatcctggctaacacggtgaaaccctgtctctactaaaaatacaaaacattagcagggcgtggtggcggccgcctgtagtcccagctactggggaggctgaggcaggagaatggcgtgaactcaggaggcggagcttgcaatgagcagaggtcgcgccactgcactccagcctgggtgacagagggagcccactccagcctgggcgacagagggagactccgtctcaaaaaaaaaggaaagaaagaaaggagaggtatctggggagaaggtacagcttggggtgtgtccgggatgagcaggggctgacagaacatgtccccccacctctcatcttcagccttttctgagccgcagggcctctccactcccagactgaagggtattagaagagaagacaagggaacatttttccactgttgcgcatttgttcaacaaatgctagctgaaaagagcctctagtgacttgtcgcagactacccaatctacccaggccgggcctagaggccaatgccatggcccaagggcacagctcatggtgaggtccagctgctgggcaggaaaaggacaagaggtcaggtggctgcagaggtgatggctgggggcctgtcagacgggggccaaagacattcctcccctcgtgatccctgacccaagcgcgtggacatgcaagggactccacggagcatccactgtgtgccagccccatgcagggttccaggggtccagggagcctattctgagctgcaccgcctcggacaagtcacttgaccattctgaccttgagttttctcttgtgctaaaaggctaacaggagtgtctacctcacagggcggctgctggcatatcacagagatgaggttctcaaaatgcaaagcagaaggtccagccaagagtcggtgcccaaggcaacaaagacaggaggagactcgtaggaggagggggtggtgttggggagctggagatggagggcgaggctggagggcagtccttcaaatgcagagaagcccccgggccccactggcagatgggagcagttaggggtaaatgcctggtgccagtgtccttatagccactgcccatttgttcccagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgaggagagccatctggagagtgattggccatcagggagtagttggcagtaggccggggccatagactgacccactctctgcccccatcaggtgttggggccactcattggggtccaggtgcccaaggagaaggtggaacgcaacaggactgccatggaccaggccctgcaatggctggaggacaagttcctgggggacaggcccttcctcgctggccagcaggtgacactggctgatctcatggccctggaggagctgatgcaggtgtgagctcagcctgtgggcagtgtccctcttcgtgtcacacccatgaggcagacagaaacactgaggactggagaaagccagaactttgcccagaatcatagagcaagtctctggatgatctggggccagaaccctgaacttctgcctcctgcctgggtgtggggtctcaccctggctgctcttgggctctaaggctgaacatactgcctgggcccctgtggtccattcacttaggggctggggaatggaccatgtctctgatacttctgcccatggttccagcattcgggtcggcagtgacaactgggaaagttgtatgcccacaactttttcatccttgtccctacagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaaccaagagttattggttttactacattgttgtgttatacatatggagtaaaagtatgtgctagtaatcctcatcatggttaataacaaagtaacctcacaataacgagtcaacataattgtatcaccagggcaacaaaatgttaagtaagtaaccaattcgaattgcaaactgttaaaggatataggcgatgtttcacagggcatagcaacggtctttgaagtctaggaaacttaaaagatttcttttaacaagcattcatgtcttctaggacagttttgtaataactgcaaatagtaagattatacattgtcacacagacctccatgtatatccatgggatggaccccaccacaatgattttaacggagagaacttgatataaagaattggtaaccaggcattagagaactccgaagacagagagaatccagattaacacggaggtaaacactgcaagaagctaccacccctagggctgggggatcaagggaggaattaggaagaccaagatgctggaggggccctgaagaattcaaacctccaagaaaggtgttgctcatcccccctagcatcaccttccaagaagggcaggtttccccagtttgccctgaggtcttcacaggaggccatgtggctgtggatgcagttctcaaatgtgacagtagatgtcactgctgaccaataaacaggatgttccagacacactctgcgctacctgcccacatgtcttgtggctttggggcctatttcccatgcctgacctgtgcccaccatgtgccactctattgggggacctgccccaataatcacgtagattgtttcctatttttcctaagtgtcggccggcttgagaaataaagggacagagtacaaaagagagaaattgtaaagctgtgcatccgggggagacgtcacacgttagtaggatctgtgatgccccacaagccacaaaaaccagcaagtttttattagggattttcaaaaggggagggagtgtgcaaataggtgtgagtgacagacatcaagtacttaacagggtaatagaatatcacaaggcaagtggaggcagggcgagatcacaggatcacaggaccgaggcaaaattaaaattgctaatgaagtttcgggcaccattgtcattgataacatcttatcaggagacagggttttgagaccaaccggtctcaccaaaatttattaggcgggaatttcctcttcctaataagcctgggagcactatgggagactggagtctatctcacctctgcagtctcgaccataagagagaggccacgcccggggggctgtttataagccgatacctccaggtgcgtattctctttctcagggacattccatgctgagaaaaagaattcagcgatatttctcccatttgcttttgaaagaagagaaatatggctgtgttctgcccggctcaccggtggtcagagtttaaggttatctctcttattccctgaacaattgctgttatcctcttcttttttcaaggtgctcagatttcatattgctcaaacacacatcctgtacaatttgtgcagttaatgcaattattaaagggtcctgaggcgacatacatcttcctcagctgacaggattaagagattaaagacaggtataggaaatcataagggtgttgattggggaagtgataagtgtccatgaaatctttacaatttatgtttagagattgcagtaaagacaggcataagaaactataatagtattaatttggggaactaataaatgtccataaaatcttcacactccacgttcttctgtcatggcttcagccggtccctctgtttggggtcactgacttcctgtaacaccactcctagccggaagtattccaagtaaccattgcaactgtcctgccttaagggtgcctggtgatggcttctgtcttaggtcccattctggctctctcttccagtgatttctcatactttgggggacactctggcctgctttcctgggccttttccattaccaccccctctccccatcaggcactggggatggcggccacagcctatgccttcttgatccatgctggctgccttgggattgttccttattggatggttttgctttcaacagacactccaataaagtacacgaaataaagaataaagttaaacagtcagtccccgtgctgtgtaggtggcagtaagtctgggagagcgacctcagctgaactaaccatgctgtgcatcattgtcaagcgggaccagcaggatccttaggtcacctggcaggaggaggggcagggaagggtccctagaagtgatcttgagttgcacttagtgctcttggcagagggaagggcttgggctagtgctggaggcatgaagatggggtgtgttcagggctctccagcagtccaggcatgggaaggggacgctgagggccaaaggctaaggtgacactgggaagggaaccatagcaaggtgaggaatggctttcggccatgtgactgaattgcctgtgtgtggtgcgtgtgtacgtgtgtgaatgtcagtgaactgtgtgtgtgaacgtgagtgaattgtgtaactttgtttatgtgtgggtgtatatgtgtgtgatgtgagtgaactgtgtgtatgtgggtgtatatgtgtgtgatgtgagtgaactgtgtgtatgtgggtgtatatgtgtgtggtgtgagtgaactgtgtgtaagtaggtgtatatgtgtgtgaatttgaatggtgtgtaaatgtgactgagcagtgtgaatttgtgtatgtgggtgtatgtgtgtgagtgaactgtgtgattttgttggtgtgaattgtgtgcctgtgtgtgtgaggtgtgtgtgtgtgtgtgactgaactgtgtgatgactttgtattaatgtcagtgaatggtgtggttgtgtatgtgggtgtatatgtgtgtgtatgtatgtgaattgtgtgtggggttggtgtgtatgtgtgtcaatgtgagtgagttgtgtgactgttgaatatgagtgaattatgtgattgtgtgggtgtatatgtgtgtacaggagttaactgtgtgactgtgtgtaaatgttatgattgtgtgtgtgggtgtatatgtgtgaatgtgatacatcgtgtgactgtgggtggacgtgggtggatgtgtgtgtgagtgtgcgtggctgtgtgtcgaacagtgtgtgagtgtaagtgtgcaggtggtagctgtggaattaaggcacattaggggaatccttccttggctctggtccttggtttccctcctatgaaacaagttgggtgaattaggcagtctctggcattccaggatttggtctcaggtctaaacaggattttgtaaagtgaaagcagcatcccttgggcatcccgggaggtgtccctgccctccatggctcaccttctgccacatggcccagcagcagctactctgcagggccatgtgctgccatgacaggtactgatccccatgggcgcgggcctgcaggtcctggaggtaccagtggtcaggtgctttgtacatgcagctcatatagagcaagctagccacactggggggacatggcaggggcagaagacatgccctgaacactcttcagccattttctggggcattttcactatccccatgatgcagaggagggatgtgaggctcagagaggttaggtaactgcccagggtcacacagccctacacggggccagattatcatctcaactaatggcagcaaggaagaaacaaaatgtcatgaacttcagcaggggctcagggaaggcttccaggaggaaggggcacccagtgtgagtctgaagaatgagagcaagttgggtatctccccaacatatccaaagcatggacagggccaggagcaaggccagcagggagagagccttccaggtgacatggcagcattgctccccaccccgtcccatctcctgttcacctatggtgaagggttgtgcagtctgacccccagagctcatcatgcctctatgggtgttggaccatccagtgatcccaggctctgaatgtgaatccagctccaccaaggaggcactatgtggcctcggtaaaggacgccaccatgcggccaccaacctggaggctggttttggctttcatttttcccacccacctccaacccttcagcacaccctgcagttagagtttcaagaaaagtcagaaccgaccatcaccccaccaaccctgcaccaccaccaccttggtctggggctccagcgctgcatgccagatgactgcagtggctttctcacccctgccagggggatcctttatgacgtaagtcagatcacagttctcctctgctcaaaatactccagcgactcaatccccctgcggtaagagccaaagccttcccagtgtcccatgctcccctctgtcgtgacctcctgctcttcctgctcactacacccaccctggcccgttgctctccagtctgaaccccatgcattgtcccacctggagccttcgccctcactcttccctccagccagaacacccttctcctcatgccttgcacattcctacagctctctgctcagatgccacttcctccagggagtcttccctcaacatcctactcacacacccccaatcttaccctgtttattttttccatggcatccatcaacatccgatatgttccatgtttacatgggttactgtcagctcccccttctattaatggaatgtgagatccatgaggagaaggacgtagacacgttcactgctcaagccccagggcttaaatggggtctggccctggtggatgtttagcaaatagccactgaagctcgctgagtggtccctcgactctccagggaaacagcacttgccccacaggatttgtgggcaaaatggtagcactaagatgcctggtacagccgctcctcgaaacttagcactctccttttttcggaggggaaggctggcggtgaggaggcccggaagcagactgggccctgtggccttgtgcaagtccctcccctcctccagcctcagtttcctcacttgtacaatgcaggaggggacttctataacccttgtcaacactgggcaccactgcctgcctccacccattcttcaccctggggctggtgcagggcccacagtccatgatccaagccatcaacagtgaacagacagccgactggccccacaaggcccggcagcagcccacggaccggttacctctcagccaaggtgaagtccccatccttcaaggcccggcaccttcctcagggggttcacctgggcaaaggcatcgctgtgctgctggcctgcaggagagatcagagaggtgagtggggataacccagagttctctgaggtctctgcccacccccaccccaaaatcccagcagcagctttctgaggcccctatctgggaggcatcagggaagaggaagcctctctgctagtcactgggtcacagaccttgaccccatcagagggccatctttcctgtgtccagctccttgaagcatggctcaaggacaattccctggagctgtaattcacaccccacccccagccagttccatccataggtcagacccctccagcctcctccctgggctctaggcttgccccctctgattcagcttcctatcccagctggggacttaggccctactggccaggctgggtgacctgtcaataccccagagtcccagccaaacatgttcccaaccctcagaccaacctcattcttgctgggaatccctgccccattcagccactcagcccccggtggctcagctcttcttcctttcttatgccaaactctcaaggctccctccccactgggggttcccaggtctgactcactttagcattctaggccagtgctagaggccgcattaggtgcctggtgtttggatcagaggacctcagtcaagccaggctccagtctgatcataggcctacatgtgggcctctttgcccttctactgaatggacatgcacacccctgcccattctccctccacagactgcttctgtgtccagcccctgttctgtagcaggtgactcaagctggttgtaccaagggcagcagttgggaagagtcagctgagcagggtcctccctctggcctgcccagggggctctggctctgctctctgccctactgcttagttatagccctgcctcctccactgaattgtgctccagctgcatctctgtatgccagccagaccagcaaacgctggagctcagggtgagggtgctggcctcccccactgccctgccacagggccctccagcctctagcctctaggagtagccccttcagctgggtgagaagccccatgggatagagcaagtcagatgcaggaaaaagaaaagacagaagaatgccaagaaatacataaaagtggaagagacccagggccagacatggtggtgcatgtctgtgatctcaacactttagaaggaggaggcaggaggatcacttgagctcaggagctcaaggtcagcctggtctacatggcaaaatcacgcgtctacacacaccaaaaaaaaaaaaaaaaaaagtagctgggcacggggacgtgcctgtagtcccaactattctacttaggaggagtaagttgggaggatcacttgatcctgagaggtcaaggctgcagtgagccgggatcatgccactgccctctagcctgggctgcagattgagacactgtaataaataaataaataaataaataaataaataaataaacaaacaataaaaaagtggaagagacacaggcaggggtagacagggactattttacttaggaaacaacgaggcagtttgttttttccaagcacatggggtgaagatattcttgccccactccatttccctaccctcgttctgtgcctgctgtgccctctctaaacctgtattttgaagaatgttttgtattcacaagcaaagatcaagcctctattaaaatagacaaccagtggggcatggcggctcatgcctgtaatcccaacactttgggaggccaaggcaagaggatcacttgagcccaggagttctaggccagcctcggaaacacagcaagacctcctctcaataataataataataataataaattggccaggcatgtcggtgggcacctgtagtcccagctacttgaggggctgaggcgggaggatcgcttaagcctggaaggtcgaggctgcagtgagccatgattgtgccactgcactccagcctgagtgacagagttagatgctgtctccaaaaagtaaaaataataacatagataattatgtaatagtttccacaccggagagtctgattcttcgtgttagtctgcattcttggcccgactgcaaagcagcggggacaggcagggattcgtggccaatatcccctgggcctgcctgcccagcccagctttggtcagctccactgtgcgaagctcgaaggggatgccattcttggcgaagatgtagactgaacggcagggctgggacagcagacccatggcgggggcaatggggtggggcgtcggagggcagacctaaacccaggggacgggccctggggacaaacccggggacaggcccgggaacaggaactgcgggcaggaatggctggttgggggcggcggacaggaacggctgggggtaggtgagggatgggcaggaactgctgggtcaccgagcctgcagcggtgcacctcaccaggagccccgagtccggccacgccctcttcactcatcccttggctcctagaactttgggtcaatcagtggcgtgtctgctctctcaccacccctttctgggaatctaggctgcaggtatatttcccactaaaagggaagaggagaggctgggcgcggtggctcacgcctgtaatcccagcactttgggagaccgaggggggtggatcacgaggtcaggagatcgagaccatactggctaaaacggtgaaacccgtctctactaaaaatacaaaaaattagccgggcggggtggcgggcgcctgtagtcccagctacttgggaggctggggcaggagaatggcgtgaacccgggaggcggagcttgcagtgagccgagctcacgccactgcactccagcctgggcgacagagccatactccgtctcaaaaaaaaaaaaaaaaaaaaggaagaggagaaaggaggtgcagcagcctccttgcccagtgcctgggcccagtgcccaggacggaggccagagaggaagggtggctgactgcctgcggggctgccagccccacacctcatgaaggaatgagctgtccctccccagttgctggggtcatatttgttacactctagctaacgcctccccgagatggctgaggccctgtgaggcctatccagaggtttccaacagtgcctggcattgcacagtaaattaatcaccatgacacgagttttgcaaaagagaaaagatttattcacagggcaccaagcaaggatgtgggatagtagctctcaaatccaccttcccgaaaataaggcttagggataagccttgcttccaagcagtagagcacaggccccagccacgctccagggtaggggaccatacaaggatgtgaatagcagtgtcggccttgtgggcctacaacgcagaagggccatgcacttggtttaaagctttgctgttgccatcttaacattcttaacaagttaaaaataagggtccccacattttcatttatagccagtcctgtccaaggagttcaaagatctcatgagggtggacagggcactgtctgctctgggcagtgatgggaccactaacagttgttctccagtctcccagcgcctaccccagggacacaccttcccctggtctctactattctttttttttttcgagacagggtcttgctgttgcccaggctggaatgagtgcagtggtacaaacttagcttactgcagcctcgacctgggctcaaacaatccttctgcctcaccctcccatgtagctcagaccacatgcgcatgccaccaatctgggctaattttttgactttgtagagacggggtcgcactttgtttcccagggtgctcttgaattccttggctcaagtgatcctcccacctcagcctcccaaagtgctgggattataggtgtgatccaccacccctggcctctctcacattcttgacatttaaagttaccatcattgacaaggaacatgggtacactccaatttactcaagaaaaagctcttttctccattgaagacatatgtggcctagctgcttcatattctagttgaggtcttcttgttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagtagcagccttgcctgggagcttgttagaaatatactaacaggctcccacccccaaacccagacctactgaatcagacagagtttattttcataagatcctcaggtgatccaaatgcaccttaaactttgaggagctttgattcagaacctgggctggaggcccctaggggccaccttgttcctcacagactgcaaggtatgtttttttcttgcctcttctctctgtcccaatgtctccttctctctgtgtctgaccctgaggaccctgtgacatcctcccaggggagtttccactgccaaaggcctgattctctagaaactgatgggctcctctagacaccaatctctacctgggctcttgttgaagaagccaatcagctcattggttggcgatcacgtgatatacaacatggctgccttccaagccttatgtgtggacaaggagatagggacaagtaggcatatcatgttctgctacctggtccatcgtctctcctcaggcccccaggatacacgtttatggggagttttcctcccttcccccaatatggtcactcataactttacacccaacagtcaaacaggggtggaagctacagggtttcatgtaaacaataggctaggctgtggggctgagtaaaaggcactggactgtggtaggtcttactccaagatggccaaatggaagggcttttagctttctttgtttttgttttatattttgagatataatgttcaaatttacacttcagaataaaaaagagccacaatttatgcttcatattttttgtagcttcttccctatgcttttgaacaatgtaatcatattttcattatcagatataattcccataccataatatccaccctttcaaagtatactttaaaattcaattggtttaaagccaattcagtggtttttagtatattaacaaagttttgtcaccatcacagttatctaattctagatcattttcatcacccaaaaagaaactctgtacccaataaagagtcactccccattcccctcttcccctagcccctggttaccattcatctactttctacctctgtggataggaagtagctgcctattctggagatttcattcaaatgtaataatgaaatatgtggccttttatgactggcttctttcatttagcataatggtgtcaaggttcatccatgttgtagcatataacggtacttcatcccttcttatggctgaataatattcaattttatggactttttagcaaaacattctaatttttacttctctactgtgcttattgtttgtctttctccacaacaatgtgagcactaaaggcagacatttttgcctattttgttcactactgctttttctgcaccaaacgcattgcctggttgtgggtacttttctagttttaggaaggagaagacaagatataggtcctgactctggttctgcctctcattcatatgctacccttccccttgaagaacttgtttcttcatctacaaaatgggcataatactactactcatcagggtggttgtgaggattaaacaaggtaagagatgtaaaattgcatgttagttatcagatagatttgtgttcccatctagctccaatgagggagaggatttgctctagtctgtccctctgggctctgggcttctaatgggcagacagcttcctccatgatgtttgtagctgttaaggctggcgtagtccctcaagacaagttttttttttgtttgtttgttttttttttgagtcagagtatcgctctgtcaccaggctggagtacagtggtgcgatcttggctcactgcaatctctgcttcccggattcaagcgattctcctgcctcagcctcctgagtagctgggattacaggcatacgccaccacacccagctaattttaagacaagcttttggaattgaactgctgatggtcttccatgaacaattcaacagaaacccagtagcgtacacttccttgtatgcacttgcaccctctctttacatttattacacatttaatgctacctaataattccctatacttttactttatccaatcgttcaacagattccaaccgaaatacatagaagagtgatattccaacttcatcagaccctgagattctatttttaacatttcttccatggattgttgaatgtttccaatgattgatccaccttcccttggccttttctacattacagatttggtggcatgtccatgtctatgttgccaaacttgcctcatagacccagcttgaacacaagatgggtgcttgctgaagagcaggactcattctgttgaacctgcatgttttctcaggtcagattgcttggtggcgcttctttaatttctttcaacagcacattgtagtttgctgtgttgaaatgttgcttttctttggttaaatttattctattttattctttttgatggtattataaatggaagtgtggttttaattttgtttttcatcctttattgcaaatgtatactattgatttttgtgtattaatcttgtaccctgcaaccttgctgaacttattttattttattgagatggagtctcagtcagtcacccaggctggagtgcagtggcttgatcttggcacactgcaacctccacctcctgggctctggtgattctcctgcctttgcctcctgagtagctgggactacaggcatgcgccaccacgcccggctaatttttgtatttttagtagagacggggtttcaccatattggacaggctggtctcaaacttctgacctcatgatctgcccgccttggcctcccaaagtgctgggattacaggtgtgagccaccgtgcccagccttgaacttgtttattagctctaatggtttttaagtgagttaagaatttctgtaatgtcatctgtgaatagagatggttttacttctttctttctgatctagattccaccttgttcctttttcttgcctaattgccctaataagtagaagtagtgtgaatgaacattcttgtcctgttcctgatcttaggggggaaacgcttgatctttcacaatggatgaagtatggtgttagttataggtttttcatagatgctttttgtcaagttgaggaagttcctttctcgtcttcatctgctgagtaattttatcgtaaaaggatgttaggttttgtcaaatgccttctgtgcattaggatgatcatgtgactttctattaacatggtatgctacactgattgatttttgtatgttgaactgcatttgtactcctgggataaatcctacctggtcaaggtgtatgatccttttaatatgctgctggatttgatttgctaatattttgctgaggatttttacatctatatttataaggatattgctttgtaactttattttcttgtaatgtctttttctgtctttggtatcagagtaattctggcctcatagtatgagttgaaaaatatttcttcctgttttatttttttggaagagtttgtgaaggctttgtgttagttcttcaagcttttggttgaattcaccagggaagccatctggtcctgggcttttctttgtggaatttttaaaaataattaatattttaatctctttatttgttacaggcctattaaaattttatctttcttcttaagtcagttttggtagattgtgtgtttctaaaattttcccatttcatctaggttgtctaaattgtccacatatagttattcatagtatttctaaacttttgaatttctctatgaccaatgtgatgtctccattttctttctttctggtttccatttcattttttcatttttgtttttgtttgttttttgagataaggttcttctatgtgcccaggctggagtgcagtggtgcaatcatagctcggtgtaaccttgaactcttggactcgagtgatcctcccacctcggccacccagttagctaagactacaggcttgcaccaccacaccaagctaatttttttaaaaaatatattttttagaaaaaagtctcattgtgttacccaggctgttatcaatctcctggcctcaagtgatccttctgcctctgctttccaaagtgctgggattgcaggtgtgagccattgcacccagcctccactttctttcttggtgaataatttgacccttatttttttcacttggctattctaagtaaaggtttgccaattttgttgatctttgcaaagatccaatttttggttttattgattttattgcttttctattttctatttcatttatctccattctaatctttattatttcctgttttctagtggtgttgggttgagtttgctcttatttttctagttccttaaggtgtaaagttaggttattgattcaagatcattcttctttaacttatgtgtttacagctataaattttgctcttagaactgcttctgctgcatcctataaatctgggcatgttgtgttttcatttttatttgttcaggatactttttgatgtcccttgtgatttcttctttaacccatttgttgtttaagagtgtgctgtttaatttctatgtgcttgtgagttttctagttttccttctgttcttgatttttaactttattccactgtgtccagagaacatactttgtgtgatttcaatcatcttaaatttgagacttaggaccaaatatatgctctatactggagaatattccatgtgctctttagaagaatgcttattctgctcctgtcgggtggaacgttctgttcatgtctagtgtatgcgattggttaatcgtgcttttcaaattccctatttccttgatggtcttctgtagtttttctattactgaaagtggggtattgaagtcaccaactattattactcacaatgtaaccatatttaaccctttacttttaaaattctttttggaaactggaaggatctgtaaccaccacccactcccacatcagaccctatgcatatgccaactgtctgctgctcagcagctgtgatggttgttccagttctttattaggcaaagaacagttgtttttttgtttttttgtttttttttttttaacatttcctttaaggaaggtggctcagattgctaagccagccaggccctgcgggacaggctgcgcctagggtcacctgctcttcttcagcaactcagaaatattctccttgaccattgaatccaatgttgaaaagtcccagtcggccaactgcattagtcgatcatgggcctccctaaagaggccagagccaatattcagctccacctgcatacgccactcagctagcttggagctgttgaggaagacattatagttggctgccatgggctgtagatagacgaagacaaagacgtggtcagcctggggaccagccccacctgggtcctctcccacagcctcaggcccacgtccctaacatctacctatgcaaagaattaggctgctgacccccaaggcctgagcaaggggtcacagactatgtaatagatgtaggtggggatggaggatccagaatccctcagagtcctcagtcactggtcttcttgctccaagccttctgaaccatgctgagagggctcctggcccaggcacttcccacttctccagcctgcgacctcgcatgaatcctgccttcttccagggaaaccccttatcccaggtgtgtatatgtggatgagggagagaactcaggttttttcctccatgtttagcctcccactgtgatcaagctcaggggctaggatgggagacctggcgggcagtctaccctgcagtttcgctggcttactaagagtttggtttgcacccaagatctttgggaagcccaagaatgggtgtgtgtgggtgaaatgtaaggggtggggacgaagcatatggctgaacccttggggcaggccagaatgatttttcctggtgctggtctgccctgcaaacagaccaaggagactaattttcatatcagccagagatctctgggataaggaaaagaatactgcattttctggtcaatccaccaggaccccaggtccctcctctcgggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttcctcccctgttatctttgggatcagcaactggccagggttgggaagaggagggaagaggaggctgcactccagggccacctgccctgccaggtctctgtactcttgtctgctggatagatattgaacacttcccaggatataaagcagtttcacctcttttagcagttctgattggtggaagttgctgggaaccatgtgttcacaaggatttggggagctcagcaggcataagtcctgtgattgattagtgatgtctgtcacaggcatagaattcaaagtagagacacatgtactggttatttgtcatcttctaattttctataggccatactcttttttgtttttgttttttgagatggagtctcactctgtcgcccaggctggagtgcagtggcacaatcttggctcactgccaactccaactcctgggttcaagcaattgtcctgcctcagcgtcctgagtagctgggattacaggtgcccatcaccacacccagctaataattttgtatttttagtagagatggtgtttcacaatgttggcaaggtaggtcttgaactcctgacctcaagtgatctgcccgcctcggcctcccaaagtactgggattacagttgtgagccaccgtacccggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcaggtctggcgggcaccagtgcgatggtgcgctgtacttgcggcacaggtagtaaaggatggccgcgctgcagaaggggccggtcaggggcactgcccttgccttcctgagtgccactacgtcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacgtagggtagcccctggaggtgcagggaggttatggacttaatgcttaagattaggcattatataagccagggcatgaaaggatccatctctctggtgctggatggagggtgagcccgagggggcagaatggacaatgaggtggcgggccagcaactatcgggaaggttgtggtgtctggggatggtggaggccatggggacagagggaaggggacggaggggagacatgcttcggaggggatgtcctaggccttgctgattgatggctggtgtgggaacctccgcagcacaagggctcctttatcatcaccaacagcaaccatgccaaggtaaaaaggtcagggcatggagagagctatcggttaaaaagtggcaggagagacagcaactggctgcaagactcagaacttctttggatcctgatccaaacaaactgccaagaaaatatttaggagataatcagagagttttgaacaggagccacgtattagatgaaatccaggaattactgttaattttatgaggtatcttaatggtatcgtagtgatgctacgctctatcctagcccaggctggagtgcagtggcacaatcagagttcactgcagtcgtgaactcctggcctcaagcgatcctcccgtgtcagcctctcaaagtgctgggattacaggcatgagccaccgcgcccagcctgttgctttttttttttttttttttttttttttaaagaacgcttatctctaagaggtatgttcctgaacgtttattgatttatttacttacttatttttatttttgagatggggtctcactctgttgcccaggctgaagctcaatctttgctcactgcaacctctgcctcccgggctccagcaatccctccacctcagcctcctgagtagctgggactacaggtgcggaccaccatgctggctaacttttgtattttttgtagagatgggggttttgccatgttgtctaggctaggctggtcttgaacacgtgagctcaggccatcccctcacttcagcctctcaaagtgctagaattacaggcatgagctggcccctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgctcgcactgaacctcccaggaggagcagagacagatggtgcaagggccccagggaagacttacctttcacttaagataaatttcccatctttgaggctgggaagcttcctgagggggttgatgtcaatgtattctttgctgtggtggtgacctgggaggagcagggaaggtctgaggctgtgggactccaggggagagagaactgagactcccagagacacaaacgcctccctctctattttctcaagaagagaggactgaggcccggagggacatggcggctcaccccaggtcacagggcaaggcagttgcagaaccggactgggatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagttttggagtccctctgtgctcgggatggagttggagcccacccctctgaccctcactcgggagcagtggagccctgagcctttctgaacactggggaggatgggtgtagacggactgtgcacttctgccccctttgccaacctggtgggcaggtgctgagttcacaaggtcctagaatcccacaacgaagccagggtgcctggtgggagcccagggagtcccagctgctgttcattcccccttctcctcaaaaagcctgttcatctgtggcgtggggactatcattagtggggagtggctaaggtaggctaggcagggacgcagcctacaagccccgtggcatcttttccttccctgtggacctctggggtgattcccttgtctctgtccctgcttctcagaaatgcccctatcaatctgagcgtggtggctcacgcctgtaatcccagcactttggaggctgaggcggggcagatcacttttggtcaggggttcgagaccagcctggccaacatggtgaaactccatctcgactaaaaatacaaaaaatgagccgggcatggtggcgtttgcctataaacccagcaactcgggaggctgagctgggagaatcacttgaacccagtggagattgcagtgagccaagatagcaccactgcactccagcctgggtgacaaagtgaggctctaccaaaaagaaaaagaaaaaaaaagctccaatctgtgtgtcctgcctccccccaggaccaggcctgccaggcagcagtgggagctgacctttcagcagatccacaaactgaaagttgaactggatgtcatgcttcttcgagaagatgtagacggcacggcagggtgctgacagcaggtccatgtagagctccagggccatgttgagacacatgccaggccccacagctgcagctggccagccacagacctgggcctatgtctggccagagtccctggccctgtgccctctccgatctgggcccaggaccctgcattctggaacctcttgtttccctttgtgttgtcataaggccaggaagcctgcaattctcacagcatcaaggattctaaggaggcccaggagtaggctggcagaggcccgtggcaaaggtgtggcagccgtgaccctactctccccctctcacgtgtgtctgtgtcccgtggcgccacctcacagacaccctgtctgagaagggattatgcctgggaattcccagggccggactttgattgcagaacctgacgaaaggggctttgcagggtccagaatgaggaggaggcaatgagaattatccctggaggattctagaagtagaggctgggagcatccacaggtgaatggagcctgaactatgactagaaaggaattgggagaaagagacacaggaacctgggagcttcgggagcagtggggacaccaccaccaggaagtcagggggcactcggcaatgaaagtggcagatgcaataaaacttttaacatattgttgtataatgtacaataatgtaataaaaatacaccccctatacattattgttccaactctagctctatctattgccctcctcatatgaatccctctccccataccccattctctagttaatcttaactaggcctcctgtttatattagccacatcaagcctagctgtctactctatcctgtgatcaggatgagcatctaatttgaaatatgcactcatcggtgcactatgtacagtggcccaaacagtctcatatgaagtcactctagctattatcctcctatcagtcctattaataagtggttcatttaatttgtatatactcattggaacagaagaatttctctggctgctcctaccatcatgacctctggccataatatgacttatttccacactagcagaaaccagccgagcctctttagacctaacagagggggaatcagaattaatctcgggctttaacgtcgaatatgctgcaggcccatttgccctgttctttatagcagactatataaatatcattataataaatgccctgaaggccgcaagaggttcgtgggtgcagtgcacaggagaccatatctggggacagcagctgcagcagaccccaagctgggccatccctgccacttgccaggtggtgcttggcgaaggcaagcagctcccacccgcccggggaatacagcgcgacccccggcggcatgctcttcagcaccaccccaggaggtaccaggatcatctaccactggaaattcctgatggagtgttgaaacttacccgtgaccaaaacactcccaagggatctgcccaccattcccggggtcaccagccctgccagtgatgatccccccaacggaagccagccagagccacctgagcaatagtccagaagataagcagggcgggcagtgaagaagcacagttttgagatggacatttaaagcaccagccatcgcatggagcactgccaagggacccctcaggcccttcctggaggagtcccaccagccaggccttatgaaagtgatcatactaggcaggcattggtgtggggccagtcaccccagccctctctccctcactcgcggcacctgccccctcctctttgtgaacaccagcaggtacctccttgtgcctccgctgatgcaggagcagctgccccaaggggagtaacccctgccagcacaccctgcagctgagggccaggaagtggacaagaatgaaccctttcttccaaatgatcagctcttccagcccctgctgggggccccacgaccccttccttaggttgacgtgcctgggaaagctcacctccccctcttccctaagagaggaaataaaagccaccttcgccctagggcaaaaaataaataaataataaatcccgtaatcactattgtcttcctaggagcactgcataacatatatataccagaactctataccacaaatttcgtcacccaaactctcattttaacaagtctttttttatgaattcgaacatcatattcctgattccattatgatcagctcatatatctccttgaaaaaattttctaccactcacactagtactttcatatgacatatcttcatgccagtcctaacctccagcatcccaccccaaacataagaaatatgtctcacaaaagagttactttgatagaataaattacagaggtttaaacccttttgtttctagaattacaggaattgaacctacccatgagaatccaaaattctccgtgctacataatacaccacatcctatcacaccccacagtaaggacagctaagtaagctattgggcccataccctgaaaatgttggttatacccttcctatactaattaatcctccagtgtatgccatgcagaggagcccagaaacttcctggcctgggttggggctgcagtggccagactgtgcacctggtggcccaggaaggtaactagagccccacgtagaggactgagtgccactcactctatgctttgtgatttaataggtctaggctcagaaatgggactgatcccacttccagtgacagagtaagcctggagacaagcgaagagcatgcagtgtgtttattgcagacagcagggtgcagtgcagtgggctgtacccactcagtggagccactcctgcagcaactgcacctgcttctgggccagctgggggtcctgccgagcctcactgtggttcagaggctggagtatgagcttgtgggcctccaggaagagctcagtaccaagggcagccttcatatgggcctgtcacactgccagccagggccagtcttggaagaggtcgcagccaacggcagtgggctgggaagacagggcagctggggttggggctcagccccatgcccagagtccccccgagggcaggtgggtaggaaagcttcacctgcatcacctccgtcagcaccaagtcttccagggagatctgctccattgccaggaagggcctggccaccaggacccccccatccaggtgctgcagggctggcgtcagcctccccaacagccgctccagctgtgcagcatctgcaggctgtctggagaagtggggcaggagagactgggctgtgaggagaggagcaacttaacccagactcttggaagcctcttgggcctcctctccatcccttcccggctgccattcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtaccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatctgggtgacctacgtcctttccccatctgggcagctccagctggcttagactctagccaggttccagcctccagctttagcccaaaggtgcccctgggtccagcctctgcatcggagctacacaggctgaaatgaggaaggggccacagtgatttggaaagatctccaacccaaggaaagatctcccctctcgcctctgcctccccctacaactctgagccccagaacccaggcagatcctggctctgaccctgggtgggcaccaggtcaccattacctctctgctagtaggaagtcgccatctctgagggcaggcaccttccccagggggttcaccttcaggaactcaggcttcaggtgctcccctggtgggcagaaaggagagaaggctcagtgcagggcctggtccttggcacccactccatggggcccagcccagccacctggctcaccccaagccaactccactgtctgcagctgaaaagggatgtcattctgcctggcaaaagtggatagcatggcagggggctgagtgcatgtccaggaacagcttgggccccattgctgctcctcccacctgccctccccagaggtctgtacctccaggagttgctcagcccttctcggccagtgccttcccccaaaatggggccagaactctgtactcctcctgaagcctattccctccatgactggctgggaggcctgccaagcccctctccccttttctccacctctgtagagtggaggcaggggtggccagtgtccctttgggggtttcagatagaaactcaatgacaattggcttagcaaaaacaaacaaacaaaaaaaaaacaacaaaaaaaaaacaaagggagtggggtgggtggggagatttctcagaaaacttctccagtcataggaggggaggggtgtagaagccactaagagaactggaatcagaacctgtttctgtctccccacttttcctcccctctcctcctctcccctccttcccctcctgtcccctcccctcctctcccctcccctcccttccctttccttccttcccttcctcctttcctcccttctttctttgagacaggatctctgtctccctacacttttttcttttaattctctgtctctttcttgacatagaatcttgctctgtcacccagcctggagttcagtggcacgatcatggcttactgcaatctccaagtcctgtgctccagcagtcattccactacagcctctggagtacctaggactacaggtgcacatgaccataccccactagttaaaaaaaacaaaaacaaaaacaaaaaaacccttgggcctggcagggcggctcgtgcctacaatcccagccctttgggaggccaagatgggctgatcacatgagcccaggacatcaagacgagcctgggcaacgtgccgaaacccagtctctacaaaaaatacaaaaattagctgggcatggtggcgcatgcctgtagtcccagctactcaagagactgaggtggcaggatcacttgagcccaggaggcagaggttgcagtgagccaagatcacgccactgcgctccagcctaggcaacagagccagactctgtctcaaaaaaaaaaaaaagagagagagacagatagggtctcactatgttgtccaagctgatcacaaactcctggcctaaagtgatccttgggtctcagcctcccgagctgattagctgggattgcaggtgtgggctaccacgccctgttatcactccctttctctgagtcagcttttctctctcagactagcctactccatgaactcaggaaatgtcactacaggtggccccagctcccatttacctccccatagggagctcctctctccagttccaatttcaaaactcccaaggaagcattctggttcactcgcttgggccactggccagagggatgggatactctgaaagattcagctagagtcccgggcccagccctggaccatcactgtgcaccctggttagatgccagggctgggattcagggagaagaaaggaggttcccggacagtcattcctgcctcctgcggctgcgggctccctgcacagtcattcctgcctcctgcggctgcgggctccctgcccccatcctgtgcacgaagtgggagctcccgctgtctggcagcagctgctctgcaggggacagtctggacggcagaaagttcatccttaaccccagccttccagtcaaggttcccacaagtctgggacacctgcaagtgtcatatcccgctgggtgaaagtctgagatcccttttagaggatcccattcgctccctcccttctgccaccttccagctccgagaaacagagctctgaacgaaccctcagatgtccatgcgctggggcctttccaggacggcggggcgcagtcctttctgggttggggtgacacctggaaacatgtaaggtccctggcacagggacccctcccagtttcaagcgattctcctgcctcagtctcccgagtagctgggattacaggcgcccaccactgcacccagctaattttttgtgtttttagtagagatggggtttcaccgtgttagccaggatggtcgcgatctcctgacctcgtgactagcccgcctcagcctcccaaagtgctgggattacaggcgtgagccaccatgcagggccaatttttgtattttcagtagagacagggttttaccatattggacaggttggtctcgaactcctgacctcaggtgatctgcctgcattggcctcccaaagtgctgggattacaggcgtgagccaccaagcctggtggtaatttataaggggtggacatttgttggctcatggtcctgaaggctggaaagtccaagatcgaggggccagcatctggccagagctttcttgctgtatcatcccctggtgaaaggataaagagagggtaagagagagcaagaggctgaactcacagcctcaaagtccttttataatccacatcaatccatctgtaacggtggaggcctcatgagataaacacctctcattaggccccacctcccaacactgttgcattggggattacatttccaacacatgctttgtgggggacccattcaaaccacagcacagggacaccttctctttccttcctgtgatatgctgaataatgacccctaaggatatacaagtcctgatctctggaacctgtgaatattaccttctgtggcaaaagggactttgcagaattgattaagaatgttgagatggaggcattgtcttggattatctgagtgagccctaaatgcagtcacaagtatctgtgtaagaggagacagacggagatttgaaacagaagacaggagaagatggaagcagagagatttgaagatgctacattgtgggctttgaagatggaagaaggggctacatgacccaagacaggcagctccaaaagctggaaaaattgaggaaaccaattcccctctcagagcctctggagggtgtgcaaccctattggcacctgggttttggcccagagaaatagattataaagttctggtctccataactgtaagagaatagatttatgttgttttaagccaccaaggtggtggtaatttgttataccatccagaggagaggaacacagattttggtgccaggaagcagggtgctgctataaaaaagaaaatctaggctgggcacagtggctcatgtctgtaatttcaacattttcggatgccaaggtgggtggattacttgagccctggagtttgagactagcctgggcaacatggcaaaaccccgtctctactaaaaatatataaattagctggggatgggccgggagcagtggctcacgcctataatcccagcactttgggtggcaaaggcaggcggatcacgaggtcagaaggttgagaccatcctggcgaacatggtgaaacccagtctctactaaaaatacaaaaaattaaccaggcgtggtggcgggtgcctgttgtcccagctactcaggaggctgaggtagcagaatggcatgaacccaggaggcggagcttgcagagagccaagatcgtgccactgcactccagcctggggaacaaagcgcgactccgtctcaaaaaaaaaaaaaattagttggggatggtagtgcatgcttgtagtcccagctactggggagaccgaggtgggaggattgcttgaggctgggaagtctaggctgcagtgacctgtgactgtgacactgcactccagcctgggcaacagagtcagaccctgtctcaaacaaacaaacaaacaaaaatctaaaaatgtggaagtagctttaaatttgggtgatgtgcagaggccagaaaaattatgaggcccatgatagagaaaacctagattgccttgcacagattgttggtagaaatatggatgttaaagactatagggagggctcacgagtatcaactaaacatggtcagagcaagtctacattgccttacagcatacctaagtcatcataggcagctgtaggtagatatatagatattggctgggtgcagtggctcacgcctgtaatgccagcactttgggaggctgaggtgggtggatcacctgaggtcaggagttcaaaccagcctggccaacatagtgaaaccccgtctctactaaaaatacaaaaattagctaggcgtggtggcatcccagctactagggaggcggaagcaggagaattgctcgaacctgggagacggaggttgcagtgagccaagattgcgccactatactccatcctgggcgaccaagcgagaatctgcctcaaaaaaagaaaaaatagatattaaaaatcctgctgctgaggactctgaagaaatgaggaacgtgtttctggaaactggaggaaggaggatcatttcccagaaaaggagcccgtagggaggtagaaagcttagttgaattgtgtccgatagttatatggtgggtgaacttaaagcaacgaagttggatatttagctgaggagacttccaagcaaagcgttgaaggtgaagcctcatttcttcttgctgtttatggtgaaaagcaagaggaaagtgataaaatgaggaaaaagctgttaagcaaaaagaaaccaaggtttgatgatttgggaaattatcagcctgtgcagattgcaaaagatgctaaaattagaagattcgctgtttggaaaacacaactctatccctgtcctggggatcactcaagacttgtatccatagacaaccagatttctatgggcttgaactctgtgtgtgtgtgtgtgtgtgtgtgtgtgtgtgtgtgtgtgtgtgtgtgtgtgtgtgtagcaaggttgggggagcacagtggaaagaccttgaatttatttgtttattttttagacggagtcttgctctgtcgcccaggctggagtgcaatggcacgatctcagctcactgcaacctccacctccagggtggttcgagcgattctcctgcctcagcctcccgagtagctgggactacaggcgtataccactatgcccagctaatttttgtattgttagtagagatggggtttcaccatgttggtcaggctggcctcaaattcctgacctcaggtgatcaggctggtctcaaactcctgacatcaggagatccaccagcctcggccttccaaggtgctgggattacaggcatgagccaccatgcccagccttattatttatttatttatttttgagacaaagtctccctctgtcacccagactggagtgcagtggcgcaatctctgctcactgcaacctctgtctcccaggttcaagtgattctcccagctcaacctctcaagtagctgggactacaggtgcgcaccaccatgacctgctaatttttgtatttttatttatttatgtattattttattttatttttccataagttattggggtatgggtggtatttggttacatgagtaagttcttttgtagcaatttgtgagattttggtgcacctgtcaccccagcagtatacactgcaccatatttgtagtcttttatccctcaccctcctcccactcttcccctcaagtccccaaagtccattcttatgcctttgcgtcctcatagcttagctcccacatatcagtgaaaacataagatgtttggttttccattcctcagttacttcacttagaataatagtctccaaactcatccaggtcactgcaaatgctgttaattaattccttttcatgactgagtagtattccacatatacatattccatatatattcattccatatatatattccatatatgctcattccatatacatattccatatatgctcattccatatacatattccatatatactcattccatatacgtattccatacgtatgtactccatatacgtattccatacgtatgtactccatatacgtattccatgtatgtattccatacgtatgtattccatgtatgtattccatgtatattttccatatgtatatattccatgtatatattccatatgtatatattccatatatattccttatgtatatattctgtatgtatatactccatgtatatattccgtatatctatattccatatatgtattccgtatgtatatattccatatgtactccatatgtattccatatgttccatatatattccatatattccatataaattccatatattccatatatatcccatatacattccatatattccacatatattccatatacattccatatattccacatatattccgtatattccatatagattccatacatttattccatatatattccatatagattccatatatattcagatatattccatatttatattccatatatggaatatatatgtattccatatatatgtattccgtatatgtatgtattccacatatatattccatatatgtatgtattccacatatatattccatatacgtatattccagatatatactccatatgtatatcccagatatatatattccagatgtatatattccacatatatattccagatgtatatattccatgtgtgtatattccatatatgtatattccatgtgtgtatattccatgtgtattccatatatatattccatgtgtgtattccatatatatagtccatgtgtgtattccctatatatattccctatatatatattccctatatatattccccatgtacattccatatatatattccccatgtacattccatatatattccccatatatattccatatatattccccatatatattccatatatatattccccatatatattccatatatatattccccatatatattccatatatatattccccatatatattccatatatatattccctatatatatattccctatatatattccctatatattccatatatatatatatatatatatatatatatacaccctatatatatattccctatatattccatatatatatggagtctcgctctgttgcccaggctggagtgcagtggcgcgatctctgctcattgcaagctccacctcccaggttcacgccattctcctgcctcagcctcctgagtagctgggactacaggtgccagccaccatgcccagctaattttgttttcgtatttgtagtagagacggggtttcaccatgttagataggatggtctcgatctcccgacctcgtgatccgcccacctcggcctcccaaagtgctaggattacaggcttgagcctccgcgcccggcctctgaattctttttcaggtaaatcagggatttcttcttggtttggatccgttgctggtgaactagtgtgatatttgggggtgttgacgacccttgttttgtcatgttaccacagttggttttctggttccttctcattggggtaggctctgtcagagggaaggtatagggctgaaggttgttgttaagattttttttgtcccagggctattcccttgatgtagtctctcccccttttcctgtggatgtggcttcctgtgagccaaactgcagtgattgttgtttctcttctgggtctagctgcccagtgagtctagtcagctccaggctggtactgggggttgtctgcacagagtcctgtgatgtgaaccgtctatgggtctctcagccatggataccagcacctattctggtggaggcggcggacggtgcagtgcactccgtgagctttggtggtttaatgctctatttttgtgctggttggcctcctgccaggaggtggctctctccagaaagcatcaactgtagtagtgtggagaggggccagtggtgggtggggccctaggactcccaagattatgcgtcctttgtctaccactactagggtgggtaggaaaggaccctcaggtgaggacggtgctaggcatgtctgagatcagactcttcttgggcaggtgttgctgtagctgctgtggaggatgggggtgagatgcccaggtcattggagttgtgtgcctaggagaattatggctgcctctgctgagtcatgcaggttgtcagggaagtgggggaaagccggaagtcacaggcctcatccagctcccatgcaaactgaaggggcggtctcactcccaccatgtcctgcaaacagccctccatctggaaacagcaaacagtgtgtttccagatggagggccagacgaattgaaaacttgcctgaggctttccacctcccagctgccaaagaaaagggctttagttcttcctccgcctgtgaaatctgcaagccagattcacaccctcccctgggttctggcccagaggcttctcaccccattcaaattgttacaaagttcagctagagaattccttctccctgtggagctgtggagttttaccccttgctttctggccaccctcctgatggatccctgtggtgccaggcaggaatgggctgcttggggatccagtgagctcccagggcctttctgctgcttcctctgaccctgtattttgctcggctgagttttgtaacttgactcagctccaggaaaagtcggaaacttcttccacaaacaggccttcagcttctccagtgggggtgtgtgctcaggagaagcgggtctccctttcccacttccacagctggggcactcacagtatttggggtgtctcctgggccctacaggagcaagtctgcttccttcagagggtctgtggatcctctcaggattgctggtttgttctttcagtggatctgcagctaaaattcacaatgcaagcctccacatgctgctctgtccggagctgcaatctggctatgcctcccgtctgccatgatcccgaaatccctctccaatttttatatttttagtagagttggggttttgccatgttggccaggctggtattgaacttctgacctcaagttatctgcccatctcggcctcccaaagtgttggtgtaccaggacaagctgcagacaaaacctctgagacaccaagttaaagaaggaagggctttattcggccgggaacttcagcaagactcacgtctccaacaaccgagctccctgagtgagcaattcttgtcccttttaagggcttacaattctaaggggtctgtgtgagagggtcatgatcaattgagcaagcagggggtacacgactgggggctgcatgcaccagtaattagaatggaacagaacaggacagggattttcacaatgcttttccatacaatgtctggagtctatagataacataactggttaggtcaggggtggatctttaaccaagcccaaggtgcagcgccgggctgtctgcctgtggatttcatttctgccttttagtttttacctctttctttggaagcagaaattgggcataagacaatatgaggggtggtctcctaccttattggggttacaggcatgagccaccgtgcccagccaagaccctgaatttaaatcctgactctgtcattcattagctcctgacctcaagtatgccattaactactttgaatcctggtatccttgctgtcaaaggagatgagagttctgacacttataggtccactgtaagacataatttttaaaatatctgtaaaaactgggccgggcatggtggctcatacctgtaatcccaatactttgggaggtcaaggaaggcagattgcttgagcccaggagtttgagaccagcctgggcaacatgatgaaaccccgtctttaccaaaaattcaaaaaaatttagctaggcattggcacgtgtctgttagtcccatctgctcgggaggctgaagtgggaggatcactggagcccaggaggcagaggttgcagtgagccgagattgtgccactgcactccagcctggcagagtgagaccctgtctctacaaaaatgtaaaataaacttaaaaaatgtcaaagcatgataaagtacaggacataaagaccatgattaatctaacacccatcactacaatctttgcctctgttctggcattcccctatgtgtcttcgcatcaccctccttctgggtgactcctttatgttgtatttttttgtttggtttggtttttttggttagtttgttctgagacagagtcttgctctgttgctcaggctggagtgtagtggtgtgatcttggctcactgctacctctgcctcccaagtttgtacctcagcctcccgagtagttgggattacaggcatgcgccaccatgccctgctaatttttgtatttttagtagagacggggttttgccatgttggccaggctggtctcagactcctggctcaagtgacctgcccacctcagcctcctaaagtgttgggactacaggcatgagccaccacgcccggccaccccactcattttgaatgtaagtagattaccaattctgaaatgggttttgagcagtagcaacattgacacaaatttataatattttcaagaagatacttccttcaatatgtaaaatgcaacagatatcatttgcaatcatacatatgtacatatatacatacacacatataatatatatatctcaccatggaataagtctgagctgaaacatgcattacttaaaaaagaaaacacttacagacaggatcttgctccgtcatccaggctgaagtacagtggcacgattgtggctcactgcagcctcgacctcctgggctcaagtgatcctcccacctcagcctcccaagtagctgggactacaggcatgagctacctcgcctggcctgcatgatctttatgaagaatgtcatagaaagtttttgaaagcgattaaagttcacctaaacaagcagggatctatgctgtatgccatgctattattggggaggaaaaaaattctcctctacattcttagggtctctggagatctggaactaagaataaaactgaaataagacagattaacagaagaaaatcattcaagttttgctaaattttcagtgtacatgggtactttcacaagagaatgaaggcctaaagaagtcactaaagtagaaaaacaataccttttttttttttttttttaagacaaggacgggtgcggtggctcatgcctataatcccagcactttgggaggccaaggcgggcagatcacaaggtcaggagattgagaccatcctggccaacatggtgaaaccccatctctactaaaaatacaaaaaaattagccaggtgcggtggcgggcacctgtagtcccagctactcaggaggctgaggcaggagaatggcatgaatcctggaggcggagcttgcagtgagcggagatcgcaccactgcactccagcctgggtgacagagcaagactctgcctcaaaaaaaaaaaatgacaagacaaagcggcttggattatagggagtaaattgtggagaagggactaggacatacatgcggagcaaaattagaagataaggattatttttagtcgtgtgtttatacagatccattggaaccttgattcacagtcacttgtgatgacaatgttcttctcttcctggtaaagggagggtgctttcttatgggaaattgtgtggcctattcttagatagaaaagggcaggtcagagagtctttcctgcatgtgctatttctcaagtgccttcaactcaaaataattaatactccaaagcagcatatttggggtgacgtgtttttaattccttcatttcccctgctgcagactttcctagaagtttcagatattaaaagctgagttggtggctatggagataagagccagattcataacgagggatctacaaatggggagaagaacatagataagaataggaatgaataagctgaaaggaacaggtctgagcacatttccccttatcctgttaaacacacatcccattgctgggacaaggtcagtacagcagaaggaatgcacctcttttgtttgatggagagtgtttagcttgttctttaacaggtgcagcttaggcactatttgtcccagtggatttacacagaccagccttatccaccaatgatcacacaaactcctccttttgaggctgtcagtgtgtccagggtgcaacaattttggaatacagcagaagctaagctattaacttcttttgttgtggttgctgttgttgttttgagacagaatctcactttgttgagtgcaggctggagtgcagtggtgcgatcatggcttgctgcatccccagcctcctgggctcaagtgatcctcccacctcagcccccagagtagctggaactactactatgccctactaatttttaaactttttgtagagacagtctcactatgctgcccaggctggcctcgaacttctgggctcaagtgatcctccctcctcagactttcaaagtgctgggattagaggcctcagccaccatgcccagattgctttgacatcttgaggccttactgatccaggagagactgcccctccctgggccagctaattcctacagagaataaatgatttgcttatggtgtgccttcgatgggccaatcaaccgattcgtatctccaacataactttaccagccacctttcagcaggttcctgccccaaatcactccagggacaggtaccaggtaacaaaggaccactcctataacccagagcccatcacaattattaaaactagccagtcctaagtctgtttaccctgtcttgccttcttgcaaaaaacacagtaaagccttttgtccaccttttgccctcactcattctgccacctgactgaccctggtgcttccccatggccctgcatggtgtggcatgtcccccctattgtcttgggaactgtgagtaacaaactttcttttacatggctatcacctctgatctgtggcctcgccatacctgaataaagccaaaatcccaggtacattttaaaacaagtctacaagtcaaggaataccaaggatttccagcaacaccagagaggccggcccacgcccggcctgactcttactgttaatcactagttttgcatttctcttgaggaactagtcaggaggagaaaacctagacagcagctctcctggtcaagacccagtcattcagaagcctaaatggcatgcctaggtgcttggctttaaactgttagcaggtatggagtgctctgattgtgttttagaataatattctgggctgggcacggtggctcacgcctgtaatcccagcactttgggaggcggaggcaggcggatcacgaggtcaggagattgagaccatcctggctaagatggtgaaaccccgtctctactaaaaatagaaaaaattagccgggcgtggtggtgggcgcctgtcgtcccagctactcgggaggctgaggcaggagaatggcgtaaacccaggagtcggagcttgcagtgagccgagattgcgccactcattccagcctgggcaacagagcgagactccatctcaaaaaaaaaaaaaaaaaaaaaaagaataatattctggctgctgctggaaggcagccagggaggaagcaaggacattggatactgcagtaatcctggccaaaggcgacttgtgaaaaggggtgggcaactgaaggggcaggagaatgtggcccctctcagtctggagagagctgcagcactaggccaggaaggcactcttctgcggggggataggtcttaaatggggaccatgggattgggtgcagtggctcatgcctgtaatctcaacacttcaggagtctgaggcaggaagaccacttgagcccaggagttggagaccagcctgggcaacatagtgagaccctgtctcaaaaaaaaaaaaaaagacaatttaaaaactagccagatgtgatgcctgtggtcccagctacttgggaggctgaggtgagatgatcacttgatcacttgagccctggaggtcaaggctacactgagccatgatcatcccactgcactccagcctgcgcaacaaagtgagactcttatctcaaaaaaggcgacaggtgggaaccatggggaaccagagaagcaaagctattctcaagttttccagtaaccatcctcttgccaatggtctttctctgaatcttggatttgggaataggattttcctgccttgggaggctcccttgggaaatgggagtgtcacagccacaggcatcaaaagccctagagttgcacttgaatagtgggtagaaagttctgtgcaatgccaggcactgttggaaacctctgggtagggcttacagggccttagccatctgtgggaggcattagctggagtgtaataaatatgaccctcaggactggggagaaacagctcattccttcatgaggtgtggggctggcagccttgcaggcagccagccacccttcccctctggcctccatcctgggcactgagccaggcactgggtaagaaggctgctgcacctcctttctcctcttcccttttagagagaaagatacccccagccgaggatcccagaaaggcgagagcagacgcgccattgattggcccaaagttctccggagccaacctttgagcaaggagggcgtggctgggctccagtctcctagtgaggtgcaccactgcaggcttggtgacccagccgttcctgcccgctgcccccaaccagccgttcctgcccacagttcctgttcccgggcctgtccccgggtttgtccccagggcccgtcccctgggtttaggtctaccctccctcgccccaccccatcgccctcgccatgggtctggagctgtacctggacctgctgtcccagccctgccgttcagtctacatcttcaccaagaacggcatccccttcgagcttcgcaaagtggagctgaccaaagctgggctgggcaggcaggcccaggggatattggctgcggatccccacctgtccccactgctttgcagtcgggccgagaatgcagactaacatgaagaatcagactctctggtgtggaaactattacgtaattatctatgttattatttttactttttggagacaggagctaactctgtcactcaggctggagtgcagtggcacaatcatggctcactgcagcctcgaccttccaggctcaagcgatcctcccatctcagcccctcaagtagctgggactacagatgcccaccgatatgcccggccaatttattattattattattattattattactattgagaggaggtcttcctgtgttgcccaggcaggtctcaaactcctgagctcaggcgatcctctttccttggcctcccaaagtgctgggattacaggcatcagctgtcatgccctgctggttgtttattttaaaagaggcttcatctttgcttagtgaatacaaagcattcttcaaaatacaggttaagagggggcagagcagatgcagcaggagggcagggaaatggagtggggctagaatatcttcaccccatgtgcttggaaaaaacaatgaaactacctccttgtttcctaagtggagtagtccttgtttacctctgcctgggtctcttcccttcttgcctcttctttttttgacacggtctcactctgcagcccaggtagagggcagtggcatgatcccggctcactgcagccttgacctctcaggctcaagtgatcctcccacttcctcctctcaagtagagtagttgggaccacaggcacgcaaccacatccagcaatttcttttttttcctttttttttttttttttggtatttgtggagacgggattttgccatgtagaccaggctgaccttgaactccagagctcaagtgatcctcctgcctcctccttctaaagtgttgagattacagacatgcactaccatgtctggccctgggtctcttccacttttatgtatttcttggcattcttctgccttttcttttcctgcatctgacttgctctatcccatggggcttctcacccagctgaaggggctgctcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagaaggaggaacctgctcagctgactcttcccaactgctgcccttggtacaaccagcttgagtcacctgctacagaacaggggctggacacagaagcagtctgtggagggagaatgggcaggggtgtgcatgtccattcagtagaaggccagagaggcccacatgtaggcctatgatcagactggagcctggcttgactgatgccctctgatccaaacaccaggcacctaatgcggcctctagcactggcctagagtgctaaagtgagtcagacctgggaacccccagtggggagggagccttgagagtttggcacaagaaaggaagaagagctgagccaccgggggctgagtggctgaatggggcagggattcccagcaagaatgaggttggtctgagggttgggaacatgtttggctgggactctggggtattgacaggtcacccagcctggccagtagggcctaaggccccagctgggataggaagctgaatcagagggggcaagcctagagcccagggaggaggctggaggggtctgacctatggatggaactggctgggggtggggtgtgaattacagctccagggaattgtccttgagccatgcttcaaggaactggacacaggaaaggtggccctctgatagggtcagggtctgtgacccagtgactaacagagaggcttcctcttccctgatgcctcccagataggggcctcagaaagctgctgctgggagtttggagtgggggtgggcagagacatcagagaactcagggttctccccactcacctctctgatctcgcctgcaggccagcagcacagtgatgcctttgcccaggtgaatgccctgaggaaggtgccaggccttgaaggatggggacttcaccttggctgagaggtaaccggtccctgggctgctgccgggccttgtggggccagtcagtcagctgtctgtttactgctgatggcttggatcatggactgtgggccctgcaccagccccagggtgaagaatgggtggaggcaggcagaggtgcccagtgttgacaagggctatagaagtcccctcctgcattgtacaagtgaggaaactgaggctggaggaggggagggacttgcacaaggccacagggcccagtctgcttccgggcctcctcaccgccagtcttcccctccgaaaaaaagagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctacgtccttctcctcatggagctcacattccattaatagaagggggagctgacagtaacccatgtaaacatggaacatatcggatgttgatggatgccatggaaaaaataaacagggtaagagtgggggtgtgtgtcattatgagtaggatgttgagggaagactccctggaggaggtggcatctgagcagagagctgtaggaatgtgcaaggcatgaggggaagggtgttctcactggagggaagagtgagggcgaaggctccaggtgggacaatgcatggggttcagactggagagcaacgggccagggtgggtgcagtgagcaggaagagcaggaggtcatgacagaggggagcatgggacactgggaaggctttggctcttaccacaggtagattgagtcgctggagggttttgagcagaggagaactgtgatctgacttacgtcataaaggatccccctggcaggggtgagaaagccactgcagtcatctggcatgcagcgctggagccccagaccaaggtggtggtggtgcagggttggtggggattgtggtcagttctgacttttattgaaatctaactgcagggtttgctgaagggttggaggtgggtgggaaaaatgaaagccaaaaccagcctctaggttggtggctgcatggtggcgtcctttaccgaggccaaatagtgcctccttggtggagctggattcacattcagagcctgggatcactggatggtccaacacccatagaggcatgatgagctctgggggtcagactgcacaacccttcaccataggtgaacaggagatgggacagggtggggagcaatgctgccatgtcacctggaaggctctctccctgctggccttgctcctggccctgtccacgctttggatatgttggggagatatccaacatgctctcgttcttcagactcacagtggatgccccttcctcctggaagccttccctgagcccctgctgaagttcatgacattttgtttcttacttgctgcccttagttgagatgatagtctggccccgtgtagggctgtgtgaccctgggcacttacctaacctctctgagcctcacatccctcctctgcatcatggggatagtgaaaatgccccagaaaatggctgaagagtgttcagggcatgttttctgcccctgccatgtccccccagtgtggctagcttgctgtgtatgaactgcatgtacaaagcacctgaccactggtacccccaggacctgcaggcccgcgcccgtggggatgagtacctgtcatggcagcacatggccctgcagagtagctgctgctgggccatgtggcagaaggcgagccatggagggcagggacatctcccaagatgccaagggatgctgctttcactttacaaaatcctgtttagacctgagaccaaatcctggaatgccagagactgcctaattcacccaacttgtttcctaggagggaaaccaaggaccagagccaaggaaggattcccctaatatgccttaattccagagctatgagcagttaatcctatgctcttttgcatactccaggttgcctgggaatcttgcctttagggggagaaaataaacaaaccctcactttgctacacacataattcgtagatggagaagtatgaagtgaaaaaagtcaaactaggaagaagtgaggagacatttcaataaacgtttgtctgatgtctcggtatgaaaggactttctaaccctcagaacagtgggagaactcaacaaagaaataaccactacatgccagctgcggtagcatctgtaatgagcacacctgtaatcccagcactttgggaggccgaggcaggcagatcacctgagattgggagtttgagaccagcgtgaccaacatggagaaaccccgtctctaccaaaaatgcaaaattagccgggtatggtggcgcatgcctgtaatcccagctactcgggaggctgagtcaggagaattgcttgaatctgggaggcagagattgcagtcagctgagatcacgccattgaactccagccttggcaacaagagcaaaactctgtctcaaaaaacaaacaaacaaaaaaacatatacaaggacatgttgtgtaagaaaaaatggattaaacataaaacaagcaaaaaaccgggaaggatcttgataaaagatatgtcagaaggaggtaatgttctttaagatgctcttagaaacccttaagagaggcctggtatggtggctcacccctgtaatcccagcattttgggaggccaaggtgggcagatcacttgaggtcaggagtttgagaccaccctgggcaacatgatgaaaccccatctatattaaaaatacaaaaattagttgggtgcggtggcacactcaggagactgagacaggagaatcacttgaacctgggaggcggaggttgcagtgagctgacatcataccactgcactcaagctccacttagagcgagactgtctcaaaagcaaacaaagaaaaataagagaaacccatcagacaagagacaggaaaaaaatgagtcatagctcactgcattctagatctcctgggctcaagcgatcctcctgcctccgcccaggtagctagaactacaggtgcacaccacaacactgggattctttttttttttctttttttttgtagaaaacaacgaagggaatcttgctatgttgcctagcctggtcttgaactcctgggctcaagcaatcctcccttcttggcctcccaaagagctgagattacaggtgtcagccactttgcgtgaccacaatttcaatcatatttaaaatgtacaattcaagtgattttgccacactaaccacagactcatgtttaagccacaccaacggatttccatgttttaaataacatattttgccaccccctagtggacagtggctcaccaccggcacaaggggctacataggcagtcaatgggaaccaggcggggacgggaaatgtcgtgaacccaacggtccctgcccagccccacccgcgtccgcaacgtgtaaccacatctcctgactgcccaagagaagcgcagatttccatactgaacatgaaattgcctgacttcgaaatggtggcaaatcattaaaaaaaattttaaactcactttgcattggttattagggtcgaacttggggaagacccctacaggtgtgtgtgtgtctgtatgttaggggtgttcagacctttaatagggctagaaaccaggcaaccacaccgcggaaagcttgaggagagggaaatccaccagacgccaagcaggagggtcagggaagagacagggtggggccactaccgggttaaagacttgtagtgggtggggctacacgtagggccgagacgaccggatttccggaaatcagagccggcacacgtgacttttgtttgcagaagtgggaaggtaccctaggcagccaatcggggagcgctgagtctctgtccagccaatgagaagccaggttgttttagcgcctcgcccctcctctccggtccgcgagccttgggtatctccagcttttttccgccagagctgtttccgttcctctgcccgccatgccgttcctagagctgcacacgaatttccccgccaaccgagtgcccgcggggctggagaaacggctgtgcgccgtcgctgcctccatcttgggcaaacctgcagacgtgagcgtgggccgggcagcactgggcgaggggaagttggtgggccaggggtccggccttgtccctgctctgcctccgcaacagcgaccccgatccctttccccagggaccaccccccaccccattccgcaggccaagctctgactttccgtgcttcacgatcccgcggctccccctccgcacgtctttcccttgtcgccctccccagtcatgacccggacgtgaccttcagggacctcggcctgtactgggatccctgtccccgcgaacactgcgcgtttcggctttcgcgcgctcgggtcgggaccccagacgtagcccgactggctccagcttcgggtaaaacttttcatgttcccctcagcttgtgaacgtgacggtacggccgggcctggccagggcgctgagcgggtccaccgagccctgcgcgcagctgtccatctcctccatcggcgtagtgggcaccgccgaggacaaccgcagccacagtgcccacttctttgagtttctcaccaaggagctagccctgggccaggaccggtgcgcaggggtagtaggcccggaatattattctaaaacacaatcagagtactccattcctgctaacagtttaaagccaaacacctaggcaggccatttaggcttctgaatgactgggtcttgaccaggagagctgctgtctaggttttctcttcctgaccagttcctcaagagaaatgcaaaactagtgattaacagtaagagtcaggcagggcgcggtggctcacgcctgtaatcccagcactttgggaggccgaggcgggcggattatgaggtcaggagatcgagaccatcctgactaacacggtgaaactccgtctctactaaaaatacaaaaaactagccggacgtggtgggcgcctgtagtccccgctactcgggaggctgaggcaggagaatggcgtgaacccgggaggcggagcttgcagtgagccgaaattgcgctactgcacaccagccggggcgacaaagcgagactgtctcaaaaaaataccaaaaaacaagcaaaagaaaacaaaacaaaaacagtaagagtcgtcccaacgcagtggcttatgcctgtaattccagcactttgggaggccgaggcaggcagatcacctgtggttgggagttcgagaccagcctgaccaacatggagaaaccctgtctctactacaaatacaaaattagctgggcgtggtggtgcatgcctgtaatcccagctactcagaaggctgaggcaggagaatcactttaacccgggaggcggaggttgtggtgagctgagattttgccactgaactccagcctgggcaaaaagagcaaaactccttctcaaaaaaacaaacaaacaaacaaaaaaaaaaaacacacacacacacaatccaaaaaccagtaagggtcatgtcctgggaggctaactcagccgactgttaggtcaccatgcttatagccaagaaatgtgggatgctgctgggccctgagcggtcagataaactactttctctgataattagaaggctacaggaaatgttttgttttgttttgttttgggtttctttgtgtgtttttagagacaggatcttgttctgttgccccaggctggagtgctatggctcaatcagagctcactgcagcctcgaactcctgggctcaagcaatcctcccacctcagcctcccaagtagctagaactacaggtatgcatcaccacgcctgactaattaaaaaaaaaatttcttttggttgcgtgtggtgtcttggcacccgtaatcccagcactttgggaggtagaggtgggagcatctcttgagcacaggagtgcagggctagcctgggcaacatggcaagaccctgtctctacaaaaataaaaaagaaatgagctgggcgtggtggggtgcacctgttgtcccagcttcttaggaggctgaggtgggaatattgcttgagcctgggatgtcaaggctgcagtgagccatgactgtgccactgcactccaggctgggcaacagagtgagaccccatctctgaaaaaatatttttttggggagccaggcacagtggctcatggtaatcccagcactttcagaggtggaggtgcacagatcatttgaggtacagagtttgacaccagcctggacaacacggtgaaaccctgtttctactaaaaacacaaaaattagccaggtgtgatagtgcgtgcctataatcccagcttctggggagactgaggcaagagaatcgcttgaacctgggaggtggaggttgcagtgagctgtgatcatgccattgcactccagcctgggcaacagagcaagacactatctcaaaaaaaaaaaaaaaaaagtttgttttgaaatcctggactcaagcaatccccccaacctggacctcccaaagtactaggattataagtatgagctaccacactcagccactttttttttttttgagatggagtctcgctcggttgcccaggctggagtgcagtggcgcgatctcggctcattgcaaggtccgcctcctgggttcatgccattctcctgcctcagcctcccgagtagctgggactacaggcacccaccaccacgcccggctaattttttgtatttttagtagagacggggtttcaccgtgttagccaggatggtctcgatctcctgacctcgtgatccccctgccccggcctcccaaagtgctgggattacaagcgtgagccaccgcacgcggcctcagccacatttattaatttcactcttggcaaacatcagggggaagctgacccacacggcctgggaagggggttgtcttttgcatagagaccatgaccaggtctgggacagaggaaagtcaaataaatcacacattagagttagaagcagaggctcaggctgagcccaggtttattatccaaaatcaaaatgaaatgcagtgattaaaggacacaaggcctcagtgtgcatcattctcattgtggctttcaggcggctgtggaagacagggtggggatggtggcttcgggaggtgaggtgctctgggacttgggcaagtcttaggcaagccattcctgctttctgggcctggctcccatgggccattagaaatgaaaatgctttgtggactgctgaggacggtgcaagggtgaggtttcccagctcaccggatcatggccagcacccagggcatcagcttctgctttatggtggggtctgcaggtgggaagtccttggccttcagaatgacctcatgggcctcctggaagaggtcctcccccactgctgcctccacgcgctgccgccatgtggccagcttgggtcggccttcgaagacttggcagccagcacccacgggctgtggggaaaagggtacagactggggatggatggttgtgagggcagggatgggcagcatctgatttggggaccacagatctccaggaggtgtttgcacacacacttaagcacagtgccatagcccggtgtggcagcataagcaggacttcagcaactagccagggccccctgcctagtgggttcacctgcccacagcactcacatgcatcagctccgtgatggctacgaggtcagctaaggagatgtgaggaccagtaaggaaggccttgttctggaggaacttgtcctcgagcaactgcagggtcacatccaactctgccagggtggctgccagtgtctggggagatactggctcacccaggaaaacagggaacatcacctggggattgggcaggcaaagtcgggagttactggagtagggagttagttttgatttgcatttccctaatgattagtgatgctgagcatcttttcttttttttttttttttgagactgagtcttgctctctcgcccaggctggagtgcagtggggtgatctcggctcactgcaagctccgcctcctgggttcacgccattctcctgcctcagcctcccgagtagctgggactacaggtgcccgccaccacgcccagctaattttttttttatttttagtagagacagggtttcactgtgttagccaggatggtctcaatctcctgaccttgtgatctgcctgcctccgcctcccaaagtgctgggattacaggcgtgagccaccgcgcccggccaagcatcttttcttgtacttgttggccaaaatgataatattctcaacacattgggttaagtaaaatatatcaatttccttttactttttttttttcttttgagacagtgttcagctctgtcacccaggctggagtgaagtggcaccatctcggcacactgccaactttgccccctgggttcaagcaattctcctgcctcagcatcctgagtagctgggattataggcacaggccaccaagcctggctaatttttgtggttttagtagagacaaggtttccccatgttgaccaggctggtctcgaactcctgacctcaggtgatccactgccttggcctcccaaagtgctaggattattggcatgagccactgtgcctggactctttttactttttaaatgtgcctactagaaaatttaaaattacgtatgtggctcactttatacttctatcggacagcacttgactaaatgaactaaattccagagaggcataagccgttcctagatgagctactttcattccaatttcatttccttgggcccaagcaggctgggagaaagactgtcacaggcatgggcttttctgactgagcagcagtttgggaactgggggcagggatgaaaagcagagagatcttacaggcaacatcgtagttggtgattagattccaaagccatgctagactgagctagtgacctgatctcacattcaagatatttgaaaccaaagataaactgaaaccaactaaacctgcaacccagcccacctcctgattagcttagaagagaacagcctcacatcctggctacctgacacagggaagtgcaagccctttcttgggggtgtttattatgcaattcaatctctgctcttcttttatcataatgtctggcacacaaggatacatcatgaggccgggcatggtggctcatgcctacaatcccagcactttgggaggccgagatgggaggatcacctgaggtcaggagttcaagaccagcctggccaacatggtgaaaccctgtctctacaaaaatacaaaaattagccaggcatgatggcaggtgcctgtaattctagctacttgggaggctgaggtgggagaatcgcttgaacccaggaggcggaggttgcagtgagccaagatcgtgccattgcacgccagcctgggcaatggagtgagagtccgtctcaaaaaaataaaaaataatgataatacatcatgagacatgcaaagaagcaggcaaatgtgacccataatcaagagggagaaaacaacaatcaatagaaatagacccgtaggctgggtatggtggctcatgcctgtaatcccaacactttgggaagccaaggaggacgaatcacttcaggtggagagttcgaaaccagcctggccaacatggtgaaacccggtctccactacaaataacaaaagttagccaggtgtgctggtgggtgcctgtaatcccagctacgcaggaggctgaggcaggagaatcgcttgagcctgggaggtggaggttgcagtgagctgagatcgcaccattgcactcagcctgggtgacagagtgagaccccatctcaaaaacaaaacaaaacaaaaaaaccagacccacagaacacctacgtgttgaaattagttgacaaagatttttaggtaacagtgataaatatgttaaagaatttacaagaaaagacagataaaatggatgaacagatggtgaatttcatcagagaagtggaaattctaaaaaacaaccaaatggaatttccagagctgaaaaatacatatctcaaacaaagaatgtattggatgggcttaatagcaatttggcacaacagaggaaagaatctgtgaaggcaaagacaggtcagtagaaataatccaaaactgaaaagaagagactggtgcctgaacacctttggggaatgctctcgctgccgccccccacattcccagcctcaccttatgccacaaggcccggaggcagcttctccgcagagtcgtgtgctgccatgccaggtactcatccacacgggcacgggcctgcaggtcctgagggtaccagtagtcagggaccttatatttgcgcgtcaggtagagcaggatggccacactgtgggtgtgggggtcatgatgggtaagggaagggcactgtgctgggtatttcatacatagtcgcttttttttttttttgatacggagtctcgctctgtcgctcaggctggagtgcagtggtgcgatcttggctcactgcaacctccacctcccgggttcaagtgattctcctgcctcagcctcccaagtagctggaactacaggtgcgtgccaccatgcctggctaattttttgtagttttagtagagatggggtttcaccatattagccaggatggtctcgaactcctgaccttgtgatctgcctgcctcggcctcccaaagtgctgtgattacacgtataagcaaccgcacctggccttttttttttttttttttttttttttttttggagacaaggtcttcctcagtcacccaggctggagtgcagtggtgcagtctcagctcactgcagcttcaatttttataggagtgcaccaccatgcctggctaccttttttcttttttgtagagatgggatctcactgtattgccaggctggtcttaaactcctatcctcaagcaatcctccagccttggcatcccaaagcgctggcattataggcatgaaccactgtgcccagcacacttctttaacctttctgacaatttgccaaagtattagcctcattttccagagaagaaaaccaggcttagaaaggcagagacttgccctagggcacacagctcttaatggcagagctgagaatctttctgaggctaatacccaagcttttcctaccaccaggcaaaatcccacaacagaatgtcttgccaaatgtttagagacagtttctgatcagagaaccagagagagcttccaggagaacggggcatcaaagctgagctttaaagaagctcagttctttccattcggtatccactctcatctgctgggattccgaccagcctctgatggcctgactgttcaaaaaggcttccgtgtccctttgttctttctgtcattctttctgccaagaatcagctcctatctaagctgactggggtagtttggcttcctaaagtaccactcaggaagcactcctgcagctgcaggatcctagaacaacagaacagacaaggccccctggcactctcctccttccctgggttttgagggccgccatggtgatgagatgagcatggacctggaaggacacaggatgtgtccatttggagacacagaaaagctttcaggaacttggggtttcccaaaggttgggcatgcaggccaaaagggcagaaaacctctgtatctgccacgggcctatattctcttttaagctggggctacacacgtgtcccagcttaacgactccgttgtctgtgcagggtgcccaggagctccttttgctcccagccaattgttcaagccacctctgaggagggctgcaggtctctgtgagccacagacctgaaggtgagagtagtgacagaggcagagattgcacattgactctggctggtacctgggggtcacaacgctgagtgacacaaggactcaggacacctggggcaccagggaggaagacgggccctggcagaatgtcagaggaattcatcggaggtgcgtccatcctgagatttcagagatgagctttaaagcacaaactccaggttcttgttaggggaagggtgactctggtgacaaaaggggcagaactggggaaagattggcttttcctgaagaggattcaacttcttgggaccagctgtgatgtaagacgtccatatctggtggctcttccatggggaagacccatcctgggaagctgcagcccagagatggagccaccgggcagcccagatgccactgagccatcgccacacaagcttggccagaggcctgccccacggtgggcaaagctgccatcgtcctctggcctaccctgtctcaaggatactctcaccactcaccagcaaccaaagcactggtgtggaagtaaagtagatatttgcttttctaatcatcagggtgaactggaatagcaggaaggcaagggcctggggtccagtactgactctctgcaggatgcggggcacagagactctctgcctctgaagactttagtttccttgtctatgaaatagagggttagaacaggatggttccagcaggcctggcagcagtcctagggtcccagttacctctccgtcaaggtgaagtccccgtccttcaaggctggcaccttcttgagggggttcacctgggcaaaggcatcgcttaagtgctgacctgggaagagtccagcatggtgggtggtgggaggagaacgctgagcccgccatggcctgtgcccctccctgcaatgctctggccccagtttcacagttcttcttcccaccagtctgcactcctggttggcaaagactggaagggcccctgcgggaggaggaggagaccactccaccggctggtacaaaatagacaacaccccttgctaagtcctgtaggcacagcctcctcccacaggctgcccctctgcaacagagctcactgtgcagggtgtggttcctggacctttgcatgcaccctacccatctcctctttccactattgccagcttcatgaactcacaatcagagcaccccaagctgcacgataggtcacctgaggggactgactaccttgtcccttccaccattaattctaaggcagggtcatgaaacacagagaagtggtctttttctggtatctacctacttagaagcaacttctactggccccaccatgtccctttgttcaccctgccctgggcactgtggagctgtgtgtagcatacctgctaccaccccctgtgccccaaacttttattccccttacagttggggtctcactatgttgcccaggctggtcttgaactactggcctcaagtaatcttcctacttcggcctcccaaagtgctgggattacaggtgtgagccaccatgcccagcctgctaccctctcttcaccctcccttcagactgttccttcaccaggaaaaccctcctctgtctcctgggaaaacacacttccctctgcaccactacatttgacaaccagcttggacgtcctcttgtcccccattccctttcctctactccacactctgcagaggaagtccttgcgcaggacagtgggcagtttgcagaagagattatgtggagaagtttcaggcagagggccagccatggagtgggagccctgggcagaaggcttagccaagtagagtcgccttacttgccccaccagccatacctggattctgcttccaacccctcctactaccccaccctgcactgggcctgggcctgggcctgccagctgagtcctcaagggccttggaggcatgctagagaaacaaaacagggtgtagggctcatcaagccccagggtccccctgctgcttccagcatcagcagcctggggcaacctacctccccagcaggaacaagaggcagaggacaaggtttcgggcggcagaggttgcagtgagctgtgatcctgccactgcactccagcctgggcgacagagcgagactccgtctcaaaaacaaacaaacaaataaacaaaatgccttgggccaggcacagtggctcatgcctgtaatcccagcactttgggaggctaagccggcagatcatttgatgtcaggagttcgagaacagcctgaccaaaattgtgaaatcccatctctgttaaaaatacaaaaaaattagccagacatagtggcacacatttgtaatctagctactcaggaggctgaagcaggagaattgcttgaacccgggaggtggtggttgcagtgattcgagatccgtgccactgcactgcaacaaagcaaaagcaagactctgtctcaaaaaaaaaaggacaaggacaaggtcagaggcaaaacaggaggaacagaggaaggaagggacaaagagggaccccaatgcagactggacgagtgcagagggcagggatggaaagtcacgtcctgagctgtttgctgttgcagaatctcagcagctgggccataaagaagggacttgacgctgtcccagtctctacacttggcacccttgacctctctcatcccacctttccctaggccgaggtcacacctgctttcattttgtttttttttgttttttttttttaagacggggtctcgctagattgccctgacgggagtgcagtggctattcaagggcaccatgatagtgcactgcggcctggaattcctgggctcaagcgatcctcccaccccagcctctcgagttgctgggactacaggcgtgtgcccctgcacccagctgcgcccgtttttgtcctcctgtctggcttctcttcatgatccccacccctttattcggcctcaggggaaccccgtggtctattccgtgagaccgagcagagttttggggagccccgactcttggatctccctgctggctcacctttctctgttcggtctccaaaccagaccagcaatggccccaggaagaaggtggcgctgggagaagttccctaagctatgtatgcctacctgtccccttcctgacttttcggttccccaaacccgaggctggacctacctttaatcagatccacgatgcgcagctcgaagggaatgtcgttcttcttggcaaagatgtaaacagcgcggcagggctgggacagcaggtccaggtacagctccaggcccatagtggggaccgaccgacctgaccggaaaccagagggagtcagcaaactccagtgccaggactcgggtctcggacctcagaccacgcccctgcggctacgcaccccgaccgctgtgccccattgggcggcacggacgcctgggacactctttagtccaattgcgggcggcgggcggcctgtctcagggctgggcccgcctggctcctgtgggatcagggtgggtggccaagagaccgttgtctctcagggggacgcacagagaggccccagtcccatccctttcgtgcctggctcgctcatttcacttagcataatgtcttcaaggtgcatctgtgttgaagcgtgtgtcagaatttcccaccgtccgcattttagaggaggagacagacactgaatgattatagacccagaaagtctggctccaaagtccatcctcttggctcaacactgcagagtccttggtgccagcaagtggcaaagcctcagggcttacgttcagtgttttgtggtcactcgcttcactgcagtcgcactccctggaatgtcacagccttggtcttcctgcccctgccagcacagtgccatctatcgcattccctgggtttatttcttcctttctccaggcctgtgtttctccatctttaaaatgacagggaagctagagccctccagagtccttgcaagtccacccccctggattcatctgctgagccgtaagcccaggcctgccccttgctgccatggagcctgtcaaatagtatcagggtcacatgtcattttctaaaacgaatcccactgaaagtgtgtcagccaacgcataatgttttctagagaataaggaacatttctgcaaataaagtggaagtaacaactgttttattttatttagatagagtctcactctcttgcccagggtagaatgcagtggcatgatcacagctcactacagactccaactcctgggctcaagccatcctcccatctcagcctccccaagtagctgggactacaggtgcgcacaaagacgcccagctagttaaaaaaaatttttttctgtagaggcagggtctcactatgttgcctaggctgatcctcccacctctgccacctgctgggattacagatgtgagccactacaactggccagtaataatgatttttaactggaaaaaaaattaaggaaagatgagaaattcagatttccatgttaaagttttgaaaggaggtagacactcagagaaggcaatggctgccttatcctcacctctggataactccagtcagaggcccaaggaggagctgtcaggattctggttcaaggctcagcctgtcttttaagttcaaaacctaatttggggcgggagtggtggctcattcctataaccccagcaccttgggaggctgaggccggcggatcacctgagttcaggagtttgagaccagcctggccaacttggtgaaaccccatctctgctaaaaatataaaaattatctgggcgtggtggcatgcacctgtaattccagctactcaggaggctgaggcaggagaatcgttgaactctagaggcagaggttgccgtgtgccaagactgcgccattgcactccaggctgggcgacaagagagtaactccaactaaaaaacaaaacaactaatttggtccacgtttcaggattgatcattttctttgggtctgactcacataaaccaactcacaaaggctgtatttattaatttatagaaacaagataaaagtgagagtgtgtgggttggttcgtttgtttgttttttgactttgcccctctctgtcactcaggctgaagtgcagtggtgcaatctctgctcactgcaacctctgcctcctgggttcaagcgattctcgtgcctcagccacccgggtagctgggatttcaggcatgtgccaccatgctcagctaattgtatttttagtagagacagggtttcaccatgttggccaggctggtcttgaactcctggcctcaagtgacctgccagcctcggcctctcaaagtgctgggattacaggcgtgagccaccgtgcccggcctagaaagaagagaaaagtcatttagacagaatgctcccaaccattgctcagtgctctcttggcagtgtagtctcctaggaagcctcgtgggtgttactggccaggaccaggtccgttctgcccatgcacagtaaattaatcactgtgacatgagttttgcaaaagactaaagatttattcacaagggtgccaagcaaggaggtaggataatagctctcaaatccacctccccgaaaataaggcttagggataagccttgcttccaagcaataaagcacagaccccagtcacactcaaggggagggggctatacaaggatgtgaataccagtctgcctgcctcgtgggcctacaacgcagaagggccatgcacttggtttaaaactttgttgttgctgtcttgacattcttaacaatttaaaaataagggtccccacattttcatgtgtagccagtcctgtccaaggagtccaaagaggtcatgagggtggacaggtcactgtctcctctgggcagtgatggggccactagcagttgttctgtagtctcctagcccctaccccagggccacaccttccccatggtctctcacattcttttttttttttttttttttttttttgagacagggtcctgctgttgcccaggctggagtgagtgcagtgctgcaaactcagcttactatagcctcgacctcctgggctcaaacaatccttctgcctcaccctcctgtgtagttcggatcacaggcacatgccaccatgcttggctaattttttgactttgtagagagggcatcacactttgtttcccagggtggtcttgaattcctgggctcaagtgatcctcccacctcagcctcccaaagtgctaggattataaagatgtgatccgccgccccggcctctctcacattcttggcatttaaagttaccgtcattgacaaggaacatgggtacactccaatttactcaagaaaaaaactcttttctccattgaagagatatgtggcctggctgcttcctactctagttgaggtcttctttttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagcagcagccttgcctgggagcttgttagaaatatactaacaggctcccacccccaaacccagacctactgaatcagacagagtctgtattttcataagatcctcagatgatccaaatgcgccttaaactttgaggagctttgatccagaacctgggctggaggcccctgggggccactctgttcctcacagactgcaaggtatgtttttttcttgcctcttctctctgtcctaatgtctccttctctctgtgtctgaccctgaggaccctatgacatcttcccaggggagtttccactgtcaaagagctgattctctctctcttttttttttttttgagacggagtttcgctcttgttgcccaggctggagggcaatggcgtgatctcggcttaccgcgacctctgcctcccaggttgaagcgattctcctgcctcagcctcccgagtagctgggattacaggcatgcatcaccacgcccagctaattttttgtagttttagtagagacagggtttctccatgttggtcaggctggtctcgaactcctgaactcaggtgatctgcccacctcagcctcccaaaggcatgagccaccatgccctactgccagaggcctgattctctagaatctgatgggctcttctagacagcaatctctacctgggctcttgttgaagaagccaatcagctcattggttggaggtcacatgatataaaacatggccatcttccaagccctatgtgtggacaacgagatagggacaagtaggcatatcacgttctgatacctggacccacatctgtcgctgggcccacgtctgtcctcaggcccccaggatatacttttatggggagttttcctcccttcccccaatgtggtcactcataactttacacccaacagtcaaacaggagtggaagctacagagtttcacgcaaacaataggctaggctgtgggactgagtaaaaggcactggactgtggtaggtcttactccaagatggccaaatggaagggcttttagctttctttgtttttgttttatatcctgagacaaaatgttcaatttctacactttagaataaaaagagccatattttatgtttcatattttttgtatgcttcctttcatactcttttgaacaatgcaatcatattttcattatgaggtataattcacataccataatatccgctctttcaaaatatactttaaaattcaattggtttaaagccaattcattggtttttagtatattaacaaagttttgtcaccatcacaattatctaattctagatcattttcatcacccctaaaagaaactctgtacccattaaacagtcactccccatttccctcttctcctagcccctggtaaccattcatctactttctacctctgtggacagtaagtatctgcctattctggacatttcattcaaatttaataatgaaatatgtgagcttttatgactggcttctttcatttaacataatggtgtcaaggttcattcatggtgtagcatataacagtacttcatcccttcctgtggctgaattatattccattttatgtatacaccacattctgtttatccattcaccagttgatggacttttgcattgattctacttttcagctattgtgaatccccatgctgtgatgaacattcacgtacaagtttttgtctggacatatgtcttcagttgtcttgggtatacacctaggaatggaattgctggataatataattctatgttggccgggcacggtggcacatgcctgtaatcccagcactttggaaggctgaggtgggtggatcacctgaggtcaggagttcgagaccagcctggccaacatggcgaaaccccgtctctactaaaaatacaaaaactagctgggcatggtggtgcctgcctgtaattccagcctgtaattccagttactcaggaggctgaggcaggagaattgcttgaaaccaggagacggaggttgcagtgagccgagatggcaccactgcactctagcgtgggtgacagagcaagaatctgtctccaaaaaaaaaaaaaacaaaaaaaacaaaacaaaactaacccatatatatataatatgttatatatacataataatatattttatatatatgtgtatatatgtttaacttttggaggaactgcaagctgttttccaaagcggttatacattttacattctcagcagcagcacacaagggtttcaatttcttcacacatcctcaacaatacttttaatctgtcttttctgttatacccctcatagagtgtgtgaagtgatatctcattgtggtttgattggcaatgtcttgattatagtatctttgtactaagttttgaaattgggaagcatgagtcctacagctttttctttttcaaaattattttgaagattctgagtcactttaatttccaaatgaattttagggccaatttgtcagtttgtgcaaacaggccaagtggaattttaatgcagactgtgttgaatttgacatcttaacattactacaccttccaatcatgaacatgggatgtctttccatttattaaggtcttctttaagttttcccccaacttttaaattatgaaaacatttaaaatccagaaaatgaaaggactagtacaacagcactaatatatgcaaccccagtttcaacttactgttttttgaacataagataccaacatcatgacaccccacctaaggactttttagcaaaacattctaatttctctactgggattattgtttgttgtcttcctccacaataatgtgagcactaaaggtagagacttttgcgtactttgttcactactgcttcctctgcaccaaaaacactgcctggttgtgggtacttttctagttttaggaaggagaagacaagatataggtcctgactctggttctgcctctcattcatatgctactccgaggatcccttccccttgaagaacttgtttcttcatctacgaaatggggataatactactactcatcagggtggttgtgaggattaaacaaggtaagagatgtaaaattgcatgttagttatcagatagttttgttttcccatctagctccatgagggagaggatttgctctagtccgtccgtctgggctctgggcttctaatgggcagacaccttcctccatgatgtttgtagctgcaaagcctggcacagtccctcaagacaagctttttgacttgaactgctgatggtcttccatgcacaattcaacagaaacccagtagcatacacttccttgtatgcacttgcccctctttttacatttattacacattcattgctacctaataatccccgatacttatcttttactttatccaattattcaacagttttcaacagaaatacctagaagagagctattccgacttcattagaccctgagattctatttttaacatttcttccatggattgttgaatgtttccaatgattgatccaccttcccttggccttatctgcattccagatttggttgtgtgtccatctctgtgttgccagacttacctcacagacccagcttgaacacaagatgggtgcttgctgaagagcaggactcattctgttgaacctgcatgctttctcaggtcagattgcttggtggtgcttctttaatttctttcaacagcacattgtagtttgctgtgtttaagtgttgcttttctttggttaaagttattctaagtattttattctttttgatgctattgtaaatgaaagtgttgttttaattttgtttttgatcctttactgcaaatgtatactattgatttttgtgtattaatcttgtatcctgcaaccttgctgaacttgcttatgagctctaatggtttttaagtgagttccttaggagttcctataatgtcatctgtgactaaagatagttttacttctttctttccgatctggattccaccttgttcctttttcttgcctaattgccctaataaatagaagtagtatgaatgaacattcttgtcctgctcttgatcttgaggggaaacactcaatctttcacaaggaatgaagtatggtgtttataggtttttcatagatgctctttgtcaggctgaggaagttcctttctagtcttcatctgttgagtaattttatcataaaaggatgttagattttgtcaaatgccttctctgcattaggatgatcatgtgactttctattaatatgaagtgctatatggattggtttttgtacattgaaccacatttgtactcctgggataaatcctacctggtcaatgtgtataatcctcttaatatgctgctgaatttgatttgctaatattttgctgaggatatttacatctatatttataaggatattgctttgtaactttattttcttataatgtgtttttctgtctttggtatcagggtaatgctggcctcatagaatgagttgaaaaatatttcttcctgttctattttttagaagagtttttgaagggttggtgtcaattcttcaagcttttggttgaattcaccagtgaagctatctggtcctggacttttctttgtagggatttcatttattgatttattgatttattttttgagacggagtctcgctctgtcacccaggctggagtgcagtggtgcgatctcggctcactgcaagctccgccttcctggttcacaccattctcctgcctcagcctcccgagtagctgggactacaggtgcccaccaccacgccccatctaatttttttgtatttttagtagagatggggtttcactgcattagccaggatggtcttgatctcctgacctcgtgatccgcccacctcagcctcccaaagtgctgggattacaggcatgagccaccgcgcccggctttttggtaggattttaaaaaaattaatattttaatatctttacttttacaggtctattcaaattttatcttccttcttaagtccgttttggtagattgcatgtttctaaaattttctcatttcatcgaggttatctcatttgttcacatacaattattcatagtatttctttataaacctttgtacttctctaataccagtagtgatgtgtccattttctttctttctggtgtctggttttttggtttttgttttttttgtttttttttttgatataaggttttcctatgttacccagactagagtgcagtggtgcaatcacagctcaatgtaaccttgaattcctgggctaaagtgatcctcccaccttagccacccaatttgctaggactacaggcgcgcaccaacacactcagctaattttttctttcttttttttttttgagacgaaattttgctcttgtcacccagggtggagtgcagcagtgtgatcttggctcactgcaactctgcttcttgggttcaagcgattctcctgcctcagcctcccgagtagctgggattacaggcgcctgccaccatgcccagctagttttttatttttactagagatggtgtttcaccatgttggccaggctggtctgaaactcctgatatcaggtgatccgcccgtctcagcctcccaaagtgctgggattacaggcatgaaccactgggccttgcctcctagctaattaaaaaaaataaataactctttttgtagaaacaagtctcactatgttgcccaggctggtctcaatctcttggcctcaaatgatcctcctgcctcggcctcccaaagtcctgggattacaggtgtgagccattgcacccatcctccactttcttggtgaataatttgagtcttattttttcacttggccattctaactaaaggtttgccaagttttgttgatcttttcaaagatccaatttttggtttctttgattttctctattgtttttctgttttccatttcatttatctccattctaatctttattatttcctgtcttctattggtgttgggtttattttgctcttatttttctagttccttaaggtgtaaagttaggttattgattgaagattgttcttctttaacttaggtgtttacagctataaattttgctcttagcactgcttctgctgcatcctataaatttgggcatgttgtgttttcatttttattcattcaagatactttttaatttcccttgtggttttgtctttgacccattggttgtttaagagtgtgccgtttaatttctatgtgcttgtgagttttctagttttccttttgttcttgattttaaactttattccactgtgtccagagaacaccctttgtatgatttcaatcttcttaaatttgagacttaggaccaaatatatgctctatactggagaatattccatgtgctctttagaagaatgcttattctgctcctgtcgggtagaacgttctgttcatgtctagtgtgtgcaattggtttacagtgcttttcaagtcctctatttccttgatggtcttctgcagtttttctattactgaaagtgggggccaggtgtggtggctcacgccccgaatccctttggggattcagggtggctcagcactttgggaggctgaggcgggcgatttgcctgagctcaggagttcgagaccagcctgggcaatacaatgaaaccctgtctctactaaaatacagaaaaaaattagctgggcatggcggcatgtgcctgtaatcccagctactcaggaggctgaggcaggaggattgcttgaacctgggaggtggatgttgcagtgagctgagatcgcaccactgcactccagcctgagtgacagagtgagactccatctcaaaaaaaaaaaaaaaaaaaaaaaaaagtcaggtattgaagtcaccaactattattactgacaacgtaatcatatttaaccctttacttttaaaattctttttggaaactggaaggatctgtaaccaccacccacttccacatcagaccctatgcatacgccaactgtctgttgctcagcagctgtgatgttgttccagttctttattaggcaaagaacagttgtttttttagcatttcctttaaggaaggtggctcagatcattgagccagccaggccctgcaggatgggctgcgattagggtcacaagtacttctcccgaaactcacagattttcctcgtgaccattggatccaatgttgaaaagtcccagtcggccaactgcattagtcgatcatgggcctccctaaagaggccacagccaatattcagctccacccgcatacgccactcagctagcttggagctgttgaggaagacattatagttggctgccatgggctgtggatagacaaagacgaagatgtggtcagcctggggaccagccccacctgggtcctctcccacagcctctggcccacgtccctaacatctacctatggaaagaattaggctgctgacccccaaggcctgagcaaggggtcacagactatgtaatagatgtaggtggggatggaggatccagaatccctcagagtcctcagtcactggtcttcttgctccaagccttctgaaccacactgagagggctcctggcccaggcagctcccacttctccagcctgcgacctcgcatgaatcctgccttcttccagggaaaccccttatcccaggtgtgtatatgcggatgagggagagaactcaggttttttcctccatgtttagactcccactatgatcaagctcaggggctaagatgggagacctggcgggcagtctaccctgcagtttcgctggctcactaagacagtctaccctgtagttccgtttgcacccaagatctttgggaagccaaagaaggggtgggtcgttggtgaaatgtaaggggtggggacgaagtatatggctgaacccttggggcaggccagaatgatttttcctggtgctggtctgccctgcaaacagaccaaagagactaattttcgtatcaaccagagatctctgcaatagggaaaagaacactgtatttcctggtcaatccaccaggatcccaggtgcctcctcctggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttccttccctgttatctttgggatcagcaactggccagggttgggaagaggagggaagaggaggctgtactccagggccacctgccctgccaggtctctgtactcttgtctgctggatagatattgaacacttcccaggatataaagcagtttcacctcttttagcagttctgattggtggaaggtgccgggaaccatgcgttcacaaggatttggggagctcagcaggcataagtcctgtgattgattagtgatgccggtcacaggcatggaatttgaagtagagacacgtgtactggttatttgtcatcttccaattttcttttttcttctttttttttttttttttttttttttgagacggagtctcactctgttgcccatgctggagtgcagtggcgggatcttacctcactgcaacctccgcctgctgggttcaagaaattctcctgcctcagcctttggagtagcgtggattacaggcacatgccagcatgcctgggtaacttttatatttttagtagagatggggtttcaccctgttggccaggctgttattgaagtcctgaccttgtgatccgcccacctcggcctcccaaagtgctgggattacaggcatgagccactgtgcccggccatcttcaaattttctatgagccatttttttttttttttttgagatggaatctcactttgtcacccaggctggagtgcagtggcatgatctcggctcactgcaacatccacttccctggtttaagcgattctcctgcctcagcctcctgagcagctgggattacaggtgcccaccaccacaccagctaattttttttgtatttttagtacagacagtgtttcacaatgttggacaggtaggtcttgaactcctgacctcaagtgatccacctgcctcggcctcccaaagtattgggattacaggcgtgagcactgctcctggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcgggtctggcgggcaccagtgcgatggtgcgctgtacttgcggcacaggtagtaaaggatggccgcgctgcagaaggggccggtcaggggcactgcccttgccttcctgagtgccactacatcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacggagggtagcccctggaggtgcagggaggttatggacttaatgcttaagattaggcattatataagccagggcatgaaaggatccatctctctggtgctggatggagggtgagcccgagggggcagaatggacaatgagggggccagcaactatcgggaaggttgtggtgtctgggaatgttggaggccatggggacagagggaaggggatggaggggagacatgcttcggaggggatgtcctaggccttgctgattgatggctggtgtgggaacctccgcagcacaagggctcctttatcatcaccagcagcaaccatgccaaggtaaaaaggtcagggcatggagagagctatcggttaaaaagtggcaggagagacagcaactggctgcaagactcagaacttcttggctgggcacggtggctcacgcctgtaatcccagcactctgggaggccgaggcggggggatcatggggtcaggagatcgagaccatcctggttaacacagtgaaaccccgtctctactaaaaatacaaaaaaattagccaggcatggtggcgggcacctgtagtcccagctactcaggaggctgaggcaggagaatggcgtgaacccgggaggcggagcttgcagtgagccaagatagcgccactgcactccagcctgggcaacagagcgagactccgtctcaaaaaaaaaaaaaaaaaaaaacttctttggatcctgatccaaacaaactgccaagaaaatgtttaggagataatcatagagttttgaacaggagccacatattagatgaaatccaggaattattgttaattttatgaggtatcttaatggtatcgtagtgatgctacgctctatcctagcccaggctggagtgcagtggcgcaatcagagttcactgcagttctgaacttcctggcctcaagcgatcctcccgtgtcagcctctggaagtgctcggattataggcatgagccaccacacccagcctgttgctttttttttgtttgttttaagaactcttatctctgaaaagtatgttcctaaacatttattgatttatttacttatttatttttatttttgagatgggatctcactctgttgcccacgctgaagtgcaacgacgcagtcttggctcactgcatcctctgcctcctggctcaagcagtctttccgcctcagcctcccgagtagctgggactacaggtgcagaccaccatgctggctaatttttgtattttttgtagagatggggttttgccatgttgtctaggctaggctggtcttgaacacgtgagctcaggccatcccctcacttcagcctctcaaagtgctagaattacaggcatgagctggcttctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgcttgcactgaacctcccaggagaagcagagacagatggtgcaagggccccagggaagacttacctttcacttaagataaatttcccatctttgaggctgggcagcttcctgagggggttgatgtcaatgtatcctttgctgtggtggtgacctgggaggggcagggaaggtctgaggctgtgggactccaggggagagagaactgagactcccagagacccaaacgcctccctctctattttctcaagaagagggaactgaggcccggagggacattgcgtctcaccccaggtcacagggcaaggcagttgcagaaccggactgcgatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagcttttggagtccctctgtgctggggatggagttggagcccacccctctgaccctcactcagggttagtggagccctgagcctttctgaacactggggaggatgggtgtagacggactgtgcacttctgccccctttgccaacctggtgggcaggtgctgagttcacaaggtcctagaatcccacaaggaagccagggtgcctggtgggagcccagggagtcccagctactgttccttcccccttctcctcgaaaagcctgttcatctgtggcgtggggactgtcattagtgagcactgactaaggtaggctggacaaggatgcagcctacaagccgcgtggcatcttttccttccctgtggacctctggggtgattcccttgtctctgtctctgctcctcagaaacgcccctatcaggctgtgcgcggtggctcacgcctgtaatcccagcactctggaggctgaggtgggcagatcacttgaggtcaggagtttgagaccagcctggccaacatggtgaaacccctgttaaaaatacaaaaaattagctgggcgtggtggcatgcacctctaatcccagctactcgggaggctgaggcaggagacgcacttgaacccagcagaggttgcagtgagccgagatagcaccaccgtactccatgctgggcaacagagcgagactccatcaaaaaacaagaaaaaaagaaaagccgcaatctgtgtgtcctgcctccccccaggaccaggcctgccaggcagcagtgggagttgacctttcagcagatccacaaactgaaagttgaactggatgtcatgcttcttcgagaagatgtagacggcacggcagggtgctgacagcaggtccatgtagagctccagtgccatgttgagacacatgccaggccccacagccgcagttggccagccacagacctgggcctatgtctggccagagtccctggccctgtgccctctccgatctgggcccaggatcctgtgttccccagggaaacctcttgtttccctttgtgttgtcataaggccaggaagcctgcaattctcacagcatcaaggattctaaggaggcccaggagtaggctggggagaggcccgtggcaaaggtgtggcagccgtgaccctactctcccccttccacgtgtgcctgtgccccgtggtgccacctcacagacaccagtctgagaagggattatgcctgggaattcccacggctggattttcattgcagaacctgacgaaaggggctttgcagggtccagaatgaagaggaggcaatgagaattatccctggaggattctagaagtagaggctgggagtatccacaggtaaatcgagcctgaactatgactagaaaggaattgggagaaagagacacaggtgaatcgagcctgaactatgactagaaaggaactgggagaaagagacacaggaaactgtgagctttgggagcaatggggacaccaccaccaggaagtcagggggcactcagccggtgtgtgccacacagaggagcctagaaacttcctggccttggttggggctgcagtggccagactgtgtacctggtggccaaggaaggtaactagagccccacgtagaggactgagtgccactcactctatgctgtgatctaataggtctaggctgagaaatgggactgaccccacttctggtgacagagtaagcctggagacaagcgaagagcatgcagtgtgtttattgcagacagcagggtgcagtggagtgggctgcacccactgcacctgcttctgggccagctgggggtcccgccaagcctcactgtggttcagaggctggagtatgagcttgtgggcctccagcaagagctcagtaccaagggcagccgccacacgggcctgccacactgccagccggggcagtcttggaagaggtcgcagccaacggcagtgggctgggaagacagggcagctggggttggggctcagccccatgcccagagtccccccagagggcaggtgggtaggaaagcttcacctgcatcacctccgtcagcaccaagtcttccagggagatctgctccattgccaggaagggcctggccaccagcaccccccaatccaggtgctgcagggctggcatcagcctccccaacagccgctccagctgtgcagcatctgcaggctgtccggagaagtggggcaggagagactgggctgggaggagaggagcaacttaacccagactcttggaagcctcttgggcctcctctccatcccttcccggctgccactcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtgccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatccgggtgacctacgtcctttccccacctgggcagctccagctggctcagactctagccaggttccagcctccagctttagcccaaaggtgcccctgggtccagcctctgcatcggagctacacaggctgaaatgaggaaggggcctcagtgatttggaaagatctccaagccaaggaaagatctcccctctcgcctctgcctccccctacaactctgagccccagaacccaggcagatcctggctctgaccctgggtgggcaccaggtcaccattacctctttgctagtaggaagtcgccatctctgagggcaggcaccttccccagggggttcaccttcaggaactcaggcttcaggtgctcccttggtgggcagaaaggcgagaaggctcagtgtagggcctggtccttggcacccactccatggggcccagcccagccacctggctcaccccaagccaactccaccatccacagctcaaaagggatgtcattctgtcttgcaaaagtggatagtgtgtcaggtccaggaagagctcaagccccattgctgctcctctcacctgccctccccagaattctggacctccaggagttgctcagcccttctccactagttctgagctgtttcctgtccatagtctgctgtagtgggccagagcacagggcagatttgtcttcagggactttctctgggcattcctgggcagagaacttcatcttctctgttaactcttgctgataattctctgtagctaggcaccttgtaaaacccatgtcccagaatgccaaacctggaaatgcaatgtcagcgccgaaactgcattgaaactgaatgaa

SEQ ID NO: 434 - DNA, 69383 bp, Homo sapiens
acacatttaatgctacctaataattccctatacttttactttatccaatcgttcaacagattccaaccgaaatacatagaagagtgatattccaacttcatcagaccctgagattctatttttaacatttcttccatggattgttgaatgtttccaatgattgatccaccttcccttggccttttctacattacagatttggtggcatgtccatgtctatgttgccaaacttgcctcatagacccagcttgaacacaagatgggtgcttgctgaagagcaggactcattctgttgaacctgcatgttttctcaggtcagattgcttggtggcgcttctttaatttctttcaacagcacattgtagtttgctgtgttgaaatgttgcttttctttggttaaatttattctattttattctttttgatggtattataaatggaagtgtggttttaattttgtttttcatcctttattgcaaatgtatactattgatttttgtgtattaatcttgtaccctgcaaccttgctgaacttattttattttattgagatggagtctcagtcagtcacccaggctggagtgcagtggcttgatcttggcacactgcaacctccacctcctgggctctggtgattctcctgcctttgcctcctgagtagctgggactacaggcatgcgccaccacgcccggctaatttttgtatttttagtagagacggggtttcaccatattggacaggctggtctcaaacttctgacctcatgatctgcccgccttggcctcccaaagtgctgggattacaggtgtgagccaccgtgcccagccttgaacttgtttattagctctaatggtttttaagtgagttaagaatttctgtaatgtcatctgtgaatagagatggttttacttctttctttctgatctagattccaccttgttcctttttcttgcctaattgccctaataagtagaagtagtgtgaatgaacattcttgtcctgttcctgatcttaggggggaaacgcttgatctttcacaatggatgaagtatggtgttagttataggtttttcatagatgctttttgtcaagttgaggaagttcctttctcgtcttcatctgctgagtaattttatcgtaaaaggatgttaggttttgtcaaatgccttctgtgcattaggatgatcatgtgactttctattaacatggtatgctacactgattgatttttgtatgttgaactgcatttgtactcctgggataaatcctacctggtcaaggtgtatgatccttttaatatgctgctggatttgatttgctaatattttgctgaggatttttacatctatatttataaggatattgctttgtaactttattttcttgtaatgtctttttctgtctttggtatcagagtaattctggcctcatagtatgagttgaaaaatatttcttcctgttttatttttttggaagagtttgtgaaggctttgtgttagttcttcaagcttttggttgaattcaccagggaagccatctggtcctgggcttttctttgtggaatttttaaaaataattaatattttaatctctttatttgttacaggcctattaaaattttatctttcttcttaagtcagttttggtagattgtgtgtttctaaaattttcccatttcatctaggttgtctaaattgtccacatatagttattcatagtatttctaaacttttgaatttctctatgaccaatgtgatgtctccattttctttctttctggtttccatttcattttttcatttttgtttttgtttgttttttgagataaggttcttctatgtgcccaggctggagtgcagtggtgcaatcatagctcggtgtaaccttgaactcttggactcgagtgatcctcccacctcggccacccagttagctaagactacaggcttgcaccaccacaccaagctaatttttttaaaaaatatattttttagaaaaaagtctcattgtgttacccaggctgttatcaatctcctggcctcaagtgatccttctgcctctgctttccaaagtgctgggattgcaggtgtgagccattgcacccagcctccactttctttcttggtgaataatttgacccttatttttttcacttggctattctaagtaaaggtttgccaattttgttgatctttgcaaagatccaatttttggttttattgattttattgcttttctattttctatttcatttatctccattctaatctttattatttcctgttttctagtggtgttgggttgagtttgctcttatttttctagttccttaaggtgtaaagttaggttattgattcaagatcattcttctttaacttatgtgtttacagctataaattttgctcttagaactgcttctgctgcatcctataaatctgggcatgttgtgttttcatttttatttgttcaggatactttttgatgtcccttgtgatttcttctttaacccatttgttgtttaagagtgtgctgtttaatttctatgtgcttgtgagttttctagttttccttctgttcttgatttttaactttattccactgtgtccagagaacatactttgtgtgatttcaatcatcttaaatttgagacttaggaccaaatatatgctctatactggagaatattccatgtgctctttagaagaatgcttattctgctcctgtcgggtggaacgttctgttcatgtctagtgtatgcgattggttaatcgtgcttttcaaattccctatttccttgatggtcttctgtagtttttctattactgaaagtggggtattgaagtcaccaactattattactcacaatgtaaccatatttaaccctttacttttaaaattctttttggaaactggaaggatctgtaaccaccacccactcccacatcagaccctatgcatatgccaactgtctgctgctcagcagctgtgatggttgttccagttctttattaggcaaagaacagttgtttttttgtttttttgtttttttttttttaacatttcctttaaggaaggtggctcagattgctaagccagccaggccctgcgggacaggctgcgcctagggtcacctgctcttcttcagcaactcagaaatattctccttgaccattgaatccaatgttgaaaagtcccagtcggccaactgcattagtcgatcatgggcctccctaaagaggccagagccaatattcagctccacctgcatacgccactcagctagcttggagctgttgaggaagacattatagttggctgccatgggctgtagatagacgaagacaaagacgtggtcagcctggggaccagccccacctgggtcctctcccacagcctcaggcccacgtccctaacatctacctatgcaaagaattaggctgctgacccccaaggcctgagcaaggggtcacagactatgtaatagatgtaggtggggatggaggatccagaatccctcagagtcctcagtcactggtcttcttgctccaagccttctgaaccatgctgagagggctcctggcccaggcacttcccacttctccagcctgcgacctcgcatgaatcctgccttcttccagggaaaccccttatcccaggtgtgtatatgtggatgagggagagaactcaggttttttcctccatgtttagcctcccactgtgatcaagctcaggggctaggatgggagacctggcgggcagtctaccctgcagtttcgctggcttactaagagtttggtttgcacccaagatctttgggaagcccaagaatgggtgtgtgtgggtgaaatgtaaggggtggggacgaagcatatggctgaacccttggggcaggccagaatgatttttcctggtgctggtctgccctgcaaacagaccaaggagactaattttcatatcagccagagatctctgggataaggaaaagaatactgcattttctggtcaatccaccaggaccccaggtccctcctctcgggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttcctcccctgttatctttgggatcagcaactggccagggttgggaagaggagggaagaggaggctgcactccagggccacctgccctgccaggtctctgtactcttgtctgctggatagatattgaacacttcccaggatataaagcagtttcacctcttttagcagttctgattggtggaagttgctgggaaccatgtgttcacaaggatttggggagctcagcaggcataagtcctgtgattgattagtgatgtctgtcacaggcatagaattcaaagtagagacacatgtactggttatttgtcatcttctaattttctataggccatactcttttttgtttttgttttttgagatggagtctcactctgtcgcccaggctggagtgcagtggcacaatcttggctcactgccaactccaactcctgggttcaagcaattgtcctgcctcagcgtcctgagtagctgggattacaggtgcccatcaccacacccagctaataattttgtatttttagtagagatggtgtttcacaatgttggcaaggtaggtcttgaactcctgacctcaagtgatctgcccgcctcggcctcccaaagtactgggattacagttgtgagccaccgtacccggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcaggtctggcgggcaccagtgcgatggtgcgctgtacttgcggcacaggtagtaaaggatggccgcgctgcagaaggggccggtcaggggcactgcccttgccttcctgagtgccactacgtcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacgtagggtagcccctggaggtgcagggaggttatggacttaatgcttaagattaggcattatataagccagggcatgaaaggatccatctctctggtgctggatggagggtgagcccgagggggcagaatggacaatgaggtggcgggccagcaactatcgggaaggttgtggtgtctggggatggtggaggccatggggacagagggaaggggacggaggggagacatgcttcggaggggatgtcctaggccttgctgattgatggctggtgtgggaacctccgcagcacaagggctcctttatcatcaccaacagcaaccatgccaaggtaaaaaggtcagggcatggagagagctatcggttaaaaagtggcaggagagacagcaactggctgcaagactcagaacttctttggatcctgatccaaacaaactgccaagaaaatatttaggagataatcagagagttttgaacaggagccacgtattagatgaaatccaggaattactgttaattttatgaggtatcttaatggtatcgtagtgatgctacgctctatcctagcccaggctggagtgcagtggcacaatcagagttcactgcagtcgtgaactcctggcctcaagcgatcctcccgtgtcagcctctcaaagtgctgggattacaggcatgagccaccgcgcccagcctgttgctttttttttttttttttttttttttttaaagaacgcttatctctaagaggtatgttcctgaacgtttattgatttatttacttacttatttttatttttgagatggggtctcactctgttgcccaggctgaagctcaatctttgctcactgcaacctctgcctcccgggctccagcaatccctccacctcagcctcctgagtagctgggactacaggtgcggaccaccatgctggctaacttttgtattttttgtagagatgggggttttgccatgttgtctaggctaggctggtcttgaacacgtgagctcaggccatcccctcacttcagcctctcaaagtgctagaattacaggcatgagctggcccctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgctcgcactgaacctcccaggaggagcagagacagatggtgcaagggccccagggaagacttacctttcacttaagataaatttcccatctttgaggctgggaagcttcctgagggggttgatgtcaatgtattctttgctgtggtggtgacctgggaggagcagggaaggtctgaggctgtgggactccaggggagagagaactgagactcccagagacacaaacgcctccctctctattttctcaagaagagaggactgaggcccggagggacatggcggctcaccccaggtcacagggcaaggcagttgcagaaccggactgggatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagttttggagtccctctgtgctcgggatggagttggagcccacccctctgaccctcactcgggagcagtggagccctgagcctttctgaacactggggaggatgggtgtagacggactgtgcacttctgccccctttgccaacctggtgggcaggtgctgagttcacaaggtcctagaatcccacaacgaagccagggtgcctggtgggagcccagggagtcccagctgctgttcattcccccttctcctcaaaaagcctgttcatctgtggcgtggggactatcattagtggggagtggctaaggtaggctaggcagggacgcagcctacaagccccgtggcatcttttccttccctgtggacctctggggtgattcccttgtctctgtccctgcttctcagaaatgcccctatcaatctgagcgtggtggctcacgcctgtaatcccagcactttggaggctgaggcggggcagatcacttttggtcaggggttcgagaccagcctggccaacatggtgaaactccatctcgactaaaaatacaaaaaatgagccgggcatggtggcgtttgcctataaacccagcaactcgggaggctgagctgggagaatcacttgaacccagtggagattgcagtgagccaagatagcaccactgcactccagcctgggtgacaaagtgaggctctaccaaaaagaaaaagaaaaaaaaagctccaatctgtgtgtcctgcctccccccaggaccaggcctgccaggcagcagtgggagctgacctttcagcagatccacaaactgaaagttgaactggatgtcatgcttcttcgagaagatgtagacggcacggcagggtgctgacagcaggtccatgtagagctccagggccatgttgagacacatgccaggccccacagctgcagctggccagccacagacctgggcctatgtctggccagagtccctggccctgtgccctctccgatctgggcccaggaccctgcattctggaacctcttgtttccctttgtgttgtcataaggccaggaagcctgcaattctcacagcatcaaggattctaaggaggcccaggagtaggctggcagaggcccgtggcaaaggtgtggcagccgtgaccctactctccccctctcacgtgtgtctgtgtcccgtggcgccacctcacagacaccctgtctgagaagggattatgcctgggaattcccagggccggactttgattgcagaacctgacgaaaggggctttgcagggtccagaatgaggaggaggcaatgagaattatccctggaggattctagaagtagaggctgggagcatccacaggtgaatggagcctgaactatgactagaaaggaattgggagaaagagacacaggaacctgggagcttcgggagcagtggggacaccaccaccaggaagtcagggggcactcggcaatgaaagtggcagatgcaataaaacttttaacatattgttgtataatgtacaataatgtaataaaaatacaccccctatacattattgttccaactctagctctatctattgccctcctcatatgaatccctctccccataccccattctctagttaatcttaactaggcctcctgtttatattagccacatcaagcctagctgtctactctatcctgtgatcaggatgagcatctaatttgaaatatgcactcatcggtgcactatgtacagtggcccaaacagtctcatatgaagtcactctagctattatcctcctatcagtcctattaataagtggttcatttaatttgtatatactcattggaacagaagaatttctctggctgctcctaccatcatgacctctggccataatatgacttatttccacactagcagaaaccagccgagcctctttagacctaacagagggggaatcagaattaatctcgggctttaacgtcgaatatgctgcaggcccatttgccctgttctttatagcagactatataaatatcattataataaatgccctgaaggccgcaagaggttcgtgggtgcagtgcacaggagaccatatctggggacagcagctgcagcagaccccaagctgggccatccctgccacttgccaggtggtgcttggcgaaggcaagcagctcccacccgcccggggaatacagcgcgacccccggcggcatgctcttcagcaccaccccaggaggtaccaggatcatctaccactggaaattcctgatggagtgttgaaacttacccgtgaccaaaacactcccaagggatctgcccaccattcccggggtcaccagccctgccagtgatgatccccccaacggaagccagccagagccacctgagcaatagtccagaagataagcagggcgggcagtgaagaagcacagttttgagatggacatttaaagcaccagccatcgcatggagcactgccaagggacccctcaggcccttcctggaggagtcccaccagccaggccttatgaaagtgatcatactaggcaggcattggtgtggggccagtcaccccagccctctctccctcactcgcggcacctgccccctcctctttgtgaacaccagcaggtacctccttgtgcctccgctgatgcaggagcagctgccccaaggggagtaacccctgccagcacaccctgcagctgagggccaggaagtggacaagaatgaaccctttcttccaaatgatcagctcttccagcccctgctgggggccccacgaccccttccttaggttgacgtgcctgggaaagctcacctccccctcttccctaagagaggaaataaaagccaccttcgccctagggcaaaaaataaataaataataaatcccgtaatcactattgtcttcctaggagcactgcataacatatatataccagaactctataccacaaatttcgtcacccaaactctcattttaacaagtctttttttatgaattcgaacatcatattcctgattccattatgatcagctcatatatctccttgaaaaaattttctaccactcacactagtactttcatatgacatatcttcatgccagtcctaacctccagcatcccaccccaaacataagaaatatgtctcacaaaagagttactttgatagaataaattacagaggtttaaacccttttgtttctagaattacaggaattgaacctacccatgagaatccaaaattctccgtgctacataatacaccacatcctatcacaccccacagtaaggacagctaagtaagctattgggcccataccctgaaaatgttggttatacccttcctatactaattaatcctccagtgtatgccatgcagaggagcccagaaacttcctggcctgggttggggctgcagtggccagactgtgcacctggtggcccaggaaggtaactagagccccacgtagaggactgagtgccactcactctatgctttgtgatttaataggtctaggctcagaaatgggactgatcccacttccagtgacagagtaagcctggagacaagcgaagagcatgcagtgtgtttattgcagacagcagggtgcagtgcagtgggctgtacccactcagtggagccactcctgcagcaactgcacctgcttctgggccagctgggggtcctgccgagcctcactgtggttcagaggctggagtatgagcttgtgggcctccaggaagagctcagtaccaagggcagccttcatatgggcctgtcacactgccagccagggccagtcttggaagaggtcgcagccaacggcagtgggctgggaagacagggcagctggggttggggctcagccccatgcccagagtccccccgagggcaggtgggtaggaaagcttcacctgcatcacctccgtcagcaccaagtcttccagggagatctgctccattgccaggaagggcctggccaccaggacccccccatccaggtgctgcagggctggcgtcagcctccccaacagccgctccagctgtgcagcatctgcaggctgtctggagaagtggggcaggagagactgggctgtgaggagaggagcaacttaacccagactcttggaagcctcttgggcctcctctccatcccttcccggctgccattcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtaccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatctgggtgacctacgtcctttccccatctgggcagctccagctggcttagactctagccaggttccagcctccagctttagcccaaaggtgcccctgggtccagcctctgcatcggagctacacaggctgaaatgaggaaggggccacagtgatttggaaagatctccaacccaaggaaagatctcccctctcgcctctgcctccccctacaactctgagccccagaacccaggcagatcctggctctgaccctgggtgggcaccaggtcaccattacctctctgctagtaggaagtcgccatctctgagggcaggcaccttccccagggggttcaccttcaggaactcaggcttcaggtgctcccctggtgggcagaaaggagagaaggctcagtgcagggcctggtccttggcacccactccatggggcccagcccagccacctggctcaccccaagccaactccactgtctgcagctgaaaagggatgtcattctgcctggcaaaagtggatagcatggcagggggctgagtgcatgtccaggaacagcttgggccccattgctgctcctcccacctgccctccccagaggtctgtacctccaggagttgctcagcccttctcggccagtgccttcccccaaaatggggccagaactctgtactcctcctgaagcctattccctccatgactggctgggaggcctgccaagcccctctccccttttctccacctctgtagagtggaggcaggggtggccagtgtccctttgggggtttcagatagaaactcaatgacaattggcttagcaaaaacaaacaaacaaaaaaaaaacaacaaaaaaaaaacaaagggagtggggtgggtggggagatttctcagaaaacttctccagtcataggaggggaggggtgtagaagccactaagagaactggaatcagaacctgtttctgtctccccacttttcctcccctctcctcctctcccctccttcccctcctgtcccctcccctcctctcccctcccctcccttccctttccttccttcccttcctcctttcctcccttctttctttgagacaggatctctgtctccctacacttttttcttttaattctctgtctctttcttgacatagaatcttgctctgtcacccagcctggagttcagtggcacgatcatggcttactgcaatctccaagtcctgtgctccagcagtcattccactacagcctctggagtacctaggactacaggtgcacatgaccataccccactagttaaaaaaaacaaaaacaaaaacaaaaaaacccttgggcctggcagggcggctcgtgcctacaatcccagccctttgggaggccaagatgggctgatcacatgagcccaggacatcaagacgagcctgggcaacgtgccgaaacccagtctctacaaaaaatacaaaaattagctgggcatggtggcgcatgcctgtagtcccagctactcaagagactgaggtggcaggatcacttgagcccaggaggcagaggttgcagtgagccaagatcacgccactgcgctccagcctaggcaacagagccagactctgtctcaaaaaaaaaaaaaagagagagagacagatagggtctcactatgttgtccaagctgatcacaaactcctggcctaaagtgatccttgggtctcagcctcccgagctgattagctgggattgcaggtgtgggctaccacgccctgttatcactccctttctctgagtcagcttttctctctcagactagcctactccatgaactcaggaaatgtcactacaggtggccccagctcccatttacctccccatagggagctcctctctccagttccaatttcaaaactcccaaggaagcattctggttcactcgcttgggccactggccagagggatgggatactctgaaagattcagctagagtcccgggcccagccctggaccatcactgtgcaccctggttagatgccagggctgggattcagggagaagaaaggaggttcccggacagtcattcctgcctcctgcggctgcgggctccctgcacagtcattcctgcctcctgcggctgcgggctccctgcccccatcctgtgcacgaagtgggagctcccgctgtctggcagcagctgctctgcaggggacagtctggacggcagaaagttcatccttaaccccagccttccagtcaaggttcccacaagtctgggacacctgcaagtgtcatatcccgctgggtgaaagtctgagatcccttttagaggatcccattcgctccctcccttctgccaccttccagctccgagaaacagagctctgaacgaaccctcagatgtccatgcgctggggcctttccaggacggcggggcgcagtcctttctgggttggggtgacacctggaaacatgtaaggtccctggcacagggacccctcccagtttcaagcgattctcctgcctcagtctcccgagtagctgggattacaggcgcccaccactgcacccagctaattttttgtgtttttagtagagatggggtttcaccgtgttagccaggatggtcgcgatctcctgacctcgtgactagcccgcctcagcctcccaaagtgctgggattacaggcgtgagccaccatgcagggccaatttttgtattttcagtagagacagggttttaccatattggacaggttggtctcgaactcctgacctcaggtgatctgcctgcattggcctcccaaagtgctgggattacaggcgtgagccaccaagcctggtggtaatttataaggggtggacatttgttggctcatggtcctgaaggctggaaagtccaagatcgaggggccagcatctggccagagctttcttgctgtatcatcccctggtgaaaggataaagagagggtaagagagagcaagaggctgaactcacagcctcaaagtccttttataatccacatcaatccatctgtaacggtggaggcctcatgagataaacacctctcattaggccccacctcccaacactgttgcattggggattacatttccaacacatgctttgtgggggacccattcaaaccacagcacagggacaccttctctttccttcctgtgatatgctgaataatgacccctaaggatatacaagtcctgatctctggaacctgtgaatattaccttctgtggcaaaagggactttgcagaattgattaagaatgttgagatggaggcattgtcttggattatctgagtgagccctaaatgcagtcacaagtatctgtgtaagaggagacagacggagatttgaaacagaagacaggagaagatggaagcagagagatttgaagatgctacattgtgggctttgaagatggaagaaggggctacatgacccaagacaggcagctccaaaagctggaaaaattgaggaaaccaattcccctctcagagcctctggagggtgtgcaaccctattggcacctgggttttggcccagagaaatagattataaagttctggtctccataactgtaagagaatagatttatgttgttttaagccaccaaggtggtggtaatttgttataccatccagaggagaggaacacagattttggtgccaggaagcagggtgctgctataaaaaagaaaatctaggctgggcacagtggctcatgtctgtaatttcaacattttcggatgccaaggtgggtggattacttgagccctggagtttgagactagcctgggcaacatggcaaaaccccgtctctactaaaaatatataaattagctggggatgggccgggagcagtggctcacgcctataatcccagcactttgggtggcaaaggcaggcggatcacgaggtcagaaggttgagaccatcctggcgaacatggtgaaacccagtctctactaaaaatacaaaaaattaaccaggcgtggtggcgggtgcctgttgtcccagctactcaggaggctgaggtagcagaatggcatgaacccaggaggcggagcttgcagagagccaagatcgtgccactgcactccagcctggggaacaaagcgcgactccgtctcaaaaaaaaaaaaaattagttggggatggtagtgcatgcttgtagtcccagctactggggagaccgaggtgggaggattgcttgaggctgggaagtctaggctgcagtgacctgtgactgtgacactgcactccagcctgggcaacagagtcagaccctgtctcaaacaaacaaacaaacaaaaatctaaaaatgtggaagtagctttaaatttgggtgatgtgcagaggccagaaaaattatgaggcccatgatagagaaaacctagattgccttgcacagattgttggtagaaatatggatgttaaagactatagggagggctcacgagtatcaactaaacatggtcagagcaagtctacattgccttacagcatacctaagtcatcataggcagctgtaggtagatatatagatattggctgggtgcagtggctcacgcctgtaatgccagcactttgggaggctgaggtgggtggatcacctgaggtcaggagttcaaaccagcctggccaacatagtgaaaccccgtctctactaaaaatacaaaaattagctaggcgtggtggcatcccagctactagggaggcggaagcaggagaattgctcgaacctgggagacggaggttgcagtgagccaagattgcgccactatactccatcctgggcgaccaagcgagaatctgcctcaaaaaaagaaaaaatagatattaaaaatcctgctgctgaggactctgaagaaatgaggaacgtgtttctggaaactggaggaaggaggatcatttcccagaaaaggagcccgtagggaggtagaaagcttagttgaattgtgtccgatagttatatggtgggtgaacttaaagcaacgaagttggatatttagctgaggagacttccaagcaaagcgttgaaggtgaagcctcatttcttcttgctgtttatggtgaaaagcaagaggaaagtgataaaatgaggaaaaagctgttaagcaaaaagaaaccaaggtttgatgatttgggaaattatcagcctgtgcagattgcaaaagatgctaaaattagaagattcgctgtttggaaaacacaactctatccctgtcctggggatcactcaagacttgtatccatagacaaccagatttctatgggcttgaactctgtgtgtgtgtgtgtgtgtgtgtgtgtgtgtgtgtgtgtgtgtgtgtgtgtgtgtgtagcaaggttgggggagcacagtggaaagaccttgaatttatttgtttattttttagacggagtcttgctctgtcgcccaggctggagtgcaatggcacgatctcagctcactgcaacctccacctccagggtggttcgagcgattctcctgcctcagcctcccgagtagctgggactacaggcgtataccactatgcccagctaatttttgtattgttagtagagatggggtttcaccatgttggtcaggctggcctcaaattcctgacctcaggtgatcaggctggtctcaaactcctgacatcaggagatccaccagcctcggccttccaaggtgctgggattacaggcatgagccaccatgcccagccttattatttatttatttatttttgagacaaagtctccctctgtcacccagactggagtgcagtggcgcaatctctgctcactgcaacctctgtctcccaggttcaagtgattctcccagctcaacctctcaagtagctgggactacaggtgcgcaccaccatgacctgctaatttttgtatttttatttatttatgtattattttattttatttttccataagttattggggtatgggtggtatttggttacatgagtaagttcttttgtagcaatttgtgagattttggtgcacctgtcaccccagcagtatacactgcaccatatttgtagtcttttatccctcaccctcctcccactcttcccctcaagtccccaaagtccattcttatgcctttgcgtcctcatagcttagctcccacatatcagtgaaaacataagatgtttggttttccattcctcagttacttcacttagaataatagtctccaaactcatccaggtcactgcaaatgctgttaattaattccttttcatgactgagtagtattccacatatacatattccatatatattcattccatatatatattccatatatgctcattccatatacatattccatatatgctcattccatatacatattccatatatactcattccatatacgtattccatacgtatgtactccatatacgtattccatacgtatgtactccatatacgtattccatgtatgtattccatacgtatgtattccatgtatgtattccatgtatattttccatatgtatatattccatgtatatattccatatgtatatattccatatatattccttatgtatatattctgtatgtatatactccatgtatatattccgtatatctatattccatatatgtattccgtatgtatatattccatatgtactccatatgtattccatatgttccatatatattccatatattccatataaattccatatattccatatatatcccatatacattccatatattccacatatattccatatacattccatatattccacatatattccgtatattccatatagattccatacatttattccatatatattccatatagattccatatatattcagatatattccatatttatattccatatatggaatatatatgtattccatatatatgtattccgtatatgtatgtattccacatatatattccatatatgtatgtattccacatatatattccatatacgtatattccagatatatactccatatgtatatcccagatatatatattccagatgtatatattccacatatatattccagatgtatatattccatgtgtgtatattccatatatgtatattccatgtgtgtatattccatgtgtattccatatatatattccatgtgtgtattccatatatatagtccatgtgtgtattccctatatatattccctatatatatattccctatatatattccccatgtacattccatatatatattccccatgtacattccatatatattccccatatatattccatatatattccccatatatattccatatatatattccccatatatattccatatatatattccccatatatattccatatatatattccccatatatattccatatatatattccctatatatatattccctatatatattccctatatattccatatatatatatatatatatatatatatatacaccctatatatatattccctatatattccatatatatatggagtctcgctctgttgcccaggctggagtgcagtggcgcgatctctgctcattgcaagctccacctcccaggttcacgccattctcctgcctcagcctcctgagtagctgggactacaggtgccagccaccatgcccagctaattttgttttcgtatttgtagtagagacggggtttcaccatgttagataggatggtctcgatctcccgacctcgtgatccgcccacctcggcctcccaaagtgctaggattacaggcttgagcctccgcgcccggcctctgaattctttttcaggtaaatcagggatttcttcttggtttggatccgttgctggtgaactagtgtgatatttgggggtgttgacgacccttgttttgtcatgttaccacagttggttttctggttccttctcattggggtaggctctgtcagagggaaggtatagggctgaaggttgttgttaagattttttttgtcccagggctattcccttgatgtagtctctcccccttttcctgtggatgtggcttcctgtgagccaaactgcagtgattgttgtttctcttctgggtctagctgcccagtgagtctagtcagctccaggctggtactgggggttgtctgcacagagtcctgtgatgtgaaccgtctatgggtctctcagccatggataccagcacctattctggtggaggcggcggacggtgcagtgcactccgtgagctttggtggtttaatgctctatttttgtgctggttggcctcctgccaggaggtggctctctccagaaagcatcaactgtagtagtgtggagaggggccagtggtgggtggggccctaggactcccaagattatgcgtcctttgtctaccactactagggtgggtaggaaaggaccctcaggtgaggacggtgctaggcatgtctgagatcagactcttcttgggcaggtgttgctgtagctgctgtggaggatgggggtgagatgcccaggtcattggagttgtgtgcctaggagaattatggctgcctctgctgagtcatgcaggttgtcagggaagtgggggaaagccggaagtcacaggcctcatccagctcccatgcaaactgaaggggcggtctcactcccaccatgtcctgcaaacagccctccatctggaaacagcaaacagtgtgtttccagatggagggccagacgaattgaaaacttgcctgaggctttccacctcccagctgccaaagaaaagggctttagttcttcctccgcctgtgaaatctgcaagccagattcacaccctcccctgggttctggcccagaggcttctcaccccattcaaattgttacaaagttcagctagagaattccttctccctgtggagctgtggagttttaccccttgctttctggccaccctcctgatggatccctgtggtgccaggcaggaatgggctgcttggggatccagtgagctcccagggcctttctgctgcttcctctgaccctgtattttgctcggctgagttttgtaacttgactcagctccaggaaaagtcggaaacttcttccacaaacaggccttcagcttctccagtgggggtgtgtgctcaggagaagcgggtctccctttcccacttccacagctggggcactcacagtatttggggtgtctcctgggccctacaggagcaagtctgcttccttcagagggtctgtggatcctctcaggattgctggtttgttctttcagtggatctgcagctaaaattcacaatgcaagcctccacatgctgctctgtccggagctgcaatctggctatgcctcccgtctgccatgatcccgaaatccctctccaatttttatatttttagtagagttggggttttgccatgttggccaggctggtattgaacttctgacctcaagttatctgcccatctcggcctcccaaagtgttggtgtaccaggacaagctgcagacaaaacctctgagacaccaagttaaagaaggaagggctttattcggccgggaacttcagcaagactcacgtctccaacaaccgagctccctgagtgagcaattcttgtcccttttaagggcttacaattctaaggggtctgtgtgagagggtcatgatcaattgagcaagcagggggtacacgactgggggctgcatgcaccagtaattagaatggaacagaacaggacagggattttcacaatgcttttccatacaatgtctggagtctatagataacataactggttaggtcaggggtggatctttaaccaagcccaaggtgcagcgccgggctgtctgcctgtggatttcatttctgccttttagtttttacctctttctttggaagcagaaattgggcataagacaatatgaggggtggtctcctaccttattggggttacaggcatgagccaccgtgcccagccaagaccctgaatttaaatcctgactctgtcattcattagctcctgacctcaagtatgccattaactactttgaatcctggtatccttgctgtcaaaggagatgagagttctgacacttataggtccactgtaagacataatttttaaaatatctgtaaaaactgggccgggcatggtggctcatacctgtaatcccaatactttgggaggtcaaggaaggcagattgcttgagcccaggagtttgagaccagcctgggcaacatgatgaaaccccgtctttaccaaaaattcaaaaaaatttagctaggcattggcacgtgtctgttagtcccatctgctcgggaggctgaagtgggaggatcactggagcccaggaggcagaggttgcagtgagccgagattgtgccactgcactccagcctggcagagtgagaccctgtctctacaaaaatgtaaaataaacttaaaaaatgtcaaagcatgataaagtacaggacataaagaccatgattaatctaacacccatcactacaatctttgcctctgttctggcattcccctatgtgtcttcgcatcaccctccttctgggtgactcctttatgttgtatttttttgtttggtttggtttttttggttagtttgttctgagacagagtcttgctctgttgctcaggctggagtgtagtggtgtgatcttggctcactgctacctctgcctcccaagtttgtacctcagcctcccgagtagttgggattacaggcatgcgccaccatgccctgctaatttttgtatttttagtagagacggggttttgccatgttggccaggctggtctcagactcctggctcaagtgacctgcccacctcagcctcctaaagtgttgggactacaggcatgagccaccacgcccggccaccccactcattttgaatgtaagtagattaccaattctgaaatgggttttgagcagtagcaacattgacacaaatttataatattttcaagaagatacttccttcaatatgtaaaatgcaacagatatcatttgcaatcatacatatgtacatatatacatacacacatataatatatatatctcaccatggaataagtctgagctgaaacatgcattacttaaaaaagaaaacacttacagacaggatcttgctccgtcatccaggctgaagtacagtggcacgattgtggctcactgcagcctcgacctcctgggctcaagtgatcctcccacctcagcctcccaagtagctgggactacaggcatgagctacctcgcctggcctgcatgatctttatgaagaatgtcatagaaagtttttgaaagcgattaaagttcacctaaacaagcagggatctatgctgtatgccatgctattattggggaggaaaaaaattctcctctacattcttagggtctctggagatctggaactaagaataaaactgaaataagacagattaacagaagaaaatcattcaagttttgctaaattttcagtgtacatgggtactttcacaagagaatgaaggcctaaagaagtcactaaagtagaaaaacaataccttttttttttttttttttaagacaaggacgggtgcggtggctcatgcctataatcccagcactttgggaggccaaggcgggcagatcacaaggtcaggagattgagaccatcctggccaacatggtgaaaccccatctctactaaaaatacaaaaaaattagccaggtgcggtggcgggcacctgtagtcccagctactcaggaggctgaggcaggagaatggcatgaatcctggaggcggagcttgcagtgagcggagatcgcaccactgcactccagcctgggtgacagagcaagactctgcctcaaaaaaaaaaaatgacaagacaaagcggcttggattatagggagtaaattgtggagaagggactaggacatacatgcggagcaaaattagaagataaggattatttttagtcgtgtgtttatacagatccattggaaccttgattcacagtcacttgtgatgacaatgttcttctcttcctggtaaagggagggtgctttcttatgggaaattgtgtggcctattcttagatagaaaagggcaggtcagagagtctttcctgcatgtgctatttctcaagtgccttcaactcaaaataattaatactccaaagcagcatatttggggtgacgtgtttttaattccttcatttcccctgctgcagactttcctagaagtttcagatattaaaagctgagttggtggctatggagataagagccagattcataacgagggatctacaaatggggagaagaacatagataagaataggaatgaataagctgaaaggaacaggtctgagcacatttccccttatcctgttaaacacacatcccattgctgggacaaggtcagtacagcagaaggaatgcacctcttttgtttgatggagagtgtttagcttgttctttaacaggtgcagcttaggcactatttgtcccagtggatttacacagaccagccttatccaccaatgatcacacaaactcctccttttgaggctgtcagtgtgtccagggtgcaacaattttggaatacagcagaagctaagctattaacttcttttgttgtggttgctgttgttgttttgagacagaatctcactttgttgagtgcaggctggagtgcagtggtgcgatcatggcttgctgcatccccagcctcctgggctcaagtgatcctcccacctcagcccccagagtagctggaactactactatgccctactaatttttaaactttttgtagagacagtctcactatgctgcccaggctggcctcgaacttctgggctcaagtgatcctccctcctcagactttcaaagtgctgggattagaggcctcagccaccatgcccagattgctttgacatcttgaggccttactgatccaggagagactgcccctccctgggccagctaattcctacagagaataaatgatttgcttatggtgtgccttcgatgggccaatcaaccgattcgtatctccaacataactttaccagccacctttcagcaggttcctgccccaaatcactccagggacaggtaccaggtaacaaaggaccactcctataacccagagcccatcacaattattaaaactagccagtcctaagtctgtttaccctgtcttgccttcttgcaaaaaacacagtaaagccttttgtccaccttttgccctcactcattctgccacctgactgaccctggtgcttccccatggccctgcatggtgtggcatgtcccccctattgtcttgggaactgtgagtaacaaactttcttttacatggctatcacctctgatctgtggcctcgccatacctgaataaagccaaaatcccaggtacattttaaaacaagtctacaagtcaaggaataccaaggatttccagcaacaccagagaggccggcccacgcccggcctgactcttactgttaatcactagttttgcatttctcttgaggaactagtcaggaggagaaaacctagacagcagctctcctggtcaagacccagtcattcagaagcctaaatggcatgcctaggtgcttggctttaaactgttagcaggtatggagtgctctgattgtgttttagaataatattctgggctgggcacggtggctcacgcctgtaatcccagcactttgggaggcggaggcaggcggatcacgaggtcaggagattgagaccatcctggctaagatggtgaaaccccgtctctactaaaaatagaaaaaattagccgggcgtggtggtgggcgcctgtcgtcccagctactcgggaggctgaggcaggagaatggcgtaaacccaggagtcggagcttgcagtgagccgagattgcgccactcattccagcctgggcaacagagcgagactccatctcaaaaaaaaaaaaaaaaaaaaaaagaataatattctggctgctgctggaaggcagccagggaggaagcaaggacattggatactgcagtaatcctggccaaaggcgacttgtgaaaaggggtgggcaactgaaggggcaggagaatgtggcccctctcagtctggagagagctgcagcactaggccaggaaggcactcttctgcggggggataggtcttaaatggggaccatgggattgggtgcagtggctcatgcctgtaatctcaacacttcaggagtctgaggcaggaagaccacttgagcccaggagttggagaccagcctgggcaacatagtgagaccctgtctcaaaaaaaaaaaaaaagacaatttaaaaactagccagatgtgatgcctgtggtcccagctacttgggaggctgaggtgagatgatcacttgatcacttgagccctggaggtcaaggctacactgagccatgatcatcccactgcactccagcctgcgcaacaaagtgagactcttatctcaaaaaaggcgacaggtgggaaccatggggaaccagagaagcaaagctattctcaagttttccagtaaccatcctcttgccaatggtctttctctgaatcttggatttgggaataggattttcctgccttgggaggctcccttgggaaatgggagtgtcacagccacaggcatcaaaagccctagagttgcacttgaatagtgggtagaaagttctgtgcaatgccaggcactgttggaaacctctgggtagggcttacagggccttagccatctgtgggaggcattagctggagtgtaataaatatgaccctcaggactggggagaaacagctcattccttcatgaggtgtggggctggcagccttgcaggcagccagccacccttcccctctggcctccatcctgggcactgagccaggcactgggtaagaaggctgctgcacctcctttctcctcttcccttttagagagaaagatacccccagccgaggatcccagaaaggcgagagcagacgcgccattgattggcccaaagttctccggagccaacctttgagcaaggagggcgtggctgggctccagtctcctagtgaggtgcaccactgcaggcttggtgacccagccgttcctgcccgctgcccccaaccagccgttcctgcccacagttcctgttcccgggcctgtccccgggtttgtccccagggcccgtcccctgggtttaggtctaccctccctcgccccaccccatcgccctcgccatgggtctggagctgtacctggacctgctgtcccagccctgccgttcagtctacatcttcaccaagaacggcatccccttcgagcttcgcaaagtggagctgaccaaagctgggctgggcaggcaggcccaggggatattggctgcggatccccacctgtccccactgctttgcagtcgggccgagaatgcagactaacatgaagaatcagactctctggtgtggaaactattacgtaattatctatgttattatttttactttttggagacaggagctaactctgtcactcaggctggagtgcagtggcacaatcatggctcactgcagcctcgaccttccaggctcaagcgatcctcccatctcagcccctcaagtagctgggactacagatgcccaccgatatgcccggccaatttattattattattattattattattactattgagaggaggtcttcctgtgttgcccaggcaggtctcaaactcctgagctcaggcgatcctctttccttggcctcccaaagtgctgggattacaggcatcagctgtcatgccctgctggttgtttattttaaaagaggcttcatctttgcttagtgaatacaaagcattcttcaaaatacaggttaagagggggcagagcagatgcagcaggagggcagggaaatggagtggggctagaatatcttcaccccatgtgcttggaaaaaacaatgaaactacctccttgtttcctaagtggagtagtccttgtttacctctgcctgggtctcttcccttcttgcctcttctttttttgacacggtctcactctgcagcccaggtagagggcagtggcatgatcccggctcactgcagccttgacctctcaggctcaagtgatcctcccacttcctcctctcaagtagagtagttgggaccacaggcacgcaaccacatccagcaatttcttttttttcctttttttttttttttttggtatttgtggagacgggattttgccatgtagaccaggctgaccttgaactccagagctcaagtgatcctcctgcctcctccttctaaagtgttgagattacagacatgcactaccatgtctggccctgggtctcttccacttttatgtatttcttggcattcttctgccttttcttttcctgcatctgacttgctctatcccatggggcttctcacccagctgaaggggctgctcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagaaggaggaacctgctcagctgactcttcccaactgctgcccttggtacaaccagcttgagtcacctgctacagaacaggggctggacacagaagcagtctgtggagggagaatgggcaggggtgtgcatgtccattcagtagaaggccagagaggcccacatgtaggcctatgatcagactggagcctggcttgactgatgccctctgatccaaacaccaggcacctaatgcggcctctagcactggcctagagtgctaaagtgagtcagacctgggaacccccagtggggagggagccttgagagtttggcacaagaaaggaagaagagctgagccaccgggggctgagtggctgaatggggcagggattcccagcaagaatgaggttggtctgagggttgggaacatgtttggctgggactctggggtattgacaggtcacccagcctggccagtagggcctaaggccccagctgggataggaagctgaatcagagggggcaagcctagagcccagggaggaggctggaggggtctgacctatggatggaactggctgggggtggggtgtgaattacagctccagggaattgtccttgagccatgcttcaaggaactggacacaggaaaggtggccctctgatagggtcagggtctgtgacccagtgactaacagagaggcttcctcttccctgatgcctcccagataggggcctcagaaagctgctgctgggagtttggagtgggggtgggcagagacatcagagaactcagggttctccccactcacctctctgatctcgcctgcaggccagcagcacagtgatgcctttgcccaggtgaatgccctgaggaaggtgccaggccttgaaggatggggacttcaccttggctgagaggtaaccggtccctgggctgctgccgggccttgtggggccagtcagtcagctgtctgtttactgctgatggcttggatcatggactgtgggccctgcaccagccccagggtgaagaatgggtggaggcaggcagaggtgcccagtgttgacaagggctatagaagtcccctcctgcattgtacaagtgaggaaactgaggctggaggaggggagggacttgcacaaggccacagggcccagtctgcttccgggcctcctcaccgccagtcttcccctccgaaaaaaagagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctacgtccttctcctcatggagctcacattccattaatagaagggggagctgacagtaacccatgtaaacatggaacatatcggatgttgatggatgccatggaaaaaataaacagggtaagagtgggggtgtgtgtcattatgagtaggatgttgagggaagactccctggaggaggtggcatctgagcagagagctgtaggaatgtgcaaggcatgaggggaagggtgttctcactggagggaagagtgagggcgaaggctccaggtgggacaatgcatggggttcagactggagagcaacgggccagggtgggtgcagtgagcaggaagagcaggaggtcatgacagaggggagcatgggacactgggaaggctttggctcttaccacaggtagattgagtcgctggagggttttgagcagaggagaactgtgatctgacttacgtcataaaggatccccctggcaggggtgagaaagccactgcagtcatctggcatgcagcgctggagccccagaccaaggtggtggtggtgcagggttggtggggattgtggtcagttctgacttttattgaaatctaactgcagggtttgctgaagggttggaggtgggtgggaaaaatgaaagccaaaaccagcctctaggttggtggctgcatggtggcgtcctttaccgaggccaaatagtgcctccttggtggagctggattcacattcagagcctgggatcactggatggtccaacacccatagaggcatgatgagctctgggggtcagactgcacaacccttcaccataggtgaacaggagatgggacagggtggggagcaatgctgccatgtcacctggaaggctctctccctgctggccttgctcctggccctgtccacgctttggatatgttggggagatatccaacatgctctcgttcttcagactcacagtggatgccccttcctcctggaagccttccctgagcccctgctgaagttcatgacattttgtttcttacttgctgcccttagttgagatgatagtctggccccgtgtagggctgtgtgaccctgggcacttacctaacctctctgagcctcacatccctcctctgcatcatggggatagtgaaaatgccccagaaaatggctgaagagtgttcagggcatgttttctgcccctgccatgtccccccagtgtggctagcttgctgtgtatgaactgcatgtacaaagcacctgaccactggtacccccaggacctgcaggcccgcgcccgtggggatgagtacctgtcatggcagcacatggccctgcagagtagctgctgctgggccatgtggcagaaggcgagccatggagggcagggacatctcccaagatgccaagggatgctgctttcactttacaaaatcctgtttagacctgagaccaaatcctggaatgccagagactgcctaattcacccaacttgtttcctaggagggaaaccaaggaccagagccaaggaaggattcccctaatatgccttaattccagagctatgagcagttaatcctatgctcttttgcatactccaggttgcctgggaatcttgcctttagggggagaaaataaacaaaccctcactttgctacacacataattcgtagatggagaagtatgaagtgaaaaaagtcaaactaggaagaagtgaggagacatttcaataaacgtttgtctgatgtctcggtatgaaaggactttctaaccctcagaacagtgggagaactcaacaaagaaataaccactacatgccagctgcggtagcatctgtaatgagcacacctgtaatcccagcactttgggaggccgaggcaggcagatcacctgagattgggagtttgagaccagcgtgaccaacatggagaaaccccgtctctaccaaaaatgcaaaattagccgggtatggtggcgcatgcctgtaatcccagctactcgggaggctgagtcaggagaattgcttgaatctgggaggcagagattgcagtcagctgagatcacgccattgaactccagccttggcaacaagagcaaaactctgtctcaaaaaacaaacaaacaaaaaaacatatacaaggacatgttgtgtaagaaaaaatggattaaacataaaacaagcaaaaaaccgggaaggatcttgataaaagatatgtcagaaggaggtaatgttctttaagatgctcttagaaacccttaagagaggcctggtatggtggctcacccctgtaatcccagcattttgggaggccaaggtgggcagatcacttgaggtcaggagtttgagaccaccctgggcaacatgatgaaaccccatctatattaaaaatacaaaaattagttgggtgcggtggcacactcaggagactgagacaggagaatcacttgaacctgggaggcggaggttgcagtgagctgacatcataccactgcactcaagctccacttagagcgagactgtctcaaaagcaaacaaagaaaaataagagaaacccatcagacaagagacaggaaaaaaatgagtcatagctcactgcattctagatctcctgggctcaagcgatcctcctgcctccgcccaggtagctagaactacaggtgcacaccacaacactgggattctttttttttttctttttttttgtagaaaacaacgaagggaatcttgctatgttgcctagcctggtcttgaactcctgggctcaagcaatcctcccttcttggcctcccaaagagctgagattacaggtgtcagccactttgcgtgaccacaatttcaatcatatttaaaatgtacaattcaagtgattttgccacactaaccacagactcatgtttaagccacaccaacggatttccatgttttaaataacatattttgccaccccctagtggacagtggctcaccaccggcacaaggggctacataggcagtcaatgggaaccaggcggggacgggaaatgtcgtgaacccaacggtccctgcccagccccacccgcgtccgcaacgtgtaaccacatctcctgactgcccaagagaagcgcagatttccatactgaacatgaaattgcctgacttcgaaatggtggcaaatcattaaaaaaaattttaaactcactttgcattggttattagggtcgaacttggggaagacccctacaggtgtgtgtgtgtctgtatgttaggggtgttcagacctttaatagggctagaaaccaggcaaccacaccgcggaaagcttgaggagagggaaatccaccagacgccaagcaggagggtcagggaagagacagggtggggccactaccgggttaaagacttgtagtgggtggggctacacgtagggccgagacgaccggatttccggaaatcagagccggcacacgtgacttttgtttgcagaagtgggaaggtaccctaggcagccaatcggggagcgctgagtctctgtccagccaatgagaagccaggttgttttagcgcctcgcccctcctctccggtccgcgagccttgggtatctccagcttttttccgccagagctgtttccgttcctctgcccgccatgccgttcctagagctgcacacgaatttccccgccaaccgagtgcccgcggggctggagaaacggctgtgcgccgtcgctgcctccatcttgggcaaacctgcagacgtgagcgtgggccgggcagcactgggcgaggggaagttggtgggccaggggtccggccttgtccctgctctgcctccgcaacagcgaccccgatccctttccccagggaccaccccccaccccattccgcaggccaagctctgactttccgtgcttcacgatcccgcggctccccctccgcacgtctttcccttgtcgccctccccagtcatgacccggacgtgaccttcagggacctcggcctgtactgggatccctgtccccgcgaacactgcgcgtttcggctttcgcgcgctcgggtcgggaccccagacgtagcccgactggctccagcttcgggtaaaacttttcatgttcccctcagcttgtgaacgtgacggtacggccgggcctggccagggcgctgagcgggtccaccgagccctgcgcgcagctgtccatctcctccatcggcgtagtgggcaccgccgaggacaaccgcagccacagtgcccacttctttgagtttctcaccaaggagctagccctgggccaggaccggtgcgcaggggtagtaggcccggaatattattctaaaacacaatcagagtactccattcctgctaacagtttaaagccaaacacctaggcaggccatttaggcttctgaatgactgggtcttgaccaggagagctgctgtctaggttttctcttcctgaccagttcctcaagagaaatgcaaaactagtgattaacagtaagagtcaggcagggcgcggtggctcacgcctgtaatcccagcactttgggaggccgaggcgggcggattatgaggtcaggagatcgagaccatcctgactaacacggtgaaactccgtctctactaaaaatacaaaaaactagccggacgtggtgggcgcctgtagtccccgctactcgggaggctgaggcaggagaatggcgtgaacccgggaggcggagcttgcagtgagccgaaattgcgctactgcacaccagccggggcgacaaagcgagactgtctcaaaaaaataccaaaaaacaagcaaaagaaaacaaaacaaaaacagtaagagtcgtcccaacgcagtggcttatgcctgtaattccagcactttgggaggccgaggcaggcagatcacctgtggttgggagttcgagaccagcctgaccaacatggagaaaccctgtctctactacaaatacaaaattagctgggcgtggtggtgcatgcctgtaatcccagctactcagaaggctgaggcaggagaatcactttaacccgggaggcggaggttgtggtgagctgagattttgccactgaactccagcctgggcaaaaagagcaaaactccttctcaaaaaaacaaacaaacaaacaaaaaaaaaaaacacacacacacacaatccaaaaaccagtaagggtcatgtcctgggaggctaactcagccgactgttaggtcaccatgcttatagccaagaaatgtgggatgctgctgggccctgagcggtcagataaactactttctctgataattagaaggctacaggaaatgttttgttttgttttgttttgggtttctttgtgtgtttttagagacaggatcttgttctgttgccccaggctggagtgctatggctcaatcagagctcactgcagcctcgaactcctgggctcaagcaatcctcccacctcagcctcccaagtagctagaactacaggtatgcatcaccacgcctgactaattaaaaaaaaaatttcttttggttgcgtgtggtgtcttggcacccgtaatcccagcactttgggaggtagaggtgggagcatctcttgagcacaggagtgcagggctagcctgggcaacatggcaagaccctgtctctacaaaaataaaaaagaaatgagctgggcgtggtggggtgcacctgttgtcccagcttcttaggaggctgaggtgggaatattgcttgagcctgggatgtcaaggctgcagtgagccatgactgtgccactgcactccaggctgggcaacagagtgagaccccatctctgaaaaaatatttttttggggagccaggcacagtggctcatggtaatcccagcactttcagaggtggaggtgcacagatcatttgaggtacagagtttgacaccagcctggacaacacggtgaaaccctgtttctactaaaaacacaaaaattagccaggtgtgatagtgcgtgcctataatcccagcttctggggagactgaggcaagagaatcgcttgaacctgggaggtggaggttgcagtgagctgtgatcatgccattgcactccagcctgggcaacagagcaagacactatctcaaaaaaaaaaaaaaaaaagtttgttttgaaatcctggactcaagcaatccccccaacctggacctcccaaagtactaggattataagtatgagctaccacactcagccactttttttttttttgagatggagtctcgctcggttgcccaggctggagtgcagtggcgcgatctcggctcattgcaaggtccgcctcctgggttcatgccattctcctgcctcagcctcccgagtagctgggactacaggcacccaccaccacgcccggctaattttttgtatttttagtagagacggggtttcaccgtgttagccaggatggtctcgatctcctgacctcgtgatccccctgccccggcctcccaaagtgctgggattacaagcgtgagccaccgcacgcggcctcagccacatttattaatttcactcttggcaaacatcagggggaagctgacccacacggcctgggaagggggttgtcttttgcatagagaccatgaccaggtctgggacagaggaaagtcaaataaatcacacattagagttagaagcagaggctcaggctgagcccaggtttattatccaaaatcaaaatgaaatgcagtgattaaaggacacaaggcctcagtgtgcatcattctcattgtggctttcaggcggctgtggaagacagggtggggatggtggcttcgggaggtgaggtgctctgggacttgggcaagtcttaggcaagccattcctgctttctgggcctggctcccatgggccattagaaatgaaaatgctttgtggactgctgaggacggtgcaagggtgaggtttcccagctcaccggatcatggccagcacccagggcatcagcttctgctttatggtggggtctgcaggtgggaagtccttggccttcagaatgacctcatgggcctcctggaagaggtcctcccccactgctgcctccacgcgctgccgccatgtggccagcttgggtcggccttcgaagacttggcagccagcacccacgggctgtggggaaaagggtacagactggggatggatggttgtgagggcagggatgggcagcatctgatttggggaccacagatctccaggaggtgtttgcacacacacttaagcacagtgccatagcccggtgtggcagcataagcaggacttcagcaactagccagggccccctgcctagtgggttcacctgcccacagcactcacatgcatcagctccgtgatggctacgaggtcagctaaggagatgtgaggaccagtaaggaaggccttgttctggaggaacttgtcctcgagcaactgcagggtcacatccaactctgccagggtggctgccagtgtctggggagatactggctcacccaggaaaacagggaacatcacctggggattgggcaggcaaagtcgggagttactggagtagggagttagttttgatttgcatttccctaatgattagtgatgctgagcatcttttcttttttttttttttttgagactgagtcttgctctctcgcccaggctggagtgcagtggggtgatctcggctcactgcaagctccgcctcctgggttcacgccattctcctgcctcagcctcccgagtagctgggactacaggtgcccgccaccacgcccagctaattttttttttatttttagtagagacagggtttcactgtgttagccaggatggtctcaatctcctgaccttgtgatctgcctgcctccgcctcccaaagtgctgggattacaggcgtgagccaccgcgcccggccaagcatcttttcttgtacttgttggccaaaatgataatattctcaacacattgggttaagtaaaatatatcaatttccttttactttttttttttcttttgagacagtgttcagctctgtcacccaggctggagtgaagtggcaccatctcggcacactgccaactttgccccctgggttcaagcaattctcctgcctcagcatcctgagtagctgggattataggcacaggccaccaagcctggctaatttttgtggttttagtagagacaaggtttccccatgttgaccaggctggtctcgaactcctgacctcaggtgatccactgccttggcctcccaaagtgctaggattattggcatgagccactgtgcctggactctttttactttttaaatgtgcctactagaaaatttaaaattacgtatgtggctcactttatacttctatcggacagcacttgactaaatgaactaaattccagagaggcataagccgttcctagatgagctactttcattccaatttcatttccttgggcccaagcaggctgggagaaagactgtcacaggcatgggcttttctgactgagcagcagtttgggaactgggggcagggatgaaaagcagagagatcttacaggcaacatcgtagttggtgattagattccaaagccatgctagactgagctagtgacctgatctcacattcaagatatttgaaaccaaagataaactgaaaccaactaaacctgcaacccagcccacctcctgattagcttagaagagaacagcctcacatcctggctacctgacacagggaagtgcaagccctttcttgggggtgtttattatgcaattcaatctctgctcttcttttatcataatgtctggcacacaaggatacatcatgaggccgggcatggtggctcatgcctacaatcccagcactttgggaggccgagatgggaggatcacctgaggtcaggagttcaagaccagcctggccaacatggtgaaaccctgtctctacaaaaatacaaaaattagccaggcatgatggcaggtgcctgtaattctagctacttgggaggctgaggtgggagaatcgcttgaacccaggaggcggaggttgcagtgagccaagatcgtgccattgcacgccagcctgggcaatggagtgagagtccgtctcaaaaaaataaaaaataatgataatacatcatgagacatgcaaagaagcaggcaaatgtgacccataatcaagagggagaaaacaacaatcaatagaaatagacccgtaggctgggtatggtggctcatgcctgtaatcccaacactttgggaagccaaggaggacgaatcacttcaggtggagagttcgaaaccagcctggccaacatggtgaaacccggtctccactacaaataacaaaagttagccaggtgtgctggtgggtgcctgtaatcccagctacgcaggaggctgaggcaggagaatcgcttgagcctgggaggtggaggttgcagtgagctgagatcgcaccattgcactcagcctgggtgacagagtgagaccccatctcaaaaacaaaacaaaacaaaaaaaccagacccacagaacacctacgtgttgaaattagttgacaaagatttttaggtaacagtgataaatatgttaaagaatttacaagaaaagacagataaaatggatgaacagatggtgaatttcatcagagaagtggaaattctaaaaaacaaccaaatggaatttccagagctgaaaaatacatatctcaaacaaagaatgtattggatgggcttaatagcaatttggcacaacagaggaaagaatctgtgaaggcaaagacaggtcagtagaaataatccaaaactgaaaagaagagactggtgcctgaacacctttggggaatgctctcgctgccgccccccacattcccagcctcaccttatgccacaaggcccggaggcagcttctccgcagagtcgtgtgctgccatgccaggtactcatccacacgggcacgggcctgcaggtcctgagggtaccagtagtcagggaccttatatttgcgcgtcaggtagagcaggatggccacactgtgggtgtgggggtcatgatgggtaagggaagggcactgtgctgggtatttcatacatagtcgcttttttttttttttgatacggagtctcgctctgtcgctcaggctggagtgcagtggtgcgatcttggctcactgcaacctccacctcccgggttcaagtgattctcctgcctcagcctcccaagtagctggaactacaggtgcgtgccaccatgcctggctaattttttgtagttttagtagagatggggtttcaccatattagccaggatggtctcgaactcctgaccttgtgatctgcctgcctcggcctcccaaagtgctgtgattacacgtataagcaaccgcacctggccttttttttttttttttttttttttttttttggagacaaggtcttcctcagtcacccaggctggagtgcagtggtgcagtctcagctcactgcagcttcaatttttataggagtgcaccaccatgcctggctaccttttttcttttttgtagagatgggatctcactgtattgccaggctggtcttaaactcctatcctcaagcaatcctccagccttggcatcccaaagcgctggcattataggcatgaaccactgtgcccagcacacttctttaacctttctgacaatttgccaaagtattagcctcattttccagagaagaaaaccaggcttagaaaggcagagacttgccctagggcacacagctcttaatggcagagctgagaatctttctgaggctaatacccaagcttttcctaccaccaggcaaaatcccacaacagaatgtcttgccaaatgtttagagacagtttctgatcagagaaccagagagagcttccaggagaacggggcatcaaagctgagctttaaagaagctcagttctttccattcggtatccactctcatctgctgggattccgaccagcctctgatggcctgactgttcaaaaaggcttccgtgtccctttgttctttctgtcattctttctgccaagaatcagctcctatctaagctgactggggtagtttggcttcctaaagtaccactcaggaagcactcctgcagctgcaggatcctagaacaacagaacagacaaggccccctggcactctcctccttccctgggttttgagggccgccatggtgatgagatgagcatggacctggaaggacacaggatgtgtccatttggagacacagaaaagctttcaggaacttggggtttcccaaaggttgggcatgcaggccaaaagggcagaaaacctctgtatctgccacgggcctatattctcttttaagctggggctacacacgtgtcccagcttaacgactccgttgtctgtgcagggtgcccaggagctccttttgctcccagccaattgttcaagccacctctgaggagggctgcaggtctctgtgagccacagacctgaaggtgagagtagtgacagaggcagagattgcacattgactctggctggtacctgggggtcacaacgctgagtgacacaaggactcaggacacctggggcaccagggaggaagacgggccctggcagaatgtcagaggaattcatcggaggtgcgtccatcctgagatttcagagatgagctttaaagcacaaactccaggttcttgttaggggaagggtgactctggtgacaaaaggggcagaactggggaaagattggcttttcctgaagaggattcaacttcttgggaccagctgtgatgtaagacgtccatatctggtggctcttccatggggaagacccatcctgggaagctgcagcccagagatggagccaccgggcagcccagatgccactgagccatcgccacacaagcttggccagaggcctgccccacggtgggcaaagctgccatcgtcctctggcctaccctgtctcaaggatactctcaccactcaccagcaaccaaagcactggtgtggaagtaaagtagatatttgcttttctaatcatcagggtgaactggaatagcaggaaggcaagggcctggggtccagtactgactctctgcaggatgcggggcacagagactctctgcctctgaagactttagtttccttgtctatgaaatagagggttagaacaggatggttccagcaggcctggcagcagtcctagggtcccagttacctctccgtcaaggtgaagtccccgtccttcaaggctggcaccttcttgagggggttcacctgggcaaaggcatcgcttaagtgctgacctgggaagagtccagcatggtgggtggtgggaggagaacgctgagcccgccatggcctgtgcccctccctgcaatgctctggccccagtttcacagttcttcttcccaccagtctgcactcctggttggcaaagactggaagggcccctgcgggaggaggaggagaccactccaccggctggtacaaaatagacaacaccccttgctaagtcctgtaggcacagcctcctcccacaggctgcccctctgcaacagagctcactgtgcagggtgtggttcctggacctttgcatgcaccctacccatctcctctttccactattgccagcttcatgaactcacaatcagagcaccccaagctgcacgataggtcacctgaggggactgactaccttgtcccttccaccattaattctaaggcagggtcatgaaacacagagaagtggtctttttctggtatctacctacttagaagcaacttctactggccccaccatgtccctttgttcaccctgccctgggcactgtggagctgtgtgtagcatacctgctaccaccccctgtgccccaaacttttattccccttacagttggggtctcactatgttgcccaggctggtcttgaactactggcctcaagtaatcttcctacttcggcctcccaaagtgctgggattacaggtgtgagccaccatgcccagcctgctaccctctcttcaccctcccttcagactgttccttcaccaggaaaaccctcctctgtctcctgggaaaacacacttccctctgcaccactacatttgacaaccagcttggacgtcctcttgtcccccattccctttcctctactccacactctgcagaggaagtccttgcgcaggacagtgggcagtttgcagaagagattatgtggagaagtttcaggcagagggccagccatggagtgggagccctgggcagaaggcttagccaagtagagtcgccttacttgccccaccagccatacctggattctgcttccaacccctcctactaccccaccctgcactgggcctgggcctgggcctgccagctgagtcctcaagggccttggaggcatgctagagaaacaaaacagggtgtagggctcatcaagccccagggtccccctgctgcttccagcatcagcagcctggggcaacctacctccccagcaggaacaagaggcagaggacaaggtttcgggcggcagaggttgcagtgagctgtgatcctgccactgcactccagcctgggcgacagagcgagactccgtctcaaaaacaaacaaacaaataaacaaaatgccttgggccaggcacagtggctcatgcctgtaatcccagcactttgggaggctaagccggcagatcatttgatgtcaggagttcgagaacagcctgaccaaaattgtgaaatcccatctctgttaaaaatacaaaaaaattagccagacatagtggcacacatttgtaatctagctactcaggaggctgaagcaggagaattgcttgaacccgggaggtggtggttgcagtgattcgagatccgtgccactgcactgcaacaaagcaaaagcaagactctgtctcaaaaaaaaaaggacaaggacaaggtcagaggcaaaacaggaggaacagaggaaggaagggacaaagagggaccccaatgcagactggacgagtgcagagggcagggatggaaagtcacgtcctgagctgtttgctgttgcagaatctcagcagctgggccataaagaagggacttgacgctgtcccagtctctacacttggcacccttgacctctctcatcccacctttccctaggccgaggtcacacctgctttcattttgtttttttttgttttttttttttaagacggggtctcgctagattgccctgacgggagtgcagtggctattcaagggcaccatgatagtgcactgcggcctggaattcctgggctcaagcgatcctcccaccccagcctctcgagttgctgggactacaggcgtgtgcccctgcacccagctgcgcccgtttttgtcctcctgtctggcttctcttcatgatccccacccctttattcggcctcaggggaaccccgtggtctattccgtgagaccgagcagagttttggggagccccgactcttggatctccctgctggctcacctttctctgttcggtctccaaaccagaccagcaatggccccaggaagaaggtggcgctgggagaagttccctaagctatgtatgcctacctgtccccttcctgacttttcggttccccaaacccgaggctggacctacctttaatcagatccacgatgcgcagctcgaagggaatgtcgttcttcttggcaaagatgtaaacagcgcggcagggctgggacagcaggtccaggtacagctccaggcccatagtggggaccgaccgacctgaccggaaaccagagggagtcagcaaactccagtgccaggactcgggtctcggacctcagaccacgcccctgcggctacgcaccccgaccgctgtgccccattgggcggcacggacgcctgggacactctttagtccaattgcgggcggcgggcggcctgtctcagggctgggcccgcctggctcctgtgggatcagggtgggtggccaagagaccgttgtctctcagggggacgcacagagaggccccagtcccatccctttcgtgcctggctcgctcatttcacttagcataatgtcttcaaggtgcatctgtgttgaagcgtgtgtcagaatttcccaccgtccgcattttagaggaggagacagacactgaatgattatagacccagaaagtctggctccaaagtccatcctcttggctcaacactgcagagtccttggtgccagcaagtggcaaagcctcagggcttacgttcagtgttttgtggtcactcgcttcactgcagtcgcactccctggaatgtcacagccttggtcttcctgcccctgccagcacagtgccatctatcgcattccctgggtttatttcttcctttctccaggcctgtgtttctccatctttaaaatgacagggaagctagagccctccagagtccttgcaagtccacccccctggattcatctgctgagccgtaagcccaggcctgccccttgctgccatggagcctgtcaaatagtatcagggtcacatgtcattttctaaaacgaatcccactgaaagtgtgtcagccaacgcataatgttttctagagaataaggaacatttctgcaaataaagtggaagtaacaactgttttattttatttagatagagtctcactctcttgcccagggtagaatgcagtggcatgatcacagctcactacagactccaactcctgggctcaagccatcctcccatctcagcctccccaagtagctgggactacaggtgcgcacaaagacgcccagctagttaaaaaaaatttttttctgtagaggcagggtctcactatgttgcctaggctgatcctcccacctctgccacctgctgggattacagatgtgagccactacaactggccagtaataatgatttttaactggaaaaaaaattaaggaaagatgagaaattcagatttccatgttaaagttttgaaaggaggtagacactcagagaaggcaatggctgccttatcctcacctctggataactccagtcagaggcccaaggaggagctgtcaggattctggttcaaggctcagcctgtcttttaagttcaaaacctaatttggggcgggagtggtggctcattcctataaccccagcaccttgggaggctgaggccggcggatcacctgagttcaggagtttgagaccagcctggccaacttggtgaaaccccatctctgctaaaaatataaaaattatctgggcgtggtggcatgcacctgtaattccagctactcaggaggctgaggcaggagaatcgttgaactctagaggcagaggttgccgtgtgccaagactgcgccattgcactccaggctgggcgacaagagagtaactccaactaaaaaacaaaacaactaatttggtccacgtttcaggattgatcattttctttgggtctgactcacataaaccaactcacaaaggctgtatttattaatttatagaaacaagataaaagtgagagtgtgtgggttggttcgtttgtttgttttttgactttgcccctctctgtcactcaggctgaagtgcagtggtgcaatctctgctcactgcaacctctgcctcctgggttcaagcgattctcgtgcctcagccacccgggtagctgggatttcaggcatgtgccaccatgctcagctaattgtatttttagtagagacagggtttcaccatgttggccaggctggtcttgaactcctggcctcaagtgacctgccagcctcggcctctcaaagtgctgggattacaggcgtgagccaccgtgcccggcctagaaagaagagaaaagtcatttagacagaatgctcccaaccattgctcagtgctctcttggcagtgtagtctcctaggaagcctcgtgggtgttactggccaggaccaggtccgttctgcccatgcacagtaaattaatcactgtgacatgagttttgcaaaagactaaagatttattcacaagggtgccaagcaaggaggtaggataatagctctcaaatccacctccccgaaaataaggcttagggataagccttgcttccaagcaataaagcacagaccccagtcacactcaaggggagggggctatacaaggatgtgaataccagtctgcctgcctcgtgggcctacaacgcagaagggccatgcacttggtttaaaactttgttgttgctgtcttgacattcttaacaatttaaaaataagggtccccacattttcatgtgtagccagtcctgtccaaggagtccaaagaggtcatgagggtggacaggtcactgtctcctctgggcagtgatggggccactagcagttgttctgtagtctcctagcccctaccccagggccacaccttccccatggtctctcacattcttttttttttttttttttttttttttgagacagggtcctgctgttgcccaggctggagtgagtgcagtgctgcaaactcagcttactatagcctcgacctcctgggctcaaacaatccttctgcctcaccctcctgtgtagttcggatcacaggcacatgccaccatgcttggctaattttttgactttgtagagagggcatcacactttgtttcccagggtggtcttgaattcctgggctcaagtgatcctcccacctcagcctcccaaagtgctaggattataaagatgtgatccgccgccccggcctctctcacattcttggcatttaaagttaccgtcattgacaaggaacatgggtacactccaatttactcaagaaaaaaactcttttctccattgaagagatatgtggcctggctgcttcctactctagttgaggtcttctttttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagcagcagccttgcctgggagcttgttagaaatatactaacaggctcccacccccaaacccagacctactgaatcagacagagtctgtattttcataagatcctcagatgatccaaatgcgccttaaactttgaggagctttgatccagaacctgggctggaggcccctgggggccactctgttcctcacagactgcaaggtatgtttttttcttgcctcttctctctgtcctaatgtctccttctctctgtgtctgaccctgaggaccctatgacatcttcccaggggagtttccactgtcaaagagctgattctctctctcttttttttttttttgagacggagtttcgctcttgttgcccaggctggagggcaatggcgtgatctcggcttaccgcgacctctgcctcccaggttgaagcgattctcctgcctcagcctcccgagtagctgggattacaggcatgcatcaccacgcccagctaattttttgtagttttagtagagacagggtttctccatgttggtcaggctggtctcgaactcctgaactcaggtgatctgcccacctcagcctcccaaaggcatgagccaccatgccctactgccagaggcctgattctctagaatctgatgggctcttctagacagcaatctctacctgggctcttgttgaagaagccaatcagctcattggttggaggtcacatgatataaaacatggccatcttccaagccctatgtgtggacaacgagatagggacaagtaggcatatcacgttctgatacctggacccacatctgtcgctgggcccacgtctgtcctcaggcccccaggatatacttttatggggagttttcctcccttcccccaatgtggtcactcataactttacacccaacagtcaaacaggagtggaagctacagagtttcacgcaaacaataggctaggctgtgggactgagtaaaaggcactggactgtggtaggtcttactccaagatggccaaatggaagggcttttagctttctttgtttttgttttatatcctgagacaaaatgttcaatttctacactttagaataaaaagagccatattttatgtttcatattttttgtatgcttcctttcatactcttttgaacaatgcaatcatattttcattatgaggtataattcacataccataatatccgctctttcaaaatatactttaaaattcaattggtttaaagccaattcattggtttttagtatattaacaaagttttgtcaccatcacaattatctaattctagatcattttcatcacccctaaaagaaactctgtacccattaaacagtcactccccatttccctcttctcctagcccctggtaaccattcatctactttctacctctgtggacagtaagtatctgcctattctggacatttcattcaaatttaataatgaaatatgtgagcttttatgactggcttctttcatttaacataatggtgtcaaggttcattcatggtgtagcatataacagtacttcatcccttcctgtggctgaattatattccattttatgtatacaccacattctgtttatccattcaccagttgatggacttttgcattgattctacttttcagctattgtgaatccccatgctgtgatgaacattcacgtacaagtttttgtctggacatatgtcttcagttgtcttgggtatacacctaggaatggaattgctggataatataattctatgttggccgggcacggtggcacatgcctgtaatcccagcactttggaaggctgaggtgggtggatcacctgaggtcaggagttcgagaccagcctggccaacatggcgaaaccccgtctctactaaaaatacaaaaactagctgggcatggtggtgcctgcctgtaattccagcctgtaattccagttactcaggaggctgaggcaggagaattgcttgaaaccaggagacggaggttgcagtgagccgagatggcaccactgcactctagcgtgggtgacagagcaagaatctgtctccaaaaaaaaaaaaaacaaaaaaaacaaaacaaaactaacccatatatatataatatgttatatatacataataatatattttatatatatgtgtatatatgtttaacttttggaggaactgcaagctgttttccaaagcggttatacattttacattctcagcagcagcacacaagggtttcaatttcttcacacatcctcaacaatacttttaatctgtcttttctgttatacccctcatagagtgtgtgaagtgatatctcattgtggtttgattggcaatgtcttgattatagtatctttgtactaagttttgaaattgggaagcatgagtcctacagctttttctttttcaaaattattttgaagattctgagtcactttaatttccaaatgaattttagggccaatttgtcagtttgtgcaaacaggccaagtggaattttaatgcagactgtgttgaatttgacatcttaacattactacaccttccaatcatgaacatgggatgtctttccatttattaaggtcttctttaagttttcccccaacttttaaattatgaaaacatttaaaatccagaaaatgaaaggactagtacaacagcactaatatatgcaaccccagtttcaacttactgttttttgaacataagataccaacatcatgacaccccacctaaggactttttagcaaaacattctaatttctctactgggattattgtttgttgtcttcctccacaataatgtgagcactaaaggtagagacttttgcgtactttgttcactactgcttcctctgcaccaaaaacactgcctggttgtgggtacttttctagttttaggaaggagaagacaagatataggtcctgactctggttctgcctctcattcatatgctactccgaggatcccttccccttgaagaacttgtttcttcatctacgaaatggggataatactactactcatcagggtggttgtgaggattaaacaaggtaagagatgtaaaattgcatgttagttatcagatagttttgttttcccatctagctccatgagggagaggatttgctctagtccgtccgtctgggctctgggcttctaatgggcagacaccttcctccatgatgtttgtagctgcaaagcctggcacagtccctcaagacaagctttttgacttgaactgctgatggtcttccatgcacaattcaacagaaacccagtagcatacacttccttgtatgcacttgcccctctttttacatttattacacattcattgctacctaataatccccgatacttatcttttactttatccaattattcaacagttttcaacagaaatacctagaagagagctattccgacttcattagaccctgagattctatttttaacatttcttccatggattgttgaatgtttccaatgattgatccaccttcccttggccttatctgcattccagatttggttgtgtgtccatctctgtgttgccagacttacctcacagacccagcttgaacacaagatgggtgcttgctgaagagcaggactcattctgttgaacctgcatgctttctcaggtcagattgcttggtggtgcttctttaatttctttcaacagcacattgtagtttgctgtgtttaagtgttgcttttctttggttaaagttattctaagtattttattctttttgatgctattgtaaatgaaagtgttgttttaattttgtttttgatcctttactgcaaatgtatactattgatttttgtgtattaatcttgtatcctgcaaccttgctgaacttgcttatgagctctaatggtttttaagtgagttccttaggagttcctataatgtcatctgtgactaaagatagttttacttctttctttccgatctggattccaccttgttcctttttcttgcctaattgccctaataaatagaagtagtatgaatgaacattcttgtcctgctcttgatcttgaggggaaacactcaatctttcacaaggaatgaagtatggtgtttataggtttttcatagatgctctttgtcaggctgaggaagttcctttctagtcttcatctgttgagtaattttatcataaaaggatgttagattttgtcaaatgccttctctgcattaggatgatcatgtgactttctattaatatgaagtgctatatggattggtttttgtacattgaaccacatttgtactcctgggataaatcctacctggtcaatgtgtataatcctcttaatatgctgctgaatttgatttgctaatattttgctgaggatatttacatctatatttataaggatattgctttgtaactttattttcttataatgtgtttttctgtctttggtatcagggtaatgctggcctcatagaatgagttgaaaaatatttcttcctgttctattttttagaagagtttttgaagggttggtgtcaattcttcaagcttttggttgaattcaccagtgaagctatctggtcctggacttttctttgtagggatttcatttattgatttattgatttattttttgagacggagtctcgctctgtcacccaggctggagtgcagtggtgcgatctcggctcactgcaagctccgccttcctggttcacaccattctcctgcctcagcctcccgagtagctgggactacaggtgcccaccaccacgccccatctaatttttttgtatttttagtagagatggggtttcactgcattagccaggatggtcttgatctcctgacctcgtgatccgcccacctcagcctcccaaagtgctgggattacaggcatgagccaccgcgcccggctttttggtaggattttaaaaaaattaatattttaatatctttacttttacaggtctattcaaattttatcttccttcttaagtccgttttggtagattgcatgtttctaaaattttctcatttcatcgaggttatctcatttgttcacatacaattattcatagtatttctttataaacctttgtacttctctaataccagtagtgatgtgtccattttctttctttctggtgtctggttttttggtttttgttttttttgtttttttttttgatataaggttttcctatgttacccagactagagtgcagtggtgcaatcacagctcaatgtaaccttgaattcctgggctaaagtgatcctcccaccttagccacccaatttgctaggactacaggcgcgcaccaacacactcagctaattttttctttcttttttttttttgagacgaaattttgctcttgtcacccagggtggagtgcagcagtgtgatcttggctcactgcaactctgcttcttgggttcaagcgattctcctgcctcagcctcccgagtagctgggattacaggcgcctgccaccatgcccagctagttttttatttttactagagatggtgtttcaccatgttggccaggctggtctgaaactcctgatatcaggtgatccgcccgtctcagcctcccaaagtgctgggattacaggcatgaaccactgggccttgcctcctagctaattaaaaaaaataaataactctttttgtagaaacaagtctcactatgttgcccaggctggtctcaatctcttggcctcaaatgatcctcctgcctcggcctcccaaagtcctgggattacaggtgtgagccattgcacccatcctccactttcttggtgaataatttgagtcttattttttcacttggccattctaactaaaggtttgccaagttttgttgatcttttcaaagatccaatttttggtttctttgattttctctattgtttttctgttttccatttcatttatctccattctaatctttattatttcctgtcttctattggtgttgggtttattttgctcttatttttctagttccttaaggtgtaaagttaggttattgattgaagattgttcttctttaacttaggtgtttacagctataaattttgctcttagcactgcttctgctgcatcctataaatttgggcatgttgtgttttcatttttattcattcaagatactttttaatttcccttgtggttttgtctttgacccattggttgtttaagagtgtgccgtttaatttctatgtgcttgtgagttttctagttttccttttgttcttgattttaaactttattccactgtgtccagagaacaccctttgtatgatttcaatcttcttaaatttgagacttaggaccaaatatatgctctatactggagaatattccatgtgctctttagaagaatgcttattctgctcctgtcgggtagaacgttctgttcatgtctagtgtgtgcaattggtttacagtgcttttcaagtcctctatttccttgatggtcttctgcagtttttctattactgaaagtgggggccaggtgtggtggctcacgccccgaatccctttggggattcagggtggctcagcactttgggaggctgaggcgggcgatttgcctgagctcaggagttcgagaccagcctgggcaatacaatgaaaccctgtctctactaaaatacagaaaaaaattagctgggcatggcggcatgtgcctgtaatcccagctactcaggaggctgaggcaggaggattgcttgaacctgggaggtggatgttgcagtgagctgagatcgcaccactgcactccagcctgagtgacagagtgagactccatctcaaaaaaaaaaaaaaaaaaaaaaaaaagtcaggtattgaagtcaccaactattattactgacaacgtaatcatatttaaccctttacttttaaaattctttttggaaactggaaggatctgtaaccaccacccacttccacatcagaccctatgcatacgccaactgtctgttgctcagcagctgtgatgttgttccagttctttattaggcaaagaacagttgtttttttagcatttcctttaaggaaggtggctcagatcattgagccagccaggccctgcaggatgggctgcgattagggtcacaagtacttctcccgaaactcacagattttcctcgtgaccattggatccaatgttgaaaagtcccagtcggccaactgcattagtcgatcatgggcctccctaaagaggccacagccaatattcagctccacccgcatacgccactcagctagcttggagctgttgaggaagacattatagttggctgccatgggctgtggatagacaaagacgaagatgtggtcagcctggggaccagccccacctgggtcctctcccacagcctctggcccacgtccctaacatctacctatggaaagaattaggctgctgacccccaaggcctgagcaaggggtcacagactatgtaatagatgtaggtggggatggaggatccagaatccctcagagtcctcagtcactggtcttcttgctccaagccttctgaaccacactgagagggctcctggcccaggcagctcccacttctccagcctgcgacctcgcatgaatcctgccttcttccagggaaaccccttatcccaggtgtgtatatgcggatgagggagagaactcaggttttttcctccatgtttagactcccactatgatcaagctcaggggctaagatgggagacctggcgggcagtctaccctgcagtttcgctggctcactaagacagtctaccctgtagttccgtttgcacccaagatctttgggaagccaaagaaggggtgggtcgttggtgaaatgtaaggggtggggacgaagtatatggctgaacccttggggcaggccagaatgatttttcctggtgctggtctgccctgcaaacagaccaaagagactaattttcgtatcaaccagagatctctgcaatagggaaaagaacactgtatttcctggtcaatccaccaggatcccaggtgcctcctcctggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttccttccctgttatctttgggatcagcaactggccagggttgggaagaggagggaagaggaggctgtactccagggccacctgccctgccaggtctctgtactcttgtctgctggatagatattgaacacttcccaggatataaagcagtttcacctcttttagcagttctgattggtggaaggtgccgggaaccatgcgttcacaaggatttggggagctcagcaggcataagtcctgtgattgattagtgatgccggtcacaggcatggaatttgaagtagagacacgtgtactggttatttgtcatcttccaattttcttttttcttctttttttttttttttttttttttttgagacggagtctcactctgttgcccatgctggagtgcagtggcgggatcttacctcactgcaacctccgcctgctgggttcaagaaattctcctgcctcagcctttggagtagcgtggattacaggcacatgccagcatgcctgggtaacttttatatttttagtagagatggggtttcaccctgttggccaggctgttattgaagtcctgaccttgtgatccgcccacctcggcctcccaaagtgctgggattacaggcatgagccactgtgcccggccatcttcaaattttctatgagccatttttttttttttttttgagatggaatctcactttgtcacccaggctggagtgcagtggcatgatctcggctcactgcaacatccacttccctggtttaagcgattctcctgcctcagcctcctgagcagctgggattacaggtgcccaccaccacaccagctaattttttttgtatttttagtacagacagtgtttcacaatgttggacaggtaggtcttgaactcctgacctcaagtgatccacctgcctcggcctcccaaagtattgggattacaggcgtgagcactgctcctggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcgggtctggcgggcaccagtgcgatggtgcgctgtacttgcggcacaggtagtaaaggatggccgcgctgcagaaggggccggtcaggggcactgcccttgccttcctgagtgccactacatcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacggagggtagcccctggaggtgcagggaggttatggacttaatgcttaagattaggcattatataagccagggcatgaaaggatccatctctctggtgctggatggagggtgagcccgagggggcagaatggacaatgagggggccagcaactatcgggaaggttgtggtgtctgggaatgttggaggccatggggacagagggaaggggatggaggggagacatgcttcggaggggatgtcctaggccttgctgattgatggctggtgtgggaacctccgcagcacaagggctcctttatcatcaccagcagcaaccatgccaaggtaaaaaggtcagggcatggagagagctatcggttaaaaagtggcaggagagacagcaactggctgcaagactcagaacttcttggctgggcacggtggctcacgcctgtaatcccagcactctgggaggccgaggcggggggatcatggggtcaggagatcgagaccatcctggttaacacagtgaaaccccgtctctactaaaaatacaaaaaaattagccaggcatggtggcgggcacctgtagtcccagctactcaggaggctgaggcaggagaatggcgtgaacccgggaggcggagcttgcagtgagccaagatagcgccactgcactccagcctgggcaacagagcgagactccgtctcaaaaaaaaaaaaaaaaaaaaacttctttggatcctgatccaaacaaactgccaagaaaatgtttaggagataatcatagagttttgaacaggagccacatattagatgaaatccaggaattattgttaattttatgaggtatcttaatggtatcgtagtgatgctacgctctatcctagcccaggctggagtgcagtggcgcaatcagagttcactgcagttctgaacttcctggcctcaagcgatcctcccgtgtcagcctctggaagtgctcggattataggcatgagccaccacacccagcctgttgctttttttttgtttgttttaagaactcttatctctgaaaagtatgttcctaaacatttattgatttatttacttatttatttttatttttgagatgggatctcactctgttgcccacgctgaagtgcaacgacgcagtcttggctcactgcatcctctgcctcctggctcaagcagtctttccgcctcagcctcccgagtagctgggactacaggtgcagaccaccatgctggctaatttttgtattttttgtagagatggggttttgccatgttgtctaggctaggctggtcttgaacacgtgagctcaggccatcccctcacttcagcctctcaaagtgctagaattacaggcatgagctggcttctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgcttgcactgaacctcccaggagaagcagagacagatggtgcaagggccccagggaagacttacctttcacttaagataaatttcccatctttgaggctgggcagcttcctgagggggttgatgtcaatgtatcctttgctgtggtggtgacctgggaggggcagggaaggtctgaggctgtgggactccaggggagagagaactgagactcccagagacccaaacgcctccctctctattttctcaagaagagggaactgaggcccggagggacattgcgtctcaccccaggtcacagggcaaggcagttgcagaaccggactgcgatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagcttttggagtccctctgtgctggggatggagttggagcccacccctctgaccctcactcagggttagtggagccctgagcctttctgaacactggggaggatgggtgtagacggactgtgcacttctgccccctttgccaacctggtgggcaggtgctgagttcacaaggtcctagaatcccacaaggaagccagggtgcctggtgggagcccagggagtcccagctactgttccttcccccttctcctcgaaaagcctgttcatctgtggcgtggggactgtcattagtgagcactgactaaggtaggctggacaaggatgcagcctacaagccgcgtggcatcttttccttccctgtggacctctggggtgattcccttgtctctgtctctgctcctcagaaacgcccctatcaggctgtgcgcggtggctcacgcctgtaatcccagcactctggaggctgaggtgggcagatcacttgaggtcaggagtttgagaccagcctggccaacatggtgaaacccctgttaaaaatacaaaaaattagctgggcgtggtggcatgcacctctaatcccagctactcgggaggctgaggcaggagacgcacttgaacccagcagaggttgcagtgagccgagatagcaccaccgtactccatgctgggcaacagagcgagactccatcaaaaaacaagaaaaaaagaaaagccgcaatctgtgtgtcctgcctccccccaggaccaggcctgccaggcagcagtgggagttgacctttcagcagatccacaaactgaaagttgaactggatgtcatgcttcttcgagaagatgtagacggcacggcagggtgctgacagcaggtccatgtagagctccagtgccatgttgagacacatgccaggccccacagccgcagttggccagccacagacctgggcctatgtctggccagagtccctggccctgtgccctctccgatctgggcccaggatcctgtgttccccagggaaacctcttgtttccctttgtgttgtcataaggccaggaagcctgcaattctcacagcatcaaggattctaaggaggcccaggagtaggctggggagaggcccgtggcaaaggtgtggcagccgtgaccctactctcccccttccacgtgtgcctgtgccccgtggtgccacctcacagacaccagtctgagaagggattatgcctgggaattcccacggctggattttcattgcagaacctgacgaaaggggctttgcagggtccagaatgaagaggaggcaatgagaattatccctggaggattctagaagtagaggctgggagtatccacaggtaaatcgagcctgaactatgactagaaaggaattgggagaaagagacacaggtgaatcgagcctgaactatgactagaaaggaactgggagaaagagacacaggaaactgtgagctttgggagcaatggggacaccaccaccaggaagtcagggggcactcagccggtgtgtgccacacagaggagcctagaaacttcctggccttggttggggctgcagtggccagactgtgtacctggtggccaaggaaggtaactagagccccacgtagaggactgagtgccactcactctatgctgtgatctaataggtctaggctgagaaatgggactgaccccacttctggtgacagagtaagcctggagacaagcgaagagcatgcagtgtgtttattgcagacagcagggtgcagtggagtgggctgcacccactgcacctgcttctgggccagctgggggtcccgccaagcctcactgtggttcagaggctggagtatgagcttgtgggcctccagcaagagctcagtaccaagggcagccgccacacgggcctgccacactgccagccggggcagtcttggaagaggtcgcagccaacggcagtgggctgggaagacagggcagctggggttggggctcagccccatgcccagagtccccccagagggcaggtgggtaggaaagcttcacctgcatcacctccgtcagcaccaagtcttccagggagatctgctccattgccaggaagggcctggccaccagcaccccccaatccaggtgctgcagggctggcatcagcctccccaacagccgctccagctgtgcagcatctgcaggctgtccggagaagtggggcaggagagactgggctgggaggagaggagcaacttaacccagactcttggaagcctcttgggcctcctctccatcccttcccggctgccactcattagtgatgtcctctggggctctgtgttcagaaggtttctaaggattcattcaggcttaggggaaggagtactgtgatagattagttatgtctgctgaggacagtggaagtgaagctaatatgtaatatgtaccaactggtgccttccatctctgggggtccaggcccctgccccagcctgcatgacagggcctaggaagctcaccttgcacaggtagacattggtggcaggcagctggatggtgacatgcttccacgccaagtactcatccacgcaggtgcgggcttgcagctcaggtgggtaccagtgtccccgtatctggtactttcgactcaggtataaaacgatgaccatgctgtgggcagggggtgtcagagatcttttctccagcctgtcagggccaggtggcttcattgctcatactcagggtgatttgaccaggttttctccccaccttcaccttcaggggaggacctcccctatactgcaactccctccaggcagtatctccccacgaccaaaccactctgtttctccatttccaactctgatcctccctgggcccatgtttccacctcccctcccagttaccataccatcctgccctctgtgcccaggccccactccctggcatcagggtccccactcagagtgcctgccgtgtgggccctgcccaaaaggtctccaagttcccttcctagtgccccagaacactaggtgcccattttctatcctcaggtaagccctgggaggtggatacattattcctcccactccgttttacagaggagaaacctggcacacaaagttctgtgatttccccaagggcatggattgaggaagtggtgagctgggattgaatgtggagtctcccctgggtctgcccagctcctaggactctgaaaggatgagctggggacatttggggaggagccagcctcaagcctgggccttgcccgctggcttcaggttgtccaggtttatccgggtgacctacgtcctttccccacctgggcagctccagctggctcagactctagccaggttccagcctccagctttagcccaaaggtgcccctgggtccagcctctgcatcggagctacacaggctgaaatgaggaaggggcctcagtgatttggaaagatctccaagccaaggaaagatctcccctctcgcctctgcctccccctacaactctgagccccagaacccaggcagatcctggctctgaccctgggtgggcaccaggtcaccattacctctttgctagtaggaagtcgccatctctgagggcaggcaccttccccagggggttcaccttcaggaactcaggcttcaggtgctcccttggtgggcagaaaggcgagaaggctcagtgtagggcctggtccttggcacccactccatggggcccagcccagccacctggctcaccccaagccaactccaccatccacagctcaaaagggatgtcattctgtcttgcaaaagtggatagtgtgtcaggtccaggaagagctcaagccccattgctgctcctctcacctgccctccccagaattctggacctccaggagttgctcagcccttctccactagttctgagctgtttcctgtccatagtctgctgtagtgggccagagcacagggcagatttgtcttcagggactttctctgggcattcctgggcagagaacttcatcttctctgttaactcttgctgataattctctgtagctaggcaccttgtaaaacccatgtcccagaatgccaaacctggaaatgcaatgtcagcgccgaaactgcattgaaactgaatgaatgaggtccccaccctcttatctaaatatcctatcagtctgttgaatgtcaaagtatgtaggggtggtgtgggggagcctatagggagtctccatttctgtagctttccacatgttccatgcagaattttcctctaatgacccttggacaccgtggtggtcactgtttccctgcataaacctttgatgatccttatctttagcgtaccagtgaaacaccaaattcagattttcagtctgtgcagtctatgtagttaataaaatcaatttctaatggaatatgcctgtgcctggtgtgtttgtacctaaccactgctaaggactttcattgatagctagaccttggagttccttcccctggacccctgacccaagtattttgcactcattcctctgccagtgtgtttcatggtgtcctgcttcccagagtgcctcagggaatgcttgcattggatataaatgaatcgttgcggtcaccatggatgggattcaggcctaactctcaccaagaccataaggccacagtctttgatatagattccccatgttaaatctgccatcctcagtgtagtgagagtgatattgagagagaaaagttaggtaattaaggtgggtccttggtaaaactcctttaaacagaggaacagcctgaaaaatcaggcttcaggcacagataaggaaacttgcacaaacctctggctcactcagataaaggaacaatgcccaacacagaaacacctttgatctttgtgcctaaggcatgcccacagctactttgataagggaacaagacccagcatagaaatgcctttgtcctttgtataaccagtgggcttccaggaaatagtctcttctccttttgtggacatgtacacggtgggctacagtgggttccagtgggcactttcctttcttggacgtgctttagaatgtgagcctctgattggtcctgggccaggctatcacttcagctcctgattggtccctcaaggtccaggggccaagctgagtagtgctttctccaagaccagtcagtacattccttcctttcccagtccataaaaccccctgacccagcctcataatgggcaacctgcttgggccccccgccagctgcaatgagctttcttcatttgcttattaaacttttgcttcaaccttaccctttgtgtccacactccctaattttcttggtcgtgagacaaagaattctgggtgataccccacaatgagagactggtacattgtggtgcacgggcaagactgcaacaatatgttttctgcttgcttgtttggactggcctcttcctaactctccagagtgctctctccccactgtggccctgagctttgcctcacggtaacactgtgctgcatgacactccagcatgatctgcatgtttctcacctccggaccttccccacacaactttcttgctgcttggaccacccttcccacctattttcaactgtttctctccagcgcatctttcatgataaggcttgagtggaagctgtatccgaggctgaaggttatccatgcagctttgaaaccatctgtttatgcttctgtttaccccccaaatactgtttaccccaatactcaaagtcaaggttggtgactcaacaattttcagaacttctagcttatcagtatagctttattgtactgaactgagtttttcaccatgctgttactgtctttgaggttaaaaagcccccaacattcactcctatttgaatcatctgtgcaagactcaagcagctatgaattcaaccacagtgtaaagttcttccctacaatgctttattgttattctagctcccaagagagtaccatctttcagcccaagacccttgacagaaccccttcaactctgtcgccttttttcatctctggaattctgacaccacccatgacccctcttcttgttcatttactaggttttgttcctt

SEQ ID NO: 435 - DNA, 35486 bp, Homo sapiens
agacctaatgttagatccagaagttacccaattaatcaaatacataacatcactggcccaatttcaacaagccatccaggagtttgagcaaaaggtactgcctgccactgacccctccagtaatcaacccttatactagccagggtcacaagtcctcatcaaaacctggagagatgggtcacccaggtctcaactagcctgggtctctcctttatggaaaggcccctttattactttctaccccgacagctatcaaagtttctggaatctctagttggatacatcactcctgagtaaaactgtgagaaggtcccgaagaaccaacaacagaatcagcatctgagtagtctcatgagccagccactggagagcttccaattcctcttcaagtgaaaagataagtaaagccttctctcctttcacctcaaaaaaaggtctctcagtacggggaatcttggttgcggtggcatcggttcttctccttattttgacccacactggcatgccacctgaagtcccgataacagcctgatttctcactaaacactccatcgaaccatttcattatttgtctctcctattttcagcactttccttttgctttcacaaagcttaagggagaatcagctatgacagagaaattccttttcctttatctttccctccttcccatgcccctactctcacaggcacagtggaatgaaaattcccttgtcagtttttccaaaataattgcttcgggaaaccatctaagcaactgttggatctgccacaacttcatcaccaggtcctcatcttaccaatatattttggtaagaaatttttctttaaacctaacatttggttcaggaatccctgaaggccaacataaatctgttccgctccaggtttcgcttgctaactcagcgcaccaagtcccctgcctggatctcactccacctttcaatcaaagctctaaaacttctttctatttctacaactgctcttctctaaaccaaacctgttgtccatgccctgaaggacactgtgacaggaagaacacctctgaggagggattccccagtcccaccatccatcccatgagcttctccccagcaggctgccaccctaacttgactcactggtgtccagctaaacaaatgaacgattatcgagacaagtcaccccaaaaccgctgtgcagcttgggaaggaaaagagctaatcacatggagggttctatatttgcttcccaaggcacacactgtccccacatggccaaaatctactgttcccctgggagggcctctatcccctgcatgcaatcaaactattccagcagggtggaaatcgcagttacacaagtggttcgacagccacatcccccggtgggcctgtacccctcctggctatgtatttttatgtgggccacaaaaaaataaactgccctttgatggaagtcctaagataacttattcaaccccccctgtggcaaacctctacacttgcattaataacatccaacatacgggagaatgtgctgtgggacttttgggaccacgggggataggtgtgaccatttataacaccacccaacccagacagaaaagagctctgggtctaatactggcagggatgggtgcggccataggaatgatcgccccatggggagggttcacttatcatgatgtcaccctcagaaatctctccagacaaatagacaacatagctaagagtaccagagatagcatctctaaactcaaggcctccatagattctctagcaaatgtagtcatgaacaacagattggccttagattacctcttagcagagcagggtggagtctgtgcagtgatcagtaaatcctgttgcatttatgtcaataacagtggggcgatagaggaggatataaaaaagatctatgatgaggttacgtggctccataactttggaaaaggtgattcagcagggtccatttgggaggctgtgaagtctgccctcccctccctcacatggtttgtccctttactgggaccagctgcacttaatagcctgctttctcctctttggcccttgtctctataattcactaattaaatatgtctcttccaggatatggcaatttcacacagagcccctaaaaatggaaagagatcatccaatcttccttggaggtcccagcacctacaagtacatatctcccttggatgccagtgggcaaagattctgcaactacggaggggctccttccctgacagagagcaagagagggagaccctgatgacttcttcgtcccacgtcagcaggaagtagttacagaagacccacgacgtccttatgcccaaagcttttcagggtctccaactcttgagggggaatactgttagggtaggcaggtagccagacaagagcaggcaaggaagcccctgggaaaggaatctttagaaatgcagcccgctgatggcctccttggaaacgctgcacgctgagtcagcaaaaggaggagcgtggctacactggctacacctggccttgtggctgcattcctctgttccagaagggaacttatcaaggcccagccagaggttaccaaggtaggagctattccccactaagaagcatgtatacttctctaataattcaccctaatataccattttgttcattaaaataataaaaaaaaccacacacctgtgtggagattttattttttaaccagaaattccttgttagactttagatccaaatgacatggcacatgtgtgcccagaccagttcccaacacatgcttactagtaacgcccctgcatgaccccttcatgaataatcatgtaaaattctcataagaagcatctccccagccaggtgtggtggctcacgcctgtaatcccaacactttgggaggctgaggcaggcagatcacctgaggtcgggagcgcgagaccagcctgaccaacatggagaaaccccgtctctactaaaaatacaaaattagctgggcgtggtggcgcatgcctgtaatcccagctacttgggaggctgaggcaggagaatcgcttgaacccgggaggcagaggttgtgttgagccaagatcgtgccattccactccagcctgggcaacgagaggggaactccatctcaaaaaacgaacaaacaaaaagaagcgtctccccagcattggtgagacagactcattcatttgagcagcccagcctgttctgtctttcagggtgtactgtttatttaaaagcccccataaaaattcctcccaggccaggcatggtggctcaggcctgtaatccctgcacttccttgggcggatcctcagacagatcacagctcaggagtttgagaccagcctgacaaacatggcgaaaccccgtctctactaaaaatacaaaaaaattagccgggcctggtggcacgcacctgtaatcccagctactcaggaggctgagggaggagaatcacttgaaaccaggaggcggaggttgcagtgagccaagattgcgccactgcactccagcctgggctacaggagactccatctggggagggcggcggggaattcctcctaagtcactagcagctgactcactctctgcagcagccagttctgtctcttcttgacctcctgtctttaaataaaggttacttaacgatttaactctttctgtgtgcctcctagatgaattctttccttcaggaagataaactgaaggacctccacacccctcctggtaacaaaggtctttgtgcaatccctcctgaagaagcaatggaggatttagtatatctaaactagtaaatacaaactgtactcaattatccaagaaatcattgaagaaacactctttactccattttttatatcttgggaaaaatataattaaagacaaaataatatttgccaaacccagaaatcctcaccaaaaaggaaaaaaataaataaacaatcccagttggtggctggtgaatgcttctaccttaatcaatacatgttttgaagctgtcagcttctttttgctcataagtgactccacagaatctagtctttgctttgccctctagacaaggaatacagaatttttaaatcttatcagaaacatataaattgtttggttttgcacaatatttactaattttctccactcatccactgtggagtcatagcacaaaatgaggcaccaccctctcgtattgcaactaaaacagactgagcttctgctccataaccataaacagtaatagcaatactaattgaaagatgaagtaattttacgtaagtaggtataaaactgataattcattgttattttcagttttacaataagtgggaattacatagaataaatctttctctctctctctttctatttctgacagtcccgctctgtcgcacaggccaaagtgccatggggtgacctcagcttactgcaacctccgcttcctgggttcaagtaactcttgtgcctcagtctcctgagtagctgggattgcaggtgtacaccaccttgcttggctaatttttgtatttttcatagagatgaaatttcactatgttggccagagtggtctcaaactcccaacctcagatgatcagcctgccttggtctcccaaggtgctgggattacaggcatgagccaccacacccaacggagttttcactcatttactttaatcatcatgggttagagatatagcttttaaaaatgtaattgaatatacccttacagttaggatctaaaaagagcatttcctctattaatgtttattaaataatatggtggaactcagacttgctctgttgcccaagttggagtgcagtggcatgatcttggctcaatgcaatctctacctcatgggtttaagtgattctcgtgcctcagcctcctgagtagctgggattgcaggcatacaccaccatgcctggctaaattttgtatttttactagagacagggtttcaccatgttgctcaggttagtctcgaactcctggccacaagtgatccacccaccttggcctcccaaagtgctgggattgcaggtgtgagccaccacaccagcttaattttttttctttttcttttcttttcttttcttttttttttgagatggagtttcactcttgttgtccaggctggagtgcagtggcacaatctcagctcactacaacctgcacctcctgggttcaagtgattctcctgcctcagcctcctgagtagctgggattacaggcatgtgccaccatgcctaattttgtatttttagtagagatggggtttctccatgttagttaggctggtcttgaactcccgacctcaggtgatctgcccgtctcagcttcccaaagtgctgggattacaggcgtgagccatcgtgcccagcaattttttctatctgagtttcttccgtactaatcagcttgtgatagacacatggtttctgaaacagaaaagtgcaagggctttttatgagcagggtgtggaagactaccagtaacaaatgctttggcataagtgatgagtgagaaggggagtgagagtctctactgtcctacctactaattgtgctttgggaatttggattgaaaaaagccaccttaatggtgtttggttatcatttattctcccccacctggcaggaaataaggacagggtccccaaagctgctagggcacttagggtggatatgaaacattaaaatatgaaacattaaaacttcacttgcttgaaaccagagcagccaccaaactgctcaaaattactgccaatgatgtcttgcttcctggcattcagaaaccttctccttctctacccctgactcttccttccctctctatcccaatctcaatcaccttaaggaagagctgagtatcctgaaaaatttgaaaggaaaaaagagattcaaacttttgtagctctcttggtaagaggtgccccaatcaccttccgaggagaaatgctttgtaggagtgtctcaaaccaccaagacctgtgggaccaagcacatatggggcccataggaagaagccactgagcctcaggatcctccagatgctgggaggtacatggagcagcaggcagcattatgcttgtatcaagcacccaaggagaaaacaaggccactgagctgccccagccttccctgacatgattgtctcctatggccctgggtttgtttggagacctgcaacataactgtaattcctccttctcctttgtgagttcaaactaagggtaggtttgctaccagtcttttaaaaaagattggtgccactcttgcttacagggcagagaaggcacccagaatggtggccactggcaccccactcccaagccaataccacctctagtgtaaccatgcacacaatctccagaaggggaccccagcccctgacccagctgcattgtctctgccactgtggtgaacacttgcatggaggcaggtactctggcgccctctagcactctggctcttgaggagtcagaggaaaacactggggcccaatacaagtcccctaaagttagagcacacagtccagataagtgctggccccctaaaatcttccagaaatgaagccagtcagctgaatccaccttataccacaatccacaatcaaaccctcaaggtcatcaaatagttatgataaaagtaaaaaacaaaaacaaaaaacaatcctcatccaaaggtcagcaacctcaaagactgaaggtagataagcccaaaaagatgagaaagaatcagtgcaagaaccctggaaactcaaaaagctagagtgccttttttcttccaaacaactgcatcacctttccagcaaggtttctgcaccatgcagagatggcagaaataacagaaatagaactcaaaatgtggataaggacaaagttcattgagctatgggagtatgttgaaacccaatccaagaaagataacaaacacataaaacaatgggattatgtaaagaggccaaatctatgattcactggtgtccctgaaagagagtgaaaccaatttggaaaatatatttttgcatattatccatgagaacttccccaacctagctagagaggccaacattcaaattcaggaaatgcagagaaccccagtaagatacttcacaagaagatcatacccaagccacataatcatcagattctccaaggtcaaaatgaaagaaaaaatgttaaaggaagctagagagaaaggtcaggtcacctacaaaggaaagcccataagagcagacatctcagcagaaagcctacaagctagaagagattgagggccaatatttaacattcttaaagaaaagaaattccaacccacaatttcatagttggccaaagtaagcttcataagcgaaagagaaataagatccttttcagagaagcaaatgctgagggaattcattaccatcagacctgcagtacaagagctcctgaagaaagcattaaatatggaaagaccattaccaaccactacaaaaacacactaaaggacatagatcagttacactataccacctaacaccatgataacggatcaaatccacacatatcaatattaaccttaaatgtaaatgggcagccagctggatgcagtggctcatgcctgtaaccccagcactttgggaggtggaggtgggtggatcatgacattaggagtttcagaccagcctggccaacatggtgaaaccccatctctactaaaaacacaaaaattagctgggcatggtggtgcatgcctatagtcctagctactcaggaggctgaggcaggagaatcgcttcagccccagaggcggaggctgcagtcagctgagattatgccattgcactccagcctgggcaacagagcaagactctgtctcaggaaaaaaaaaaaaaaaagtaaatggcctaaatgccccaattaagagacagactggcaaggtgggtaaagaaccaaaacccactggtatgctgtctccaagagacccatctcacaagcagtgacacacataggcttaaaataaagaaatggacaaaaatccaagtctttgctattgtgaatagtgccacaataaatatacgtgtgcatgtgtctttagagcagcatgatttataatcctttgggtatatacccagtaataggatggctgggtcaaatggtatttctagttatagatccctgaggaatcgccacaccgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgattagcatttctctgatggccagtgatgatgagcattttttcatgtgtctgttggctgcataaatgtcttcttttgagaagtgtctgttcatatccttcgcccactttttgatggggttgtctttttcttgtaaatttgtttgagttcattgtagattctggatattagccctttatcagatgagtaggttgcaaaaattttctcccattctgtaggttgtctattcactctgatggtttcttttgctttgcagaagctccttagtttcattagatcccatttgtcaattttggcttttgttgccattgcttttggtgttttagtcatgaagtccttgcccatgcctatgtcctgaatggtattgcctaggttttcttctagggtttttatggttttaggtctagcatgtaagtctttaatccatcttgaattaatttttgtataaggtgtaaggaagggatccagtttcagctttctacatatggctagccagttttcccaacacaaatgtccaacaatgatagactcgattaagaaaacgtggcacatatacaccatggaatactatgcagccataaaaaatgatgagttcatgtcctttgtagggacatggatgaagctggaaaccatcattctcagcaaactattgcaaggacaaaaaaccaaacaccgcatgttctcactcataggtgggaattgaagaatgagaacacatgaacacaggaaggggaacatcacacacccggaactgttgtggggtggggggagggagggatagcattaggagatacacctaatgctaaatgatgagttgatgggtgcagcacaccaacatggcacatgtatacatatgtcacaaacctgcatgttgtgcacgtgtaccctaaaacttaaagtataataataaaaaaaagagaaaaaaaacctgcttattaggaaagcagagtaattatagaatgtaaaattagtgaaaaaatttatgaaattttgcctttataatgatatttaaaataaataccatcatgcctcttttgcaggtaaagaaaatgaaaaactagaatatttaggctcagggtggggtaactttaaaaaagaaggactggtcatgtctatacaatacaatatccttcctcccctaataaactaactcctaaaataaaaaaataaaaaataaataaatggacaaaaatctaccaagaaaatggaaaacagaaaaaaagcagggggccaggtgcaatggctcatggctataatcccaggactttgggagaccgaggcaggaggatcacttgaggccaggagttcaagaccagcttggccaacatggtgaaatgctgtctctactaaaaatacaaaaaattagctgggcatgggggcttgtgcctgtaatcccagctactagggaagctgatgcaggagaattacttgcacaccggaggtggaggttgcagtgaactgagattgcaccactggtctccagcctgggcaacagagcaagactccaactcaaaaagaaaaaaaggaaagaaaaagaaaaaaaaaagcaggggttgcaattctagtttctaacaaaacagactttaaaccaacaaagattctaaaaagacaaggaagggcattacataatggtaaagggttcaatttgacaagaagagctaactatcctgaatacatatgtacgcaacacaggagcaccctgtattcctaatgcaggaacttgctcaaaatgcaggttcttagagactttcaaagagacttacactcccacataataacagtgggagactttaacaccccactggcaatatcagacagatcattcacacagaaaattaacaaaaatattcaggacttgaattcagcactggatcaaatggacctgacagacatctacggaactctctactcaaaaacaatagtatatacattctccccattgtcacatggcacacactcctttttttttttttttttttttttttgagatggagtctcactctgtcccccaggctggagtgcagtggcacgatctcggctcactgcaacctccgcctcccaggtacaagcaattctctgcctcagcctccaaagtagctgggattacaggcacctgccatgatgcccggctaatttttgttatttttagtagagatggggtttcaccatcttggccaaactgctcttgaacttctgacctcatgattcacccacctcagcctcccaaagtgctgggattacaggcgtgagccacggcacctggccggcacacactcttaaatagatcacataattgaaagtaaaatactcctcagcaaatgcaaaataactgaaatcataacaacctctttgatcatagtgcaatcaagtcagaaatcaagactaagaaattcgttcaaaaccatatattacacagaaattgaatcacttgctccagaatgacttttacctctataattgacaattcttgtctcccatcttgctctttcttcttaaatttccttggctattccctccaagatgatgttggataagaggagactagaagctccttagtgtcatttctgactttagtgtgactttctgtaacatgtcccagatgtttgtcaatttgatgaagatatatcacttcctagttcactatttttaggtaacattatttcctgttaaatactgccaattttttttgcatttatgaatgtgggcaccttatttttctctcaacatagagagaccccatctctacaaaaaaatacaaaaatcagccaggcatggtggcacatgcctttggtcccagctattcaggagactgagatgagaggatcatgtgaacctgggagagggaggttgcagtgagtgagtcaagatcatgaacgctgcactccagcctgggtgacagaatgagaccctgcatgaaaaaaaaagactgcatggcattggtggggagtgatatatatatccatggaacagaatagagaatgcacaaatattttcctttcaactgatatttgataaagataccaaagcaggccaggtatggtggctcacgcctgtaatcccagcactttgggaggccgaggcaggcagatcacgaggtcaagaaattgagaccatcctggccaatgtggtgaaaccccgtctctactaaaaatacaaaaattagctgggtgtggtgacacgtgcctgcaatcccagttactcgggaggctgaggcaggagaatcacttgaacccaggagacggaggttgcagtgagccgagatcatgccactgcactccagccaggcggcagtgagactccatctcaaaaaaaaaattaaaaaaaaaaaagataccaaagcaattgaaagcaggactttcaaataatggtgctggaccaaatgaatatccacaatgaaaaaagatcaatctgcacctaaatttgacactcattcaaaaaggaccatgttgtgaaatgcaaaataaagaaaccatcaaatgttaatctatcaagaattagaaaaacatactgtaaactaattgggaacaagcacaccaaagagttcatagatatgacaccaaaagcatggaaaaaaatgataaatgaaacttcgtcaagttaaaacttctggtctgtgataccaatggaacagaacagagaacccagaaataaggccacaaacctgcaactatctgatcttcgatgaagctgacaaaaacaagcaatggagataacactctctacttaataaatgatgctgggataactggctagccacatgtagaagactgaagctggacctcttccttataccacacaaaaaattaagtcaagatgaatcaaagacttaaatgagaaatcccaaactataaaacacatggaagataatctaggcaataccatcctggacatacaaatggacaaagatttcataacgaagacaccaaaagcaattacaacaaaagcaaaaattgacaaatgggatctaattacaccaaagagcttccacatagcaaaagaaactatcgcaatgaatagaaaaccgtacagaatgtgagaaacttttgtgcaaactatgcacctgacgagtctaatatccagcatctatgaggaacttacacaaaattataagaataaaacaaccccattaaaaagtgggcaaaggacatgaacatttttcaaaagaagacatatggcccagctcaatggctcaaacctataatcccagcactttgggaggccaatcctggtggatcacctgaggtcaggagttccagaccagcttggccaacatggtgaaaccccgtctctactaaaaatacaaaaattagccacgcgtggtggctcacgcctgtaatcccagccactcgggaggaagaggcaggagaattgcttgaacccgagagaggcggtggttgcagtgagccaagatcgtgccactgcactccagcctgggcaacagagtgagactatgtctccaaaaaaaaaaaagacagaaaaaagaaacaacccagagcacaggaaaagggaagacgcctgtgtggctggaacagacggagtgagcgctcactagcaggagataaggtcagagatgtcctggggaagcagatcagatagggacaaggtcttcaaacaactctctcccacaccacaaaagaaattggaaatgatttatttcctcacctgttttaagtaaacatttaacttttttctttctcgtagaagagaaagtgatcaactgtaccacatactaccaaaaggaagagaaagatgaggacaggaagttaaatattgcatttaaaaatggggaggttctctgggcgcagtggctcacatctgtaatcccagctctcagggaggcagaggcgagaggatagctagagcccaggagttcgagacccgcctgggcaatatagcaagaccccgttgttctccacaaaaagcaaaaaaaaaaaaaagacaaaaaaaagtgtaggccaggtgtggcgactcacgcttgtaatcccagcactttgggaggccaaggcgggcagatcatgaggtcaagagatcgagaccgtcctggcaaacatggtgaaaccccacctctactgaaaatacaaaaattagttgggcgtggtgcgcgtgcctgtagttccagctactcaggaggctgaggcaggagaattgcttgaacctgggaggcggaggttgcagtgaaccgagatgcaccactgcactcccgcctgcgcgacagagcaactctcaaaaaacaaaaaaaaaaaagtgtaaaaatggggaggttggctgggctcagtgactcacacctgtaatcccagtactttgggaggccaaagtgggcaaatcacaatcaccttaggtcaggagtttgagaccagcctggctaacatggtgaagccccgcctctactaaaaatacaaaaattagctgggtgtggtggtgcatgcctgtaatcccagctactcaggaggctgacgctggagaattgcttgaatccgggaggcggagtttgcagtgagcagagatcatgccactgcactccagcctggatgacagagtgagactccgtctcaaaaaaaaaaaaaaaaaagaaagaaagaaatgggaagtcactgatgattgaaaaagaagggatcagttgaatgctggaagtgaatgtttgattcaagcaagaattcaagggttcaagtaaaagttggaggcaagacttgaagagaaagtaaaagcaagctttcagagtatgacattctttctttctttcttttcttttttttttttttttgagatggagttttactcttgttgcccaggctggagtgcaatggtgcaatctcagctcactgcaacctccacctcccaggttcaagcaattctcccgcctcagcctcccaatagctgtgattacaggcatgtgccaccacgcctggcaaatttttgtatttttagtagacacagggtttcaccatgttggccagtctggtttcaaactcctgatctcaggtgatccacccgccttagcctcccaaagtgctgagattacaggcgtaaaccactgtgcctggccacgagtatgacattctcaaaggggctcagaagaggggaattaccatagagggaaatatagttaccactaatttttgttttaaagatggtgaagggggcctgcccctccacacctgtgggtatttctcgcaaggtggagatgagagactgagaaaagaaataagacacggagccttgggcccaggggaccggcgctcagcatacgaaggacccgcaccggcactggtctctgagttccctcagtatttattgatcactatctctactatctcagcaagggggatgtggcaggactataaggtaatggtggggagagggtcagcaggaaaacatgtgagcaaaggactctgtgtcataaataagtttaaggaaaggtgctgtgcctcaatgtgcatgtagaccagatttatgtttgactttacacaagcatctcagtgcagtaaagagcagtattgcccccagcatgtctcacctccagccataaggcagttttctcctatctcagcaaatagaatgtatgatcaggttttacaccgagacattccattcccagggatgagcaggagacagatgctttcctcttatctcaactgcaaagaggccgtcctctttcactaatcctcctcagcacataccctttacgggtgttgggctgggggatggtcaggtctttcccttcccatgaggccatatctcaggctatgtcagtgggggggaaaccttggacaatgcccaggctttctcaggcagaggtccctgcggccttccgcagtgcattgtgtccccgggtactcgagactggagaatggtgatgacttttaccaagcatactgcctgcaaacacattttaacaaagcacatcctgcacagccctaaatccattaaatcttgagtcaacacagcatatgtttctgcgagcacagggttggagctagggttacagattaacagcatctcaaggcagaagaatttttcttagaacagatcaaaatggagtttcttatgttttcctttttctacatagacaaagtaacagtctgacctatctttcttcccccaacaagatgggcgagcagaagggaaaaaatggctttattctgtatgtgtgcatgtgtgtttatgtgtcttttaaaggagaagaccatcattggagtatgctgatgaaaataattcccttgagcctggcgcggtggctcatgcctgtaatcccagcactttgggaggccaaggcaggtggatcacgaggtcaggagttcgagaccaggctgaccaacatggtgaaactccatctctactaaaaatacaaaaattagccgggcttggtggcacgtgcctgtaatctcagctactcaggaggctggggcaggagaatcgcttgaacccgggaggtggaggttgcagtgagctgagatcgtgccactgcactccagcctgggcaactgagcaagactccatctcaaaaaaaaaaaaaaaatcagagcttagtcttcacttgtgaaatagatttgtgaagggagcacctgcatccttggagagctctgtgattgatcttctctgtatgccagatcttacaatgggaaccagtcactcaattgaaaaacttaaatgcagtgggaataactggatcttaaggaggtagggaccaactagcgagacttatggcccctcaatttccagacttgagccagtttacagacccaggatcccttgaatgaaagggaagctggatttccttaagaaaagatctcactgcacgacaatttatactgtcaatctttctcccatcctttgccaaggagaccgctggccttttaccagggtaaatatgcattgaggaaagtggaatgatcagaccttttggggactagtggacccggctctgagctaacattgattccaggggacccaaaacatcattttggtcctcagttacagtaggggtttatgggagatcagataattaatggagttttagctcaggtctgatttacagtgagtccagtgtgtccccagactcatcctgtggtcatttccccggtgccaaaatgcataaatggaatagacatacttagcagcaggcagaatccccgcattagcttgctgactagtagagtgagggctattatggtgggaaaggccaaacggaagccactagagctgcctccatctagaagaattgcaaataaaaaacatcacaggccaggtacagtggctcacacctataatcccatcactttgggaggttgaggctggtggatcacgaggtcaggagtttaagaccagcctgaccaatatggtgaaactccgtatctactaaaaatataaaaatacaggctgggcgcggtggctcacgcatgtaatcccagcactttgggaggccaaggtggtcagatcacgagatcaggagttggagaccagctccaacagtaaaaccccatctctactaaaaatacaaaaattagctgggcatggtgtcatgtgcctgtgatcccagctgctcaaaaggcagaggcaggagaatcgcttgaatctgggaggtcaaagttggagtgagctgagacggcgccaatgcattccagcctcggcgacagagcaagactccgtctcaaaaaaaaaaaaaaagacaaaaaaaccccacaaaagttagctgggcgtggtggcgcacacctgtagtcccaactacttgggaggctgaggcaggagaatcgcttgaacccaggaggtggaggttgcagtgagctgagatcgcgctgcactccagcctgggcgttaaagcaagactccatctcaaaaacgaacaaaaacaacaacatcatgtctctggacttgaaagatccaggggtggtgattcccaccacatctccactcagctctcttatttggcctgtgcagaaggcaggtggatcttggagaatgacagtggattatcataagctcaaccaagtggtgcctccaatggcagctgctgtaccagatgtggtttcactgctcgagcacattaccacatctcctggtaactggtatgcagccactgatttggctaactgcttttttttccttccattcctgtccataaggcccactagaaggaatctgccttcagctggcaagaccagcaatataccttccctgtcctgccttggaggaatacgggctctccagctttatgtcataatcttgctcacagagatcttgatcagttcgctttcataagatatcacactgctcctttacattgatgacgttatgctgagtgggcccagtgagcaacaagtagcaaccacactgaatttattggtgagacatttgtatgccaggggatgagaaataaatctgggtaaaattcaggattctttcgcctcagtgaaatttctaggggtccggtggtgtggggccggtcaagatatttttcttttctttttttttttttttaaatggagttttgctcttgttgcccaggctggagtgcaatgactcgatctcggctcactgcaacctctgcctcccaggttcaagcaattctcctgcctcagcctcctgagtagctgggattacaggcattcgccaccatacccggctaactttttgtatttttagtagagacggggtttcaccatgttggtcagactggccttgaactcctgacttcaggtgatccgcccgcctcggcctcccaaagtgctgggattacaggcatgagccactgcgtccggccaagatcttccttctaaggtgaacgataagttgctgcatttggcccttcctacaacaaagaaagaggcataacgcctagtgggcctgtttggatttggagacaacacatttctcatttgggtgtgttactccagcccatttatcaagtgatccaaaaggctgccaatgttgagtgtggtccagaacagaagactccacaacagctccaagctgttgtgcaagctgctctgccactgggccatatgacccagcagatccaatggtacttgaagtgtcagtggcagataggcatgctgtttggagcctttgtcaggcccctaaaggtgaatcatagtggggcctctgggattttggagcaagggcctaccatcctctgcagataactactcaccttttgaaagacagctcccagcctgttgctgggccttggtagaaactgaatatttgactatgggtcaccaagttacaatgagacctgatctgcctatcatgaactgggtattttctgattcatggagccataaagctgtgcatgcccagcagcattccatcatcaaatggaaatggtatatatgtgattgggctcaagcagttcctgaaggcacaaggaagttacatgagaaagtggctcaaatggccaggcatggtggctcacacctacaatcccagcactttgggaggccaaggtgggcggattgcttgaggtcaggggttcgagaccagcttggtcaacaaggcaaaaccccatctctactaaaaatacaaaaattagccgggtgtggtggtgcatgcctgtaatcccagctactcaggaggctgaggcaggagaatcgcttgaacccgggaggtggaggttgcagtgaactgagattgtgccactgcactccagcctgggtgacagaatgagactccatctcaaaaaaaaaaaaaaaaaaaaaagagaaagtggctcaaatgcctatggtctctactcctgccatcctgccttctctccctcagcctgcatcaacatcctcatggggagttccctatgatcagttaacagagcaaaagaagactagggcccagtttacagatggttctgcatgatatgcagttaccacctgaaagtagacagctgcagcaccttctaggacatccctgaagaatagtggtgaagggaaatcttcccagtgggcagaactttgagcagcacagctggttgtgcacttcggtttgaaggagaaatggccagatgtgtgattctatactgactcatgagttgtagctaatggtttggctggatggtcagggacttggaagaagcatgattggaaaattggtggcagaaaaatctggagaacttccatccaaatgttgatggacccgagtggtcaaaaacagtgaagatatttgtgtcccacatgaatgttcaccaaaggatgacctcagcagaggaggattttaataatgaaatggataggataactcattctgtggataccactcagcctctttccccagccactcctgtcatcacccaatgggctcatgaacaaagtggccatggtagcagggatggaggttacacatgggctcagcaatatggacttccattcaccaaggctgacctggctatggccaccgctgagtgcccaatttgccaggagcagagaccaacactgagccctcaatatggcaccattccttgggagtgatcagccaggtacttggtggcaggtcttccatcatggaaagggcagcagtttgtccttgctggaatagacacttaggccagatatggatttgcctttcctgtgattctcccacctcggtctcccaagtagtagctgagattataggcgtgcattaccacgcccagctaatttttgttttttctctgtttttttgagacggattctcgctctgtcacccaggctggagtgcagtggtgtgatctcagctcactgcaagctccacctcctgggatgacaccattctcctgcctcagcctcccgagtagctgggactacaggtgcccaccaccacgcctggctaattttttgtatttttagtagagatggggtttcaccgtgttagccagatggtctcgatctcctgatcttgtgatctgcccgcctcggcctcccaaagtgctgaatttttgtattttcagtagagatggggtttcaccatgttggcaaggctgatcttgaactcctgaccccaggtgatccgcccgcctcggccttccaaagtgctgggattacaggtgtgagccacagcgcccagctgactgctgaacttttttttttttttttttgaaatggagttcacctttgttgcccaggttggagtgcagtggcacgatctcggctcaccacaacctctgcctcccaggttcaagtgattctcctgcctcagcctcccaagtagctgggattacaggcatgcaccaccacacctggctaattttgtatttttagtagagaaggggtttctccatgttggtcaggctggtctcgaactcccgacctcaggtgatctgctcactttggcctcccaaagtgctgggaataatgagccaccaagcccagccccaagaaaaaaagttttttttttcaaagctgaagcctggaagaacatataggtgactaaaaattagacaaaaagaaaaaaaaaaaaacagaaaaaaagtcaatgtagtacaccgcactgacaaagtgaaggacaaaaatcacgtgatcagctcaattgatgcataaaaagtatttgagaaaatccaatactgttcatgattttaaaaaaccatttaaactagaaagagaagaaaataccagaacatgagatttagctgtgatttcttggatacaatatgaaaagcactggcagaaaagcaaaaacagatgaaaggaactacatctaaatgaaaaacttctgtgcatcaaaagagaatgctccagcaaggatgtagaagagcgagctcctgtttcccaacacaaaagtaaaatctcaaaacttgcaggttaaaatatcacaataaaacattcactgaaaaacatgttttaaatctcatatcgatgtataaatacgttactataaatcttgtgctgactcttgccatgaactgagaatggtggttctccactgagcacgaggaaggaagcggaacagaaaagacgatgtgttacatcttagtgcctaagctataagtttggagttttactataaaacattcaccatgtgatgttcaaaataaaatagaatatttaataattattgggttaaaaaaatggttcaattctctccaatggcaaagaagctgtgattcactgtatgagcacagtgataaccattctcacctaaaacacagttcacaggggttcctccaggaatacaacatctctgttctggtctgtctgaaaatagtttaatgtatctcctgctgtttgacatttatgttgacttcatatattaaaatgtgaggaatgaaaaaatcctatcactgatgtttccatctaaactttccattccattcccagtcattaagagtttgaactcagaaacacagtgactcacttgttcagttccaaatataataaaaacgaggcaggaaagatttccccatagtgttctcattttaaagcattcaacaggaacttgtgcatattaatacctgacgtcatgggcaacttcttgaatcctggtctacaaagaggtggcatacatccaaatgtggctcctaaacaatccctgctccccagaagcactgaaaccacaaggcccacaccccatctccaatccatgtctgggtgtcagcccttccaaggaccatgcccagcagagcctcttcagaagttcatgtcactaggtcatgcaggatggaatctaagtgagatgagagggactgagggaaggcatgcgtgagtgagcaaacatgtcaggcaggatgtttcaaagatttgcaatgacattttgttacagtaggtagcttacctggtatgagaaggagagggctccccctccccattcacacacatcaggaatgagccaggcaaccatcaggtgatggtcaggtggttgttaactgtctctctaaaataataattagtcacagccggcaccagggaaaggcatagatagaaaacacctgaaactggtgatcagcctcttcccatgagatctcaggagttgggcgagtggactaaagcatgtgcatgtggacagcccaccccaaggcaagaacagcccaccccaaggaagcaagaccccggaagtatgccaacgtataaaaccctaagtcaaaaggtcaaactgcacacttgcctttcaagtcgatcacttggccctcttccaagtgtactttccttcctttcagttctgctctaaagctttttctttttttttgagtcaaagtctcactttgtcgcccaggctggagtgcagtggtgtgatctcggctcaccacaacctccacctccagggttcaagtgattctcctgcctcagcctcccgagtagctgggactacaggcgtgcaccagtaggctcggctaatttttgtatttttagtagagacggggtttccccatcttagccaggctggtattgagctcctgacctcaggtgatccgcctgccccggcctccgaaagtgctgagattacaggcatgagccaccacacccagaaaaaaatttaaaatttaatatgtgttatattataaacagagaaatcaatatgtcacaatttaatcaactcatccaatcaacacccccaaccttgttcattattctgtgtttccctcccttattccgtacatatctctcattctcatcttctctaactcttgggttcttttctgtttccccctgggtttctgctcctcattttgagcctctctcctctcttgctgtttctccgcttcttcctgctattccatcttttccacctgttctgctccagtcttacaacttgtttcacctcctgtccctctttctccccaatcactggattgtccccagtgtccatacatttctgcctctgtctttccccatctctgcttcccctgttaaattccctcttccctgtttacacccccttgtcctcagtctctagcaccctcagatccctaggcttacactgaggtctatgatccattctgagttaatttatgcacaaaacgtgaggtttttgtctggatttttttcttttttgcatttggatgtccagttgttccagcaccaaaactcaaacagaaacacacaatctgaacaggcctatagcttttaatgaatttgaaccaataatccctgagcaccctgctgtggttcttcttctgctctccttgtcaccagttgccccttcttgctgtcccagcaccacgctgctgcctgccgtggctccaaatccctcctcctctccctcactctctgtctgaggagcctcccctctgctgcccctctccctaccttgctgtccttcacctttctggacatggagcttttctctacatttctccagttgtttccccatcctgttactttctcagcttcttctttgactcttcctgtctcttcgcgaatcccccacgcatcctccattttgccatctgtttatgggtttccctcattctctgtctcagtttgtctacttctctcgcagtccctgtttccagatccccttggcccacacattcacaggagggtttagggtaagacacctgcatcccgcaggagcacatttttccagggggtggagctgggaaggcaagaacaccaggtgtcacaggacaggccctgggcacctccctaacgcgggctcaggggaagcggggactgcaaacgagaggcctggggagcagcagggcccagcaagagttggagggaggtgggggcgaaggcgccttaggataggggtggggtctgcaggatcccgccaggcagaggacgcagcctccctgggactggggctgcggggccgacgagggcgaggctgggaggcgcccaggacgcgactccacctcgcgggtgaggacttgaaaaagtgcggggcaggatgaggggtcagtacagggtttcgaacggaaaaatttaaggaaagaacatgtctacatgacctgaaggcagaaacaccggcgacggaaccagcctcagaatgattttaccccaaatcactgaaacgaccccaagagtctcatagcgatgtgtgacttactagcagtgaggggagcggtatgagaattttcaggcgtgtacgaacctccaaatccggggtatggaggtgagaggactgcgaagcccaagtttaatcttaataatagacagagggaaatccacgcgccgccataccaggttcactccgcgcgatctgtttccgggtctgcaggaaactaagcgcagagcggaatcctgggcgggtcccgcgagcgacggcgtcgggagggaagaaggaagggggcggggcctccgcggagtgggggggcctatgctttcctcttctggctcccatggcatctctatttttcgggtttaggaggcaacatttaccagtgaggctgaagcaactcagcaggatctccctggggcagggcaaaccgttggtgattggatccaggaaaattcctgctattgaaaaagtttagcaacttaatttaaaagccccagaattgtctgtgaaggggatgcaaactggaacgtgaaaggcaaactctgcatggggggatggatcaatcccatgctgatgtcccacaaaacaaaatagaaatccttttattttttatttatttatttttttgagactgagtcttgctctgtcacccaggctggagtgcagtggtgcgatctcggctcactgcaagctctgcctcctgggttcacgccattttcctgcctcagcctcccaagtagctggaactacaggcgcccgccaccacacccggctaatgttttgtatttttagtagagatggggtttcaccgtgttagacaggatggtctcgatctcctgacctcgtgatctgcctgcctcagcctcccaaagtgctgggattacaggcgtgatccaccgcacctggccctagaaatccttttattttctaatctccatttactccagagagtcaaccttgtacttgtttccaaagactgactttgttttttttttttttttggaaacgtagtttcaaatctgtcagccttggcttcccaaagtgctgggattacaggcgtgagccactgggcctggcctccagagactttcatagacgcaacacctggggtgttaagcatggaaagctaggtctgtcatcaccctggattcatcttgtctctgcccagaagagacagtgcactgaaaacaggagagttttgcagcaaagagtttaattatcgcagggctagccaagtggaacaagttgggagagggggaagttagttctcaaatctgtcgcccgaaaagttgggagactagggttttgaggataattcggagagcaaggggctagggaattggtgtggctcattagttgtggagaaaatcataagagggttcaaaacaggcctcctggagctgagtcagtttctgggtgacggtcacaggaccgggcagtgccagttctctggtaccagtgaagaagacgtccaggtggcctgaatgactctgcccaattgtaaaagtctgaaaaatacctcaaagaccaatcttaggttttcacaatagtagtgttatctacaggagcaactgagaaattacaaatcactggttattgtttctgtctacattttagcagaattcagttacctcccataatcctaacatttagcctttcattagtcttagaaagttggtttcagtcacctgagagggtcactttgggagggactagtatcatcctttcttcaaagtcataactataaactgaattccacccatagttagctgggccaatgcccagtaatgagcaaacacagcttgtgaggttagaagcaacaattaggttagatttctctcactatcatgatttttgcaaaggtggtttcaggttcagtgatgttagatcaccgatttttgctttaaataataagcaatggccgggtgcagtggctcatgcctgtaatcccagcactttgggaggctgaggcaggtgggtcacctgaagtcaggagttcaagaccagcctggccaacatggcaaaaccctgtctctactaaaaatacaaaaagtagccgggtgtggtggtgcatgcctgtaatctcagctacttgggaggctgaggcagaagaatcacttgaacctgggaggcggaggttgcagtgagccaaggttgtgacattgtactccagccttggcgacaagatcgaaacttccttgaagaaaaacaaaacaaaacaaaaacctaaaacatctgatgggagaaagaacgcacaaataataacacaaaacccccaaacaatatgattactgagtgctctaatggtaaggagaaatttaaaccagctggttattaatcttaactttagccaagacagaaccccaaattcacctacatacctaggaatgggtataccatcctaggaggaggaaaaaaactgaaattcaccttcccaattggaagcgagcttaaactttagaaaggagttacctgccttctactgtcatggaagcaggaaaacgtgccttccttattggaagcaagtaaaactccagaaaaagatgtacagcaaaataaagttaagatctcaaccaaattttgatagatcagggattctctagagagggagctcccaggcctcagccaattgtcctactggtttgagccataaggatagctcaatctggtaccaagcaccaataggagatcgtcaaaggtcagggcccactctactcagagttacttccttgggtcaccaatttgtcaacgaagagtacctgagacaggtctcaatcaatttagaaagtttatattgccaaggttaacaacatgcctgtgacacagcctcaggaaatcctgatgacatgtgcccaaggtagtctaagtacagtttggttttacacattttagggagacatgagacattaatcaatatatgaaagatgtgggccaggcgcagtggctcatgcctgtgatcccaacaatttggaggccaaggtgggcggatcacaacgtcaggagttggagaccagcctggccaacatggtgaaagcctgtctgtactaaaaatacaaaaattagcctggtgtggtggcacgtgtctgtaatctcagctactcgggaggctgaggcaggagaattgcttgaacctgagaggtggaggttgcagtgagctgagatagggccattgcactccagcctgggcgacagagtgagactctgtctcaaatttaaaaaataaaataaaatagaaatatatgaaagatgtccatcgacttggtctggaaagtcacacaactcaatcagggaggaagcttctaggtcataggtagataacagacaaactgttgcattcttttggagtttcagattaggctttcactgaattcgtgatttacaggaatagtcacttatgccttagtctggcttagtgaaacaataggacaaaggaaaaaatcagatacgcatttgtctcatgtgagcagagggatgacactgagttctgtctgtcctttgtccacaaggaatttccttgtaggtaaattttgaggaaggtatgtagcttttaaaaatctttgtagctatcttatttaggaataaggaataaaatgggaggcatatttgcctgacagagttcccagcttgacttttcccttggctaagtgattttggggtctgagatttattttcctattacacctccttgtaatatcattataagagaaatgcaaattaatatggatttttttcaaataagttaaagtaggaactactttgtgtgtgtgtgtgtatgtgtgtgtgacagaatctcattctgtcacccagactggagtgcaatggcatgatcattgctcattgcagcctcaggtgatcctcccacctcagcctcctggtagctgagactacaggcatgtaccatcatgcctggctaatttttgtattgcttgtaaagacaggattttgccatgttgcccaggccagtcgcaaactcctggtctcaagtgatcctcccacctcagcctgccaaaatgccaggattacaggcatgaaccacttagcccatccaggaagtactttcatctcttgagtatatattatagcctgtgtcacacacaaaaaagagaatgtacatattctaacacagatggaacaatgaaaatgtttactactgtcaaagaacaaatttggacattggttagaagagattctattcaaaaagtatattgtggtagggagaatgctccaaccacaagatctgcaaatgtttgagtcacaagaaatgggcttttcttttctctaaagaaggaagcaaggctagaaagcaccaggtacagggcaggggatgagcatctgctgtgacctattcagggaattttttttttttttttttttttgagacagaatctcattctgttgcccaggctggagtgcagtggtgcaatctcggctcactgcaagctccgcctcctgggttcacgccatcctcctgcctcagcctcccgagtagctgggactacaggcgcatgccaccacgcccagctaattttttgtatttgtagtagagacagggtttcaccgtgttagccaggatggtttcgatctcctgacctcgtgatctgcccgcctcagcctcccaaagtgctgggattacaggcgtgagccaccacgcccggcccaaacaaagattttaaaaaataataaatacatgtgttctacttgaaaaacagaactaaaagtaataagaacaatagcaaactttgctccttacctcagtttttgaatgacattgaagggtcctcaatgtgcatttcggctgtgtggtattcatttcgatcacatgcaagacactgatcagttcttgttggaagatatggctctacatttctaacttcaagggtctctgtaactgtcgaattaagcagaaagctagggtcatattaagaaaaatagtgttcccttatacatttttctgctgatcatgggaaaacatattctcacagcttcatgaattatttggtcacaatttgacaataaaaacactaatttatatgtcagatccatgtcacattctcatattaatctaaattttcttttttttttttttgagacagagtcttgctgcattgcccaggctggagtgcagtggcgcgatctcggctcactgcaagctccgcctcccaggttcacgccattctcctgcctcagcctcccgagtagctgggactacaggcgcctgccacctcgcccggctaattttttgtatatttagtagagacagggtttcaccgtgttagccaggatggtctcgatctcctgacctcgtgatccacccacattggcctcccaaagtgctgggattacaggcatgcgcccgacctcaatctaaattttcttgacatcctttttggtaccagctgagccctgacaaaggaaggtaattcagagacattttctcttgtgatcagagaaataacctaatgagaataaacttatgttgattgggtttttttgttttttgtttgtttttgagacagggtctcactctgtcccctaggctggagtgcagtggcatgatcacagctcactgtaccctccacctcctgggctcaagccatcctcccagctcagcctcctcaatagctgggactagagggtcacgacactatgcccagctaatttttttgtattttttgtagacatagggttttgtcacgttgcccaggctggtcccaaacttctgaactcaagtgatccgcctgtgtcagcctcccagtgtgttgggattacaggtgtgcaccaccatgcccagctgaaaataaaattaaggtgaagaaagttgttctctgtgatctcaggggaaaaccttcaggtaaatttgcattcagattgaatagaagaaacatacaaatgtggatgaactagatactactttaaaagtctttctagcgccaggctcagtggctcatgcctgtaatcccatcactttaggaggctgaggcaggcagatcatgaggtcaggagatcaaggccatcctggccaaagtggtgaaaccccatctctactaaaaatacaaaaactagctgggcgtggtggcatgtggctataatcccagctactcgggagggtgaggcaggagaatcgcttgaaccagggagctggaggttgcagtgagccgagatcacgccactgcactccagcctgggtgacagagtgagacacctttacaaaaaataaataaataaagtatttctgtccacaaaccagcttggagtaggtaggtagccaggcatgagcagttaaaggagcccctgggaaaggaatcttaagaaacacagcccactgacaatccccttttgacagcaaaagcaggacagtggctacattgcctacacctgtccttgtggctggacttgtctggcccaggaagggagttatctggccctagccagaaataacccagctaggggattttccctattaaggagcgtgcacactcctctaataattcatcctagaatggccttttgctcattataatactaagaaacacatccccttttttcaaatatgattttagaaaaaaataaataagggctgggtgcggtggctcatgcctgtaatcccagcactttgggaggccgaggcaggtggatcacgaggtcaggagatccagaccatcctggctaacacggtgaaatcccgtctctactaaaaatacaaaaaaaaaattagctgggcgtggtggcaggcacctgtggtcccagctactcaggaggctgaggcaggagaatggcgtgaacccgggaggcggagcttgcagtgagccgagatagcgccaccgcactccagcctgggcgacagagtgagactccgtctcaaaaaaaaaaaaaaaaaagccacacccctgggtggagatttgagatgctaaggagatatgtgatgtgtgcatggacagtcacagcacattcctgcccaaatgacttcccagaacatgcttactaataatggctgtgcacggccccttcatgaataatcatgtcaggttctcattaaaagggtcaggccagcataagtaaggacagactccttcttttcaggagcccactcggttctgtcgttcagggtgtcgcttctttctgagctcctgtctctttaaatgaagggcatttaccctttaactctttctgcgcatctcttgactgaatccaagaagaccaagaaccagaggacttccacacccctctgggtaacatctggtgttttcacctggttacctggttacctcgcctggttatccaggtaagtaccaaaaagctggtgccagattctctggttgacgacctctgcttctttctgcactgaagaacctcctgccctaatgcagatctggcagctttaaggggaggggtttttcctctcaggctctgttcactaacgactgcccagtaccatttcccttcagccactgtcactctgctccctctggctgatttctcagctcaccctgaggggtgataagcagaggagggaggatttaaactccacagtgagtagatctgagacacatggtgacccttcttgcaggaggcttgtgaaggtggcagggaatacgcctggctgtgcagtgactggggagcttcatatttttttttgtgggggggaggacagagtctcactctgtcgcccaggctggagcgcagtggtgtgatctcggctcactgcaacctccacctcccgggttcaagcgattcttctgcctcagcctcccgagtagcagggactacaggcgtgtgccaccatgcccggctaatttttgtatttttagtagagacagagtttcaccatattggccaggctggtctcgaactcctgacctcgtgatccgcccacctcggcctcccaaactgctgggattacgggcgtgagccactgcgaccggcgcatatcttttaattaaaactacaatccggtgttaagtcagctcttatacttgccattcatggccgttcactcccctgaacaccatatgcccccaccgttgattaatctcccaggtcactctgcttactctttgctgtccctctcctcgccgcagggatttcatgaattcttcctgcgggtgcaagcctcttgcagggcctgtttatccaggacctgctgcgtttgcttcactcaggcgccagagtcctttgagggcctatgctgatgtttatacttttttcctcagaaatgagactcagctttgtcctttcccttgcctcctgtttcactggagggaccggcactgggaggatgcctgcttaaagaaatccctcattttggccgggcacggtggctcatgcctgtaatctcagcactctgagaggttgaggggggtggatcacctgagggcaggagttcaagaccagcctggccaacatggtgaaaccccatctctactaaatatacaaaaattagccgggcgtggtggcacacgcttgtaatcccagctacttgggaggctgaggcaggagaatcgcttgaacccgggagctggccattgcagtgggccgagatcgcaccattgcactccagcctgggcaacaagagcgaaactctgtctgaaaaaaaaaaagaaagaaagaaatccctcacttattattgggtccttctccgcctgcctactcttcaagaatgcctcattctgtgactcctcaatggaactgcctggctcttccagagggtcacctgtgaccacttccttactccctagtttctctgtacaaccagggtttccaatgggccacaggagactgctttctccacctcattaggccattgtaacagacccgtgaagtactcaggtcctttttgctttttgttgaataagctgatagaaaatgcttctcacattccccttgctgtttatgtgatcatataatggactaaaaaaccagaatcaacagcccagttcactaactctgagccccagggggtcttctatgcttttcaagcatttttttctgtataaaccccaaggaaccttttaagagtgggggaagatatcacatcttttccgttcctgtaatcattagtattagcccaatatcattatgtattaagaagacctaggctgggcgcattggctcacgtttgtaatcccagcactttcggaggccaaggcgggcgtgtcacccgaggttgtgagttcgagaccagcctgatcaacatggagaaaccccgtatcggctgggcacggtggctgatgcctataatcccagcactttgggaggctgaggcgggcagatcacgaggtcgggagtttgagaccagcctggccaatatggtggaaccctgtctctactaaaaaattagccgggcctggtggcatggatctgttatcccagctattcaggcggctgaggcagaagaatctcttgaaccctggacacagaggttgcagtgagctgagatcgtgccactgcactccagcctgggtgacaaagtgagactccatgtcaaaaaaaaaaagaaaccccgtctctactaaaaatacaaaaatagctgggcatggtggtggacaccagtaatcccagctactcaggaggctgaggcagaagaatcgcttgaacccaggaggcggaggttaccgtgagccaagatagcgccactgcactccagcctgggcaacaagagagaaactgtctcaaaaaaaaggactttagaagtcccttctctgcagaattcagcaggggcacaactactgggcttcctgcagaaccaaggtcactgggaacatgagagaagagaagagaactactctcatggcagacattcttccacccgtccttacccaacacggaagagtggaaggcatcactgctgggcatcaatcccaggaaatctaagaaatccttctgagcaaaacaataggaagaaatgcaaacagcagagcacacagtagggctaattccagagctccaaggtgaaggacacttcacccttgcagggagaggcatgagacacctcatttaggtcaaggattggaatgcctgaccttcatgagtcaccaaataggtaaagggacacttcctctatcctgcattctctcttgtcttgtctttcagatgggtaatcagatctttatatcccaggattcccctcctggatccccttggaatctgggaaaaggttgatccccagattgtaaaacaagagactgattttcctttgcaatatagtttggtcaaaggtggggagcttaaatgttaataccatattccagcttgacctttactgccaacaccaacacaaatggtcagaagtcccttatgtgaaaatcttcatgatctcgtgggaaaaccctgatttttgtaaaggctgcaaaacgggctcaaaagaaaaagaaaaggaaaggaaacagccaagggcggtggctcacgcctgtaatcctagcactttgggaggccaaggtgggctgatcacctgtcaggtaaccaggtggccaggtgaccaggctggtcaggagtttgagaccagcctggccaacatggtgaaaccccatctctactaaaaatacaaaaaaattagccgggcatggtggcggtcacctgtaatctcagctactcgagaggctgaggcaggagaatcacttgaaccccaggaggcggaggttgcagtgagctgagatcgcaccattgcactccagcctgggagacaagagcaatactacatctcaaaaaaacaaacaaaaaaaaggccagccacagtggctcatgcctgtaatcccagtactttgagaggctgaagcaggtagatcatctgaggtcaggagttcaagaccagcctgaccaatgtggagaaaccttgtctactaaaaatacaaaattagctgggcatgctggtacatgcctgtaatcccagctactcgggaggcttaggcaggtgaatcacttgaacctgggaggcggaggttgcggtgagccgagatcccgccattgcactccagcctgggcgacaagagcaaaattccatctcaaaaaaaaaaaaaaaaaaaaaaatacaagccattcaggagtttggacaaaaggtactgcctgctcttgaccctttcaggaatcaacacccattataccaaccagggtcaaaaaacctggagagatgggtcatctgggtctcaactcccttatggaaagacccctttactgtcttactttccaccccaacagctatcaacatttctggcatctccagttggatacatcagtctcaagtgaaactgtgggaaggtcccgaagaaccacagaaga

SEQ ID NO: 436 - DNA, 366656 bp, Homo sapiens
agaaacgctgaggacctgggaaatgcagacttaatacaaaacagcgaaactcaccgccgcggtgtgaccgtcactccacgcgatccgcttccagatttgcgagaatctgcgcgcgcaggacagaagccaggcctcggcgggccccgcgaggtggtgggcggggcctgggccgggtggcggcggggcgcgaagcagagagactttgcggtttagaaccggcagagggcggggccggggcgggacctgtgtgtctcacatcctggctcccagcgcctctgtttttcgggtttgggaggcgacagcggccaggaagtatgaggcatgattcaaaagccctggaattttctggaacggggatgcaaactagaatgtgaaatgcaaagccctgccagggcggaacataggatttcatgctgacggcccacagaacagaacagaactcctctccctttctattctccattcacaagggagggagggtccgccctgtgctcagcttcagagacttccctaaagccactgcctggggtgcgggacggagtgctcaggccagggaggagtgaggtcaccacctgctgcttaaacacagcaggggtgcaggcgcgaaggcgggagcctgaggtcccagctactcaggaagtaggagcaggaagatcgctgagccctggggtccaggccagcctgggcgacaaagtaacaccccctcccgcaaggccaccttccttgtctccctctctctccgtctctctctctctctctctctctcgctttttaaacctttttaaataaaatttttgatggtgtgacatagggatccaacattattctgttccgtgtggatatccagttagttgttccagcacatttgtggaagaaatctattacttttttttcacgtttttcttttctttttctttgagggagtctccctctgtcgcccaggctggcgtgaaggggcgtgatctctgctcactgcgacctctgcctcctgggttgaagcgattctcctgcctcagcctccggagtattacagtattactggtattagaggcacgagcgaccatgcccggctaatttttgtatttttgatagaggcgggctttcaccatgttggccaggctggtctcaaactccgaacttcaagtaatctacctgcctcggcctcctaaagtgctgggactacaggcgtgggctaccttgcatagcctaaggaatgctctttactgtttaaacgttgagaaaatataattgaaaacaaagaaaatcttcccccaaatgggtaattatctccacgacaacagagaaataaataaaaaccattttaataaagaaccttagactcaaatgtgatgggaaatagaggcaaacagctatgaggttgaaaagagagaaagaaatgtcactgttctatacaacccattaagcacatgttttcaagataaacactaatcagtcctcagggaaggggatttgacaaccccttgggtcacacatacttcatcctggctttacttggtaatggaggtgaccatctgtgtcagctaattagcttcatcccgagggagggggaaaaaccctaacccatgtctttttgacaagtgtgagtttcacaacatggggacaggtgccctctctggtgagactcctacaatacgacagacactgatgtcagaggtaaataataaaatttagaatatatgattaagtgcagagtttgtttgaacacaaagcttggaaatagccacctggaaacatcaacttcaaatgaataggatcagcgttctcaggtggagacgttaagattttacacacataggaaaagacagagaagctttaccagaatcacattttccattcaagaccagtgcctagggtgcagcaacttgactggtgatggattgatacacttcaaggaaggttactttatcactccataagaagggacaatgatgccaaaaggtcttaactctggggctgcttagtcttcctaattatttacagaataacctttttttttttagttgtttgtttgttgttgctgtcattttttcagacagcgtctagctctgtcacccaggctggagtgtactggcactatctcggctcactgcaacctccacctcccgggttcaagcagttctcctgccccagtcagccaggtagctgcgattacaggccagtgcgaccacgcctggctaattgttttctgtttttagtagatactgggtttcaccatgttgggcttctccattaatctctcctgcacacttcagaccacatccacacacacttaaatcaacttcagttcagagatgagaagcaaaaacctagagaggacacatccacagttactcaccaggctgaggtgggaggattgcttgaccctggagagcagaggttgaagtgactcaagatcgcaccactgccctccagcctgggggacatagtgagaccccgttacccacatccaccaaaaagttggaaatgcattgaaataagagacagcttcaagaaactataaaagcaatgcatgcagaaaattcaaaggtcaaccaacatacagaaactatgaagaactacacagaaactcttgggctaaaaatagagtaactaaatgaaaaaacgcaatacatgggttcaaaatcagaattcattaggtaaattaaaaattagtgaagaggggatgggtgaggtggctcacaccaggactttgggaggacaaggtgggtggatcacttgagctcaggagtttggagaccaacctggccaatgtggtgaaaccttgtctctactaaaaatacaaagattaacagggtgtggtggtgagctcctgtagtcccagctactctaggggctgatacaggagaagcacttgaacatgggaggcagaggttgcagtgagccgagatcaccccactgccctccagcctgggcgacaaagcaggactgtctcaaaaaataataataataataataataaaataggccaggcctggtggcttatgcttgtaatcccactataaaaaaaaaatacagaaaattagccaggcgtggtggtgggcacctgcagtctcagctactcgggaggctgaggcagaagaatggcatgaacctgggaggtggagcttgcggtgagctgagatcatgccactgcactccagcctgggcgacagagcaagactccatctcaaaaaaaaaaaaaaaaagaaatttatccttactacttactgtctacacatagataatcaaaggcaagtagttaaagacatagttaaaaatatgacaaaactggccgggcatggtggctcaagcctgtaatcccagcactttgggagaccgaggtgggtggatcacaaggtcaggagatcgagaccatcctggctaacacggtgaatccccgtctctactaaaaatacaacaaattagcagggtgtggtggcgggcgcctgtagtcccagctactccggaggctgaggcagaagaatggcgtgaacccgggaggcggagcttgcagtgagccgagatcaacccactgtactccagcctgggcgacagagcaagacttcgtctcaaaaaaaaaaaaaaaaaaaaaagacaaaactgacacatgtgcccatacaagtgtagcatggattcaaccctgatgccatgtttagaaagtagttcccagcactaggaggatttaaaactcttataataggagttattatagtaatagaaacctgcttactgctgccttgtttgctacctgtacttcttcaaacgataaaaagcttcatcgctattttagttcaccaaaatgcttcagcacaagtgtactatatgaatcactatcaatctgttgcacaaaaagacataagcagcaaaaataagagtgagaattcccactaataaaaagtgagactctcaaaggggggaaatgagggaagagagagagaccctctcatattgttttatattgttttatactcagtacctgttttaagaaaaaaacaaggaagtgaaaccaaaggcaggcatcccgatgccaggcatcagacctaaaaccagacctgaaaccaggcctcggcctgcctggcctaaacctagtaattaaaattccacccctgacctagcaactgatgttatctatagatcccagacattgtatggaaggacattgtgaaacctcctgttctgttctgtttcactctgaccaccagcgcatgcaccccctgtcacataccccctgcttgctcaaatcaatcactaccctttaatgtgaaatctttagtgttgtgagcccttaaaagggacagaaattgttcactcagagagctcggattttaagacagtagcttgccaatgctcccagctgaataaagcccttccttctacaactcggtgtctgagaagttttgtctgtggctcatcctgctacaacctgagggcaggagttcaagactagctgggccaaaatggtgaaaccccatctctactaaaaatacaaaaaaaattagttgggggtggtggcactggactataatccccaactttttgggaggctaaaacaggagaattgcctgggaggcagagtttgcagtgatctgagatcatgccactgaactccagcctggataacagagactttgtctcaaaaaaaaaaaaaaaaggccagaagaggtggctcacgcctgtaatcccagcactttaaaacgctgaggcggacggatcacgaggttatgaaatccagactgtcatgactaacaaggtgaaataccatctctactgaaaataccaaaaaattatccgggcgtggtggcactcacgtgtagtcccacatacttgggagcctgaggtaggagaatcacttgaacccaggaggcagagtttgcagtgagccgagatcacgccacagcactccagcctggctaccgggtgagactccatctcaaaaaaaaaaaaaaaaaaaaattaaccggccatggtggaactcacctgtggtcccagctacttgggaggctgaggttgggaaatggcttgagcctgaaggaggttgcagtgagctaagatcacgccattgctctccagcctaagcgacacagcaagaccttctctcaaaataaaatcaaatatatgaaaacagaataactcaaagtacaaaaatccattttgttgatataggtccacaaaataataaaacagagactcgcaagaaactacatgctaataaaaaaaagttgtcattttccccagatcttttctttcttcctttttttttttttttttttttttttagacagggtctcgttctgtcgcccaggctgcagtgcagtaatgcaatcttggttcactgcaacctctgccttctgggttcaagtggttctcctgcctcagccacagagtagctgggattaccggtgcccaccaccatgcccggctaacttctgtatttttagtaaagatggggtttcaccatgttggccaggcttgtcttgaactcctgagctcaggtgacccaccaacctcagcttcccaaagtgctaggattacagacatgagtcaccacatccagcaaattttcaaaatatatacatatatgtgtgccaatgtgtacgtatatgtatgtgtgtgtgtgtgtgtatatatatatataaagatttttaaaatataaaaagtagcaagttttgtttaactgaagaggaatctcatcttgctggaaacggatactttgatagttggggacagggaggaatcttgtcagatctaagaaaacaggaaatgtcccctcctagaggaagcaatcaccctttcaactgcctgacatggaggaatctttagatatctgtaggaatgcaggcatgctcagatgcagccactatggcactctttatacagagaaaaattgcaaaggacccacatactgtcattcagccaatttccaatgcagatgtcaaagagcaagctagccatgtttactaacataacaacatgtaaattttcacaactagcaggatgaaatatcaaagtaaaatatttactaaaacacaaagaaaacaatagacgctggggtctaggtgagggtggagatggggaggagagaggagcagaaaaaatagctaatggggctgggcacagtggctcacgcctgtaatcccagcactttgctagggcaagggggttggatcacctgaggtcaggagttcaagatcagcctggccaacatggtgaaaccctgtctctactaaaagtacaaacattagccaggcatggaggcatgtgcttgtaatcccagctactcaggaggctgaggcaggagagttgcttgaacccaggaggcagaggttgcagtgagccgagatcatgccatcatactccagactcaaaaaacgagcaaaactcagtgtcaaaaaaaaaagaaaagaaaaaaagctactgggtactgggcttgataccggtgtacaacaaactccaatgacatgagtttgcctatgtaacaaaccatcacatgtagccccaatcctaaagtaaaaacataactataaaacattttatttttttaatttactacggaattatttttaaagtctcataatgatgcagaaatacaggtgtacaagacttgctctgacacttggcacagaactgacagtagcggctccccagtgagtttggaaagagggtggaggacgtgacagggaaaggagatgctttgtggcaaagggtctgcagctttgctaagagttttactagaaaacaaatatatccatcctgtgatgtttaaatatcaaaatatatatttaataaacattggtagagctgagcacggtggctcgtgcctgtaatcccagcactctgggaggctgaggtgggtggataacctgaggtcagaactttgaggccaccctggccaacatggtgaaaccccatctctactaaaaatacaaaaaaattagccgggcgtggtggcacacgcctataaccccagctacttgggaggctgaggcaggagaatcacttgaacccagaagacagaggttgcagtaaactgagatcatgtcactgcactccagcttgggtggcagaggctgactccatctcaaaaaataaattgtaaccatttttaccaaaaacacctgtttcacaagcctctccacagtaaccccacagtctccatgagcttaatgtgttaagaatggtttaatgaatctcctgctattatttaggttgatttcctattcttaaactaatgatggaataaaacaccttctatcattcatgtctgtgtatgaactttccactctaattagttcgatttttggagccagaaacacaataactcactcaattacctaaaaatgtagtatgaaagtgaagcggtgggttgcccctccacacctgtgggtgtttctcgttaggtggaatgagagacttggaaaagaaaaagacacagagacaaagtgtagagaaagaaataagggggcccaggggaccagggttcagcatatggaggatcccgccagcctctgagttcccttcatatttattgatcattttggggtgtttctcagagagggggatgtggcagggtcataggataatagtggagagaaggtcagcagataaacacgtgaacaaaggtctctgcatcatagacaaggtaaaaaatcaagtgctgtgctttagatatgcatacacataaacatctcaatgccttacagagcagtattgctgcccgcatgtcccacctccagccctaaggtggttttcccctatctcagtagatggaacatacaatcgggttttataccgagacattccattgcccagggacgggcaggagacggatgccttcctcttgtctcaattgcaagaggcgtgccttcctcttatactaatcctcctcagcacagaccctttacgggtgtcgggctgggagacggtcaggtctttcccttcccatgaggccatatttcagactatcacatggggagaaaccttggacaatacctggctttcctaggcagaggtccctgcggccttccgcagtgtttgtgtctctgggtacttaagattagggagtggtgatgactcttaaggagcatgctgccttcaagcgtctgtttaacaaagcacatcttgcaccgcccttaatccatttaaccctgagtggacacagcacatgtttcagagagcatggggttgggggtaaggtcatagattaacagcatctcaaggcagaagaatttgtcttagtacagaacaaaatggagtctcctatgtctacttctttctacacagacacagtaacaatctgatctctctttcttttccccacatgaaagcaggcagaaaagattttcacttattggtttccttttctagaatttaccacgtactttgtgcacattaatacgtgacttccattggcagctgctctaatcctgctccacagagagctgacagtgcatccatatgtggcccctgaacaatcccttctgcccaacagcactgacaccacgggaccctcaccccgtctccatccatgtctgggtgtgagcccttcccaggcccatgcccagtgcagcctctttccaacttcatgtcactaggtcaccagagatggaatctaagcgagatgagagggactgagggaaggcatgggtgagtgtgagtaaacgtatcaggcaggaagcttcagactcagagaagattcccaactccaaggcccagggtttctgaaaggaaggagacagaacaatccaccgagaatatcatctcacctgaggaagagccatccctgactcctttgctttcctcttcctcttccgggtttcttcctcatgtaccaagagtctttaggagtcaatcctgaatgttaaaaatatgttgtttgttgctcagaatcaacacaccccctccctggaacacaaccacacatgcgaagtgtcacgcacgtctgtgggaagaggccaccaaacacgctttgtgtgagcaacgaggctgtttatttcacctgggtgcagccgggctgagtctggaaagagagtcagcaaagtgtggtgggattatcattagttctcataggttttgggacaggcggtggagttaggggcaatgctttgcaggcagggggtggatctcaccaagtccattctcaagggtggggaggattacaaagagccttctgaagggtgggggagattacaaagcacattgatcagtcagggtagggcagaaacaaatcacaatattggaatgtcatcagttaaggatatttttacagttgcttcaggctatctggatgtatacgtgcaggtcacaggggatatgatggcttagcttgggctcagaggcctaactaaagacctcaccctgaggaaatagtgccccctgctgccctcctcaccatggatgataaactcctacagggaaactcccgctccccttctggaggagtccacacacaagctgcagcagtggggagctgggctggaatgagctccccttcagggcacagacccagccctgacgaaaccccacgcagaggctgggtgcggtggctcatgcctgtcatcccagcactctaggaggctgtggcaggtagatcgcttgaactcaggagtttgagaacagcctgagcaacatggtgaaaccccatctctaccaaaaatacaaaacttcgccaggtatggtggtgcacgtctgtgtgtctgtggtcccagctacttaggaggcataggtgggaggatcacttgacctgaggagtttgagagcagcctggccaacatggtgaaaccctgtatctactaaaaatacaaaaatgggccgggcgtgtgggtcatccggtaatcctagcactctggaaggccgaggtgtgctgattacttgaggtcaggagatcgagaccagcctggccaacatggtgaaacgctgtctctactaaatacacaaaaagtagccgggcttggtaagtgtctgtaatctctgctattcaggagactgaggtaggagaattgcttgaacccgggaggtggaggtcgcagtgagccgagatggcgccactacactccagtcttggtgacagacagactcaaaaataatataaaatggaagttaaaatacaaaaattagccgggtgtggtggcagacacaccagctacttgggaggctgaggcaccagaattgcttgaacccagcagacagaggttgcagtgagccaagatcaagaggctgcactcataggctgaaagatagagtgactctgtctcaaaaaaaaaaaaaaaaaaaaaatgcatttctgatgtgattgatgcagacaatgaatcctgagtaacgtgatacagactgatggacaagggaactacagccgggggtgggagggcatgggcgacagctctgagcctagacctgaaggaggagaaagtgacagggtacgtagggtaaaaccagggacaacgacctgagacaggaagggttttgatgtttgggaaaagagaaaagcaaatatgactggggcggagagagtcatgagatgagggcaagctcccaggaggaggctggacagtggaaggggccctggacacagggctgtggagccacagtgaggggttgggcttttgtcctggggaacacgggaagctggtggagggttccctgtcagggactgacatgacctgctttagattttgttgtgatgtcctcatacagagaaaggccccgaagatggtctctgtgtctgagtctacctctgtttcttccattcttctgcttttgtttttcatttttagggcactgcatcccattgaaaattctaatcacaactgggcactcctctcctcaaaaaaatttaaaaaaaaagccacacccacacacgcactccattttgtcaatcatttcaggggtcaaagtcactagggttgagcttttctggtgtagcccctcatcgccaagttccaaggaggctcactggggctcagattggaagacattttcaccaagttgccctgagaaggtctgagatgagtgaggtgtgcctgaattcttacatgggggcctgcagggactaatgggaagggttgatcttatcacccccatcctggaaaattagagaaggctctttcacaaacctgggctaaagaaatttcttttgccgggcacggtggctcaagcctgtaatcccagcactttgggaggctgaggcgggtggatcacctgaggtcaggagtttgaggccagcctgaccaacacggagaaaccccgtctctataaaaatacaaaattagctaggagtggtagtgcatgcctctaatcccaggtacttgggaggctaaggaaggagaatcacttgaacccgggagacggaggttgcagtgagccgagatcgtgccactgcactcaagcctgggggacaagagcgaaactccgtctccaaaaaaaaaaaagaaaagaaaaaaaagaaacaaacttcttttgcaaggttctgaggccattgactcctgacagtttgttcttccttacaagaaaatcacagtaacatttataaaatgcagagttgtgaacacatagctattgaccttggaaacagggaaagaaggtcaggtgtacaactaagacataagcaaattgtttcaatcaagaatacatgagtggtcaggcacggtggctcacgcctgtaatcccagcactttgggaggtcgaggtgggcagatcaccagaagtcagtagtttgagaccagcctggccaacacagtgagagcctgtctctactgacaatgcaaaaacctagccaggagtggtggagggcacctgtaatcccaactacttggtaggctgaggcaggagaatcacttgaacccaggaggcagacgttgtagtgacaccagatcgcaccattgcagtccagcctgggcaacaagagcaaaactccatctcaaaaaaaaacccccaaaaaaacaaaaagaaaaacaaaaaaaaaaccgaggctgggagcagtggctcacacctgtaatctcatcacattgggaggccaagtcgggtggatcacaaggtcaggatttgagaccagcctgacaaacgtgatgaaaccccgtctctactaaaaatacaaaaattagccaggcatgctggtgggtgcctgtaattccagctactcaggagactgaggcaggagcatcacttgatcccaggaggcagaggttgcagtgagctgagattgcaccactgccctccatccaaggcgacagagcaagattccatttcaaaaaagaaaagaaaagaatacacgggtgcttttggaggagcgttctatgccaatccagcccatgtttcaacatttttccagaatggaccagagggccttgagggaaacacgcaataaatagctcccagatcaagattttaacaaaggacataaggaaagaaaactgaaaaacagactaactggttaaagtacattttgatgtttagttaaaaggccactgacatatttaccaagtacacactgaaacaatcaaacttaagtttaggtaccaaaggttttcaataaataacaaagactagaaagcatgcagacattgatatgaactggatgcaactaatttaaaacagcaactattttgaaattgttttttaaaaaaatctaacgaattctggggtcaaccggaaaataactggaaaatatacaagtacagaaacgaatgatgtgagctgattataggatgctgcaaaggcatctttcagaagtcattatgtattaagaaatacaacttttataacttagatttatctcaaactcaaactgcaaaataaataaataaataaataaaaaataaagagagaaatgaagaggaaccagaaagaaaaagaaggaagtccattatacgagaagaaaagcatttttgaggtctttttttgttattttttgtttgtttgagatggagactcactctgccacccaggctgcagtatagtggcacaattttggttcactgcaacttctacctcctaggtttaagcaattctcatgccccagcctcccaagtagctggaactaaaggtgcacaccaacacccccggctaacttttgtatttttagtagagatggggtttcaccatgttagggtgcttttgaaattgtgaccttaggtgaccagttcacatgggtcgaccaaagtactctgattgcagggatgagccaccacgtaccgaggctttgatatccttttttttttttttttttttgagatagactctcactctgtcgcccaggctggagcccagtggtgcgatctcgactccctgcaagctccgcctcacaggttcatgccattctcctgcctcagcatctggagtagctgggactacaggcgccagccaccatgcccagctaattttttgtatttttagtagagacagggattcaccctgttagccaggaaagtctcgatctcctgaccccgtgatctgcctgcctcggcctcccaaagtgctgggattataggcatgagcctccgtgcctggcctcatatcccttttaaaaattactatgatatatccctttcaaaaagtactaactgaaaaaagtactatctctttaaaaagtactggctcaaaaaaataatagaaaataagaaacaaaaaacaggctgagaaaagtggctcacatctgttggccatgctggtttcaaactcctgacctcaagtgacctatgtgccttggcctcccgacgtgctgggattacaggtcggagccaccacacctggccccatcctcttaacataaacacttgaatgtcaataaaggcttgaactcaatgttaagtcaacacaaactcaagtcaatgctgaattgactccaatgtcaattaatgcttgatggtttgctatactcatttcattgggaacggttatctcaaaaatgaattttctgatgttctgcatggagtgatcttggactgaagaccttgccacactgatgacatttgtaagatttctgtccagtatagattctctgatgtctaatgacgtgtgaacgtgaagcaaaggctttgccacaatcatcacacttgtgaggtttctctcctgtataaattctcctatgttttgcataggatgaagcttgactgaagaccttggcacagtcatgacatttgtaaggtttctctccagtatgagttcaccgatgacctgcaatatgtgaacgatctctgaaaaatttgccacatttattacacttgtaagatctctcttcattatggattctccaatgatttgtaatcgttgtagcattactgaagactttgtgacaatcattacattagtcaagtttccctacaccatgaattgcctgatggtgaataagtgttgactgcttgccaaaggctttgccacactcattacacttgtaaggtttctctccagtgtgaagtccagtatgttgttccaggtgtgaatcactcccaagtcttgtcagaaaccttacatttgtaagctttctctccagtataaattctcctatgtctttaaggtgtgatttccaaatggaaactttgtcacatgcttcacatttctaaggtttctctccagtatgaattctatgatgacgtgaaaggtgtgattgttgattaaaagccttcccacattcattacacttgtaaggtttctctgcagtgtgaattctggtatgtcttgacaggagtgaattacgcacgaaagccttgtcacaaattgtacatttgtaagatttctctccagtatgaagtctacgatggtatataagggatgagcagtgacggaaggtattgccacactcattacacttgtaaggtttctcaccactatgaagtctacgatggcaatgaagggatgacctgcgactgaaggtcttgctgcactcattacacttgtaaggtttctcaccactatgaactctatgatggcatacaaggtatgacctgtgactgaaggtcttgctgcactcattacacttgtaaggtttctctccactatgaattctagtatgttttgccagataggaatgacacgcaaaagccttgtcacaaaccttacatttgtatggtttctctccagtatgacctatcttatgtgtctcaaggcttgatttacgactgaaaaccttttcacattcatcacatttgtaaggttgctccccagtatgaattgacttatgaattaaaagatctgaattttgaccaaaggtcttcccacattcattacacttgtaaggtttttctccacagtcaattctagtatgttttgccagttgtgaactccacacaaaagccttgtcacaaaccttacatttgtaagatttctctccaccatgaagtctatgatggcatacaagggatgacttgtgactgaaggtcttgccacactcattacatttataagttttctttgcagtatgaattcttctatgtcgagccagctgtgaatgccacgtgaaagctgtgtcacaaaccttacatctgtatggtttctctccagtatgaattctcttatgtgtctcaatggttgatttccgactgaaaactttgtcacattcttcacatttgtaaggtttctctccagtatgaattctatgatgtgaaagttgtgattgttgattaaaagccttgtcacattcattacacttgtaaggattttctccagtatcaattgccttatcaattagaagggctgaattttgaccaaagatcttgccacactcattacaattgtaacgttttactccagtatgaagtctacgatggcaggtaagggatgactcctgactgaaggtcttgccacactctttacacttgtaaggtttctcaacagtgtgacatctatcatggcatgcaaggtattgctcgtgattaaagagcttgccacatacatcacatttatattgtttgtctcctaaatggggtatctggtgtttccttaagagtgagctacaattaaaggctttgccactcttattacattggaaagatttttctctcatgtgtacttcctgtttttgtgggagtaatgaagaattcaggggattattcccatagttattagaaatctgggtttggggcctacaggaaattctttggaatgttgaaactgagggagcatcattagtagacttctcaagttgattaccaatttcacctttgatctgaaatatgtggagttcaggcagatgtgaataaaagcttgatccaagctgatctttaataggcttgtttccagcatgcctgtgatcatgttggtctgtgctaccagtcaacttttttatttttgtcatgggtgcttcaaggccatttctttcatcttcttgacactgaaactcaatgtcatgaatttctttctcaatttcctggaagcaaaaatctccaatgtgatgactttcatgtctttgcaatgtccctgtgtggatcacttctgtattgccttgccctgttgacaagacctccttcatcatgcatttggaagagatatctacaaaatataaacaccaatacatttccaattaagtacagatggtaaatcacactgaagtgcataaatatgacacaaaaaacgatacttattttgaacttcccaaacatcatcttcaaagtttaggaaaacgaaaggagcaatattctttagtaaataaagggtgattacatgtccttcaagacaattctatgaaagcctatttcctatgtcatgacaaaacactgacagggcacaaacatgtgtaagcctaaagtaaggagtatttttccactgtgaccctgaactgtatcacaatttgcaaaaagcatatcaccatcacatcggtgaagagaaaaatatatactcttcatatttaaagcatatttactctatacaaataaatgctaaaaaaaaaaaaaaaactccccacacaacatactatattggtaaataatccacaacaagctcatgtaaggataaccaaaagcaatggaaattccgtattgtcaaacaattatagcactgagaagataagaaaagattacaaaaattagccaggtatggtggcccatgcctgtagtcacagctattcaggaggctgaagcacaagaatcacttaaacctgggaggtagaggttgcagtgagccaggatcacaccactgcactccagcctgggtgacaaagtgagactctacctaaaaaaaaaaaaaaaaagttaatagaatatttttctgaataaatgtcataaaattacctataagaacaggcactttgtgacttttcaaaaattttttgtatttttatttttttgagatggagtcttgcactccagcttggagtgccatggtgccatctcagctcactgcagcctctgcctcctgggttgaagtgattctcctgcctcagcttccagagtagcttggactacaggcatgcaccactatgcctggctaatttttgtgtttttagtaaagatggggaccatattggccaggctggtctcaaactcctgacctcaagtaatccacccacctcggcctcccaaagttctgggattacaggtgtgagccactgcacctggtggcactttgtgacattaacgaatagtgcatgtcagttatattgcataccacataccgaaaagccatatgcaaaattataaaaattaattaataaaatattgtaacccaagataaaaccagcaagcaaataagtacatttatacagcctgcagaattctaaacaactccctcttaagaaaaaagccacaacttctactcaaccaccagcacacaatataagaactgaaatacatgttaagatcactaccttctgatgtatgaggccaagaaaatacacagcattaggccaggcgccttggctcaagcctgtaatcccaccactttgggaggccgagtcagacggatcacgaggtcaggagattgagaccatcctggctaacacagtgaaaccccgtctctactaaaaaaatacaaaaacattagctgggcatgatggctggtgcctgtagtccaagctactctggaagctgaggcaggagaatggcatgaacctggaagatggagactgcagtgagcccagatcgcgccactgcactctagcctgggtgacagagcgagactctgtctcaaaaatgaaataaaataaagaaaatacacagcatcttaagaaataagaattggctaatggctgggcacggtggctcacacgtgtaatcccagtactttggcaggccaaggcatgtggatcatgaggtcaggagttcaagaacagcctgaccaacatggggaaaccccatcctacgaagaatacaaaaaaatcagctgggcctggtggagggcgcctataatctcagctactttggaggctgaggcaaaagaatcatttgaactcaggaggtggagggtgcagtgagctgagatcgcaccattgcactccagcctgggtgacagggcaagactccgtctcaaaaaaaaataaacaaaggaagaaagaattgactaatagtatagaaaagtgtaattatgatgtcacaactacacttatgtaacagccaggcaatacagcaattttatatatatgcattccccatagttatctagttcactatgcataaaatataaaacatagaatgtgtactaggaaaatttattaactgagatcagagaaaacattgtataaaacaaattgcacaataagaacaaaaaatatgatgtatgttccctggcccgaatgttcgcattggctaaaagccactatcagatttcttattccccaataggatgttcctgcagttggggtcttttagagagttttgtaatgggtgttgactaattatgaatagcactagggcttttaattgtattttttctttctttttttctttctctctttactatttatttttatttatttattttttgagagggagtatcactgtgtagcccagcctggagtgcggtggtgcaatcttggctcactgcaacctctgcctcccgggttcaagcgattctcctgcctcagccttcagagtagctaggactacaggcatgcaccaccatgcccagataatttttatatttttagtagagaaggggtttcaccatgttggccaggatggtctcaatcttttgacctcatgatccgccctcctcgcctcccaaagtgctgggattacaggcgtgagccaccatgcccggactctttatttatttttgagacagaatttcgctcttgttgcccaggctggagtgcaatagcgtgatctaggatcaccacaaccaccgcctcgcaggttcaagcgattctcctgcctcagccacccgagtagctgggattacaggcatgtgccaccactcccggctaattttgtagttttagtagagatgtggtttctccatgttggtcaggctggtctcaaactcccggcctcatgtgatttggctgtctcagcctcccaaagtgctgggattgcaggcgtgagccaccatgcccggcaaagactagtgcttttataaaaagagacagtaaagagctcattgcctgctcctctttacaccacatcaggacacggcaggaagacggctgggctaaaccatgaagaaggctctcaccaggagccaatctagctgacatcttgttcttggatttcccactttccagattcatgagcaacaaatttctatgtcttaagctttccagtttcagctatttctttttttgtctgtttttgagactgagtaatgcttcatcacccaggctggagtgcagtggcacgattctcctacctaaagagattctcatgcctcagcctcttgagtagcagggagtacagacacatgccaccatgcctggctaattttttttttttttttttttgggaaacagaatctaactctgtcacccgggatggagtaagtggtgcaatcatggctcactgcaacatccaactccaaggttcaagtgattctcatgtctcagcctcacgagaagctgggattacaggttcataccaacacacccagctaacttttgtatttttactagagatggggtttcaccatgttggccaggctggtctagaacttctgacctcaagtgatccacccgtctcggcctcccaaaatattgggataataggtgtgagacatcatgcccgtccaatgttttttaatttagtaggttcaagttttcattatgtttgcccgactggtctcaaactcctgacctcaagccatctacccacctcagcctttcaaagtgctggaattagaggccaaagccactgcggctggccagtctaagctatttctaacaggacagtgaaaagagtgagacaggaaagggggcatctcatcatcaacattactgagggctgacaaatattattaaacaaaggaagttgagtgtgtactataaaacttatatgaagccatctaatagtactcatttgttttaaaaagcaggtggatgaatcactagtagaaactccatctctgctaaaaatacagaaattagccaggctcgcaccaggcataatcccagctacttgggggattatgtcctgaggcaggacaatcacttgaacccaagaagtggaggttgcagtgagccgagactgcaccactgcagtccagcctgggcaacaagagggaaactccatttaaaaaaaaaaaaaaaaaggccaggcacagtggctcatgcctgtaatcccagtactttcggaggctgaggcaggtagatcacttgaggtcaggagttcgagaccagcctggccaacatggtgaaacccccatctctactaaaaatacaaaacttgccaggcgtggtggcacttgcctgtaatcccagcttctcgggaggctgaggcaggagaaccatttgaatccgggaggtggaggttgcggtgaactcagattgtgccattgcacttcagcctgggaaacaggagcaaaactctttctcaaacaaaacaaaactaaacaaaaaacaaaaaaaaaaaccaaccctggaggcaaattaacattatttctcaaataatgacagcaggcccacagtgttcatgtacatgaccccagtttgcacgtacggtaagtgagggacaagacttgatcctgggcatgaaggatcccacgacatgttcttaggcacaatagtcagcgcaggcaggacaggaaatgaccagacacagaaaatatgaggagaacagaaagaagtacatcaagggggatacaaggactgagctgggacacaagcgctgagctgcgctgctgacagtggttctgaagccatccctcatggatcatgtgctgagtcatgatgtcctgcacacactgatttaagcggcctcctataattttgtccagtggatgaacaaggtcttcacttactcagggagagtagtgttggaggggaggggctcacggggaaattggggtgttcacttttacaaagtcaataggctggtatttgcatccagatcaatgtatcatgtgagtcaaggccaggaaaggaagggcaagggtggacggcaggaagtaatgggcatgtaggagtgaactttgtgcatgcacctctgtgggaatataattccaccaagatagaccaaatcttgagcttagaggaaagtggaactaatttagcaaatggtaacatattgacccaaggttaaatatgcaaattacaatatgggcaagggacaagaatgaaagagatccaacaatgcagcagtacggtggcctgaggtgaaagcagttttacatctcttaaattgaatgcctctgacttctagtttcaggcatgtactcaacaaaatcctctgtgtagattccagaaatgcatacaaacacacacacaaaaaaacaactaaactccatgaagagtacagtagagcaatgtaggagaccatgggggtgaacaaggatcccctggctgagtaggtagagatgtgtttgtgaaaacagagccaggctgagtgcagtggcttacttctgtaatcccagctcattaggaagacgggtgggtggatcatgttgtcaggagttcaagactagcctggccagcatgcatggtgaaacactgtctctactaaaaaaaaaaaaaaaaaaaaaaaaaaaaaaacattggccgggcatggtgatgcacatctatgaccccagctacttaggaggctgaggtagcagattgcttgaacccaggaggcagaggttgcagtaagctgagattgcaccactgcactccagcatgggtgacagagcaatactccgtctgaaaaaaaaaaaaagaaagaaactgtacctttaatagacatatggttttgccacattgtctaggctggtctcgaattcctgacctcaggtgattcacccacgcacttccaaagtgctgggattactggcatgtgcgacttcacccagctgacattatttattatagtaaagagaagaaaccaacccagatgtccattgacagataaatatacgaacaaaatgtggtacacacatacagtggaatattattcagccttaaaaacaaactcggaaggggccaggggctgtggctcatgcctgtaatcccagcactttgggaatccaaggcaactgaatcacgtcaggccaggctatcaaaatcagcctggccaacatggcaaaactgccatctgtaatagaactaccaaaaattagtcgggtgtggtgacacatgcctgtaatcccagccactcaagaggctgaggcaggagagtcgcttgaacccaaaaggaggaggttgcagtgagccaagatcatgccactgcactcaagcctgggcaacagagtgagactctgactcaaaacaaacaaacaaaaaaacaacaacatagaaatgaacaagttgaaagccactgtgtcttaaggaaatgacagtagaactaaacaatggaaacctcattcaacctcaaaagcttcctcaataagattgatgaaaaccatatctcttacagggttgatcctacaacaaactgaacataggttttcttgttaaaaatgaacagtgacacatattggtgtgaaaaatgtgacatgaacaagagttcagtcaagagcctcatacatatgaggctgtgagcccgaatgatgtcctcgctgggaggaattgcaacaccactgactgctgcttagagaagatgatcattagtttatgggatgaacattgtcacagtgccagtgagagacgcttctgtgatgctcctcaaaaaccagaatgagctgggcatggtggctcacgcctgtaatcccagcactttgggaggccgaggtgggtggatcacctgaggtcgggagttagagacgagcctgaccaacatggagaaaccccatctctactaaaaatacaaaattagctgggtgtggtctcgcatgcctataataacagctactcaggaggctgaggcaggagaatcacttgatcctgaggggcggaggttatggtgagccaagatcataccattgcactccagcctcggcaataggagcgaaacaccatctcaaaaacaaaaaacaaaaaacaaaacccatgtatggggcaaaatcacaaaagaggatacaaagccaggatgagccaagatagacaagagcagactcctcatgtctgcagggacattttcctcacccacagcctccaggttcctgtagttctccaacatcacttccctgtacaaagccctctgtgaagggttcaggcatttccactctgccaatgagaattctatagccacatcccggaaagtcaagcgtccctaaaatgaaacacacatttcaacaaaacattatggagtaatgagttatcaccttcacagaaaatgagaaatgagaaaataagtatttatttgatcaaagattatgttctgacaaaaggatgttaaggtatttttgaatattttttccctatagttgcgttttattgtagttttccttgaaagattttaagatcccataagtcactacggaaatctcgattttatggacaatataaaaactataaaaataaaaaggaaaaacagggccaggcatggcagttcacgcttgtaatcccaacacttcaggaggccaaggcgggcagattatttgcggtcaagagttcgagaccagcctggccaatgtggtgaaaaactgtctctcctaaaaatataaaaattagccgggcatggtagaaggcacctgtaatcccagctacacaggaggctgaggcaggagaatcacttgaacccgggagatggaggctgcagtgagccaagttcgcaccactgccctccatcctgggcaacagactgacactccatctcaaaaaacaaaacaaaacaaaacaaaaaaacaatgccgggcagtgactgtcacctgtaatcccagcactttgggagaccaagacgggcagataatgtggtcaagagattgagaccatcctggtcaacatggcaaaaccatgtctctactaaaaatacaaatattagctgggtgttgtggtgcaggcctgtactcccagatactcaagaggctgaggcaggaggatcgcttgaatccgggaggcggaggttgcagtgagccaagatcgcaccactgcactttagcctggcaacagagcaagactccatctcacacacacaaaaacaaaacaaaacaaaacaaaaaaacaaatacagggttttctctatagacatgccagatattatgttcaacataccgggtgatattaagtctctagatgagctaagatacatgtggtgcttcagagaggacaaagtccaatggctttcaaagaaaagtccaaatctaaaaactggcacagtggctcatgcctgtaatcccagcactttgggaggctgaggtgggcggatcacaaggtcaggagttcgagaccagcctgggaacatgctgaaaccccttctctactaaaagtacaaaaattagctgggcgtggtggtaggtgcctgtaatccccaatactggggaggctgaggctggagaattgcttgaaaccaggaggcagaggttgcagtgagctgataccatgccggatacaaaatctctctccttattattctccttttccagaattaaccacacatctgtgcacattaacatatgtatttcatatgtagtttctctgagctgacatccagatgtggcccgtgaacaacccaggctgcccagcagcactgacatcaacgggctcacaccccatgtttatccatgtcagggtgtgagcccttcccaggaccatgcccagtggagcctcttcccaagttcatgtcactgggtcacaggagatggaatctcagagcagctgagaggaactgagggcaggcatgggtgagtgcgagtgaacgtgtcagacaagatgcttcagactcagaaaagactggctgctacaatacctggcatttcagaaacgaaagacacagattaatccacagaggaatatcacttcacctgaggaagagccatgcctggctcctttcctttcctcttctgagctgcttcctcacgtaacatgagtctttaggaatcaatcctgtatgtgaaaaaaaatgagacttcatgttagaaatgactcactcccttcctgtgacaaaaacacacgaacgggggagacgtcaccctgtagaaagaagtcccccactgcccactgcaccagagatcatgcagagataaggaagtcccacaggaagacctatgagtgtatatttgaccccagtcttcagatctcacctctctcctggagaagccaccacacacgaggcagcagtggggagctgggctggactgatctccccttcagggcacagactcatccttcatcaattgccatccagaggacagcccctcacctctctgtggatcacaggctgaggtcagccctcagaaatgcaggactcagagcttccatgctcaatgctgcacacagatgacaagcacctgggccactgcaggtattactgagggtgggttccatcccgtcagaataagaatccctgctaaagtggcacaaaagctctatttgcaaaatgcctcgactctaacgtgaagccagggttgagctccactcagagggggcgagcccagcacagccccatgttctggctctgccctccccttggggccttgttctcaccaggatccagacagtggatgacaaaggcacaaaaataatcacacagaacaggcaatgtggagaaggggtagggtgagggttgggctgtgtgtaaggaaaataaatcttggggccccaaatcactaagcaaaagggaaaagtcaagctgggaactgcaagggaaccagactccccttctattcaaagtcatccctctgctccctgacacagatgcatatctgagtgcctccttcaaaagactaattagaaactcaaaagaaggacccagcacagtggctcaggactgtaatcccagcactgtgggaggccaaggcagtcagaccacttggggtgaagaggtagggactagcccagccaacatggtgaaaccacatctctactaaaaatacaaaactgatccgggcatctacttgggaagctgaggcaggagaatcacttgaacccaggaggcagaggttgcagtgagccgagattgtgccactgcactccagcctgggggacaaaacgagacttcatctcaaaaaaaaaaaaggaaactcaaaagactgcaaccatttgtgcctcagttctctgtgaactaaaagccccttccctgcttcaagtcttcctgcctttatttaaagttgtcccactttcccagaccaaaccaacgtacttcttacatatgttgatgtctcatgtctccataaaatgtataaaattaagctctgccccgactatcttgggcaaaataaactttctaaattaactcagatctgtgtaagattttctggttttacagtggcaatgtcaaatgggagatcacaaaggaaacccggagaagatgataccagaacaaggacctagaaaagaaaggctgcttgtcacttgcagctgaggggaagagagtcctaggcagagggacagctcaagtgaaggccctgagacaggagcaacctcagccccaggaataggaaagcagcctgtgtggctggaacagtggaagagaggagggcacaagtaggagatgaggagaaaaatgttcaaaatatacacaactgtgcacacacagcaataggtgtttaaaacactgaaaaagaggcagctgtagaaatgggatctgagcaaatgcttttctcatgaacacatgggctctgctaaaccaaggttccaagtcaatccagcccatccttcaacatctgtagagaatattatggaccagagggaattgagggagacacttacttagaagctcacagatcaccattttttcagatgatatgaggaaagaaaatggaataggctacttgaactaaattttcatgttagggtaaggaaaaaaggtccttgatatctttatcaagtacacactgaaacaacctaaaattatatatcacgtagtagaaaacgttttcgatatatgataaagactagaaagcacacagacctcaatgtaaactgaacacaatctcatagagaaacaattttaaaatggttaaaaaatatagatctaatgaaatcttgggtcaaaggagaaatatttgaaaatataccatactttgaaaacaatgaggccaggcatggtgacacgcctataatcccagcactttgggaggccagggcatgatcacaaggttaggagttcgagaccagcctggccaacatggagaaaccatgtctctactaaaaatacaaaaattagcaggaaatggttgtgcacacctgtcgccccagctactctggaggctgaggcaggagaatcccttaaccccaggagatgaaggttgcagtgagacgagatcatgccactgcacaccagcctgggtgacagagtctcaataaataaaaatatatatctaaacattagccaggcctggtggggcgtgcctgtggtcccagggaatccagaggctgaggtgggaaaatcacttgagcccaggaggttgccgctgcactgagctgtgatcctgccactgcactccagcctggacagcagtaagagtgtctcaaaaaaacagaaattaaaggcccggcagctgctcatgcctgtaatcccagcaccttgggaggctgaggtgggaggatcacctgaggtcaggaattcaagaccagcctgaccaagatggagaaaccccatctctactaaaaatacaaaattagccggccatggtggtgcgtgcctctaatcataactactcaggaggctgaggcaggagaatcacttgaactccagaggcgaactttgcagtgaaccaagatcatgccattgcactacagcctgggcaacaagagcaaaactcagtcaaaaaacaaacaaacaaacaaaaaacaaaaaacccgacaacaacaaaaataagtaaattaaaagtaaacttaaaaaatgaaaagcaactaatgaggcaaagcatggtggctcacacctgtaatcccagcactttgggaggccaaggcgggtggatcacggggtcatgagttcaagagcagtctggccaagatggtgaacctctgtctctgctaaaaataaaaagtcagacaggtgtggtggcagctgcctataatcccagctgcttgggaggctgaggcagagcattgcttgaacccgggaggtggaggttgcagtgagtcaagatcactccactgcactccagcttgcctgacagagaaagactccatctcaaaaagaaaaaataaatgaataaaaacacacaaaaaaaccaaccacatgaatgaaatgaagaggaactagaaaaaaggaaaccaattacaaaaagagaacaaaagcacttttaatactcctttcatcacgttccatatagtaacagagactcagtcacttcttaccctacttctctcccccactccccaccccagccatgaaaagggaagagggtgatccacaactaacgagtcaagtcactgtcctctggctgaagaggggttgcagagggaagctgcctctgatgccatcattataaaatgcaccacacttagacacaggagtttggcaactctcattctcatctgtataatttaaactaattttaaatttgttaccttataaacagagaaagcaacatgtcatcacttcatcatcacatccaatcaactcaccgctcatctgcacccagggtcccccttcatcttcattactgttccatcattctatacatagctctttctcaccttctctctccatctgtttcttttctgcatttccccctggacttctgctcattttatgcccctctcctgttttgcttcattcttttttgttttgttttgttttttagtatttattgatcattcttgggtgtttctcagagagggggatgtggcagggtcatacgacaatagtggagagaaggtcagcagataaacacgtgaatgaaggtctctggttttcctaggcagaggtccctgcggccttccgcagtgtttgtctccctgggtacttgagattagggagtggtgatgacttttaaggagcatgctgcctttaagcatctgtttaacaaagcacatcttgcaccgcccttaatccatttatttaaccctgagttgacacagcacgtttcagagagcacggggttgggggtagggttacacattaacagcatctcaaggcagaagaatttttcttagtacagaacaaaatagagtctcctatgtctacttctttctacacagacacagtaacaatctgatctctcttgcttttctccacatttcccccttttcttttcgacaaaaccgccatcgtcatcatggccagttctcaataagctgttgggtacacctgcagaaaggctgtcacttcacacttggaagattgcacagcggccaggcagaggcgccccccacctccccgacggggcggccgggcagaggcgctccccacttcccagatggggcggccgggcagaggcactcctcacttcccagaaggggcggttgctggacagaggcgctcctcacctcccagatggggcggccgggcagaggcgctcctcacctcccagatggggcggccgggcagaggcgctcctcacctcccagatggggcagccgggcagaggcgctcctcacttcccagacggggcagctgctgggcagaggcgctcctcacctcccagacggggcagccgggcagaggtgctcctcacatctcagacggggcggctgctgggcagaggcgctccccacctcccagatggcgtggccgggcagaggcactcctcacatcccagacggggtggccaggcagaggtgctccccacttccccgatggggtggcggctgggcagaggtgctcctcacttcccagatggggcggccgggcagagatgctcctcacttctcagatggggtggctgggcagaggcgttcctcacctcccagacagggtcgcagtcaggcagaggcgctcctcacatcccagacggggcggccgggcagaggcactcctcacttcccagacggggaggccaggcagcggtgctcctcacttcccagacggggcggccaggcagaggcgctcctcacttcccagacagggcagccgagcagaggggctcctcacttcctagacggggcggccaggaagagacgctcctcacttcccaaacggggtggtggctgggcagaggcgctcctcacttcctagatgggatggcggccgtgcagaggtgctcctcatttcccagactgggcagccgggcagagaggctcctcacatctcagacaatgggtggccaggcagagacgctcctcacttcctagatggggtggtggccgggcagaggctataatctcagcactttgggaggccaaggcaggcggctgggaggtggaggttgtagcaagccaagatcacgccactgcactctagcctgggcaacattgagcactgagtgagcaagactccgtctgcaatcccggcacctcgggaggccaaggcgggcaaatcactggaggtcaggggttggagaccagcccggccaacatggcgaaaccccgtctccaccaaaaatacaaaaaccagtcaggcttggtggcttgtgactgcaatcccaggcactcagcaggctgaggcaggagaatcaggcagggaggttgcagcgagcccagatcacggcagtactgtccagcctcggcaacagagggagaccgtggaaagtgagaggggaaagggagagagggagggagagggagaggcagaggcagagggagagggagagggaaagggagagggagagagagagggagagggagagcttttttttgttttttgagatggagtttcgctcttgttgcccacactgaagtgcaatgatgcgatctcagctcaccacaacctctgcctcctgggttcaagtgactctcctgcctcagcctcctaatccaaaattatcagggcacggtggcccatgcctgtaatcccagctactcagggggtagtatcgcaggagaatcgcttcaaccctaaaggcagagatactcattagccaagattgtgccattgcactccagcctgggcaacaagagcaaaactccactgcaaaataataataataataattagtatgtaggccaggtgcggtggctcatccctataatcccagtacattgcaaggccaagacaggaggaacctttgagcccaggattttcagtccagcctgggaaacatactgaaaccgtttctacaaaaaaaataaaataaaataaaaaataaataaataactagccgggcttggtgtctcacacctgtggtctcagctactcaggagactgagggaggaggatcacttgagcctaagaggtcgaggctgcagttagagtagataacgccattgtactccagcctgggcaatagggccagaccctgtctcaaaatattaattaattaattaattaattaaaagtattatgtaataacagaaagttgtttttttctttttccccacatcactgccccactttctaccccaccctgggaaaagggaagaaactgactcacaactgagtaagtcactgccctcgggctgaatagggattccaagtggaagctaacctctgacaccaagatttatagaatgtacatgactcacataggaattttaaaattctcaaactcatctgtataatttaaacaagttattagattatatacacagaagtcaacatgtcacaactaatcatatccaatgaactcacacactcatctgtatccaaagtcccccaccctttttttcttttaaaacagggtcttgctcttttcaccaggctggagtacagtggcatgatctctgctcacagcagcctggacctcctgggctcaagtgatcctccagcctctgcctacagagtagctgaaattacaggtgcacattatcatgcctggtttttgttttcgtttttttttttttttttttgatagagatgggggcaatgactattttgcccaggctggtcttgaactcctggattcaagcaatctctctgtcccagtctcctaaagtgctgggattacaggcatgagccactgcgcctggcccctctttcttcattactgtgcttccctccctaattctgtgcatatctctcattctccccttctctttctagctcttgttttcttttctttttccctgggattgtgctccttattttgtacctctctcctctcctgcaatttatccccttcttccctctattgcttctcttccacctcttctgctccatcctcacaacttatttaaccttttttttttttttttttttgagacggagtttccatcttgttgcccaggctggagtgcaatggtgcgatcttggctcactgcaacctccgcctcccaggttcaagcaattctccttcctcagacttcctagtagctggcattacaggcatgtgcaaccgtgcctgccttattttgtatttttagtagagacggggtttctccatgttggtcaggctgctctcaaactctggacctcaggtgatccgcccacctcagcctcccaaagtgctgggattataggcatgagccacagcgtctggtccttattgaagggggccagcccctccacacctgtgagtatttctcatcaggtgagatgagagactgagaaaagaaataagacagagacaacgtatagagaaagaacagtgggctcagaggaccagcactcagcatacggaggatccgcaccagccgaggtctctgagttccctcaatatttattgatcactatctctaccatctcagagagggggatgtggaaggactgtagggtaatggtggggagaaggtcagcaggaaatcatgtaagcaaagctctctgtgtcataaataagtttaaggaaagatgctgtacctcgatgtgcatgtagggtagatttatgtttgactttacacaaacatctcagtgcagtaaacagcagtattgccaccagcatgtctcacctacagccataaggcagttttctcctatctctgtaaacagaacatacgattgggttttacaccaagatattccattcccagggaggagcaggagacagaggccttcctcttatctcaactgcaaagagggctatctctttcactaaccgtcctcagcacagaccctttacgggtgtctggctgggggatggtcaggtctttcccttcccacgaggccatatctcaggctgtctcagtggagagaaaccttggacaatacccaggctttcttgggcagaggtccctgcggccttccacagtgtattctgtcccagggtactcgagactggagaatggcgatgacttttaccaagcatactgcctgcaaacacattttaacaaagcacagcctgcacagccctaaatccattaaaccttgggtcaacacagcacatgtttctgtgagcacagggttgcggctagggttacagattaacagcatctcaaagcagactaatttctcttagtacagaccaaaatggggtttcttatgtctacttctttctacatagacacagtaacagtctgatctctcttttttttccccaaaccttatttaacctcttgttgctccttctccccaatctttcaatcgtcctcaatctctatatattaccgcctcttctcttatctctccatctcctctgctctccctgttaaattctctcttccctgttacagcccccagtccccactctctagcaccccagatccccaggtgtcctccctgctgtggttctccctctggtctccgtgccaccagcaccactctgctctgtctgccctggctccaaatccctcctcctctccctcactctggtgagcctccctctttgctgcccctctccctatcttgtccttcatctctgtacatctagctcttctctacatttctccagttgcttttctcctcctgctttcttattttttctttcacttttgctgtctcttggcaaatttctcacccatcctctactttgccatctgttacgggcctttctcattcttcttttctctgtctctggttttctactgctctctcagtccctctctctatctcctcatctctttgacccaaacaatcacacgcgggtttggagtaagaggcctacatcctggagaagcgcattttccaggaggtggagctgggcaggcaagaacacccggtgtcataggacaaggccctgggacctccccaacgctggctcaggggaagcggtgactgcggagggaagacttggggagcagcagggcccggcacgaggagggacatagtgggagacggcgccttaagacatgggtggcacctgcaggctcccaggaccaggcagaggacccagcctccccaggactggggccccggcgctgcgctccaggggaggccgacgggggctgggaggcgcccagggcgggaatccagcgcacgggtgaggactttaaaaagcaaggggcaggatgagtcaacaaggttttgagcaggaaaactatgcgataggaagtgtatacattgccctatagcagaaagaccggggacgggaccagcctccaagcgacttcaaacccaaaaggaagcaacttccagactcttatgggcgtctcaatttgctctgggtgaaggaagacaggcaagaatttccaggtctgtgaggaccccacgtcccagggacagaagtgccagggacctgggaagtgcagacttaatacaaggcagagcaaaactcacgcgcctcggtaggacctttactccacgtgatccacttccgggtttgctgcgcaggacagaagccagtcccgggtggggcccccgaacatggtggcggggcctgggtgggacagaggcggggcgcgaggcggagagaccttgccctttagaacaggcaaagggcggggccgggaccagacctgtgcatctctccgcctcgcacccagcgcctctgtttttcgggtgtttggaggtgagagcggccaggaaggctgaggcatgatacaaaagccctggaattatctggaacgggaatgcaaactagaatgtgaaatgcaaagccctgcctgggcggaacatacgatttcatgctgatggcccacagaacagaacagaactcctctccctttctattctccattcactcaggagggagagtccaccctgtgctcagcttcagagacttccctagagcctttgcttgggatgcgggactgggtgctcaggccagggaggagtgaggtcaccacctgctgcctaaacgcagcagggatgcgggcgtgaggccggaagcctgaggtcccagctactcaggaagcagcggcgggagaatcgctgaacctgggggtccaggccagcctgggcgacaaagtaacaccccctcccgcagtgctctcttcattgtctctctcgcgcgctctttttcttttctttcctttttatttatttttattttttgagacggagtcttgctctgtcacccaggctggagtgcagtggcatgattttggctcactgcaagctccacctcccgggttcacgccattctcctgcctgagagttgagtaactgggactacaggtgcccgccacgatgcccggctacttttttgtatttttagtagagaaggggtttcactgtgttagccaggatggtctcgatctcctgaccccgtgatccacctgcctcagcctcgcaaagtgctgggattacaggtgtgagccaccatgctcggccttgtgtttttttttttttttttctttttaaacaaaatttttcatggtgtgacacagggatccaacattattcttttcaatgtggatatccagttagttgtcccgcacgtttgtgaaagagatcaattactttctctttttttacttttttctttccttttacttttgagacagagtatttctctgtggcccgtgctggggtgcagttgtgagatcatggcccactgcagcctctgcctcctgggttgaagctattcgtctgcctcagcctttggagtagctggtattacaagcgcacatgaccatgcccagctaacttttgtatttttggtagagatggggtttcaccatgttggccaggctggtctagaactcctgacttcaagtgatccgcctgccttggcctcccaaagtgctgggattacactcgtgagtcactgtgcctggcccaggaaatattctttacttcactttttaaatgtgagaaaatataattgagaaacaaagagtcttgccccaaatgagaaatcatctccacgatgataatagagaaagaaagaataactattttattaataaataagctttagaccagaatgtgatgggaaataaaggcaaacagctaagaggttgaaaagagagaaagaaacgtcactgttactatacaacccatttagtacatgttttcaagataaacactaatcagtcctcagggaagaggacttgaaaagcccttggtcacacatagttcatcctggctctacttggtaatggaggtgaccatctctgtcagctaactagcttcatcccgaggcagggggagaaaccctaacactaaccctaacacaaaaattagctggacgtggtggcaggcgcctgtaatttttctgtatttttagtagagacagagtttcaccaagctggccaggctggtttcgaactcctgacctcaagtgatctgcccaccttggcatatcaatgtattgggattacaggcttgagccaccagggtcagccaggaaaaactcttagaagttgcacctgcattccgctagactctgcttgcatgaccacattcctctcaaggctcagaattatttacaggtccatagctttaaatttgaatcatttgatgtttgaattatttaatttcctactgagacacaggtactatctatcttgttgtgtgccttttttttttttttttttttgagacggagtctcgctttgttgcccaggctgcagtgcagtggtgcaatctcagctcactgcaacctctgcctcccaggttcaagcaattctgcctcagcctcctgagtagctgggactacaagcatgtgccaccacacccggctaatttttttgaatttttagtagagacaggttttcaccatgttggtcaggtggtcttgaactcctgacctcgggattggccaggcttggcctcccaaagtggtgggattacaggcgtgagccactgcacctggccgttgtttgcctgtcaaagtgagctcccaagttcttcagaaatacatccctgggccgggcgtggtgggtcacgcctgtaatcccaggactctggaaggccgaggctggaggatcatctgaaatcagaagttcaagaccagcctggccaacatggtgaaaccccatctctacaaaactataaaaatcagccaggcattacagcgggtgcctgtagtcccagctacttgggaggctgaggcaggagaatcacatgtacccgagagacagaaattgcagtgagccgagatcgcaccatttaactccagcctgggcaacaagagtgaaactccatgtccgagaaagaaaagaaaagagaaagaaagaatactaccctcagaaaacagaaaatgcatttgcaaattttctaaataaatctcctaagaaaagaaatgaaaggaaagaaaatctctttctttattttcaaaggaggaattaaacctctcatttacttccttgtctgtttgagatagggtgtagctcactcacccaagctggagtgtggtggcaaaaacagggctcactgcagccttcaactccctggctcaagtgatcctcccacctttttcatcaagcatttggaagagatatctacaaaatataaacaccaatacgtttccaattaagtccagacggtaaatcatactgaaatgtgtaaatatgacacaataaacaatacttactttaaacttcccaaacataatcttcaaagtttaggaacataaaaggagtaagattctttaataaataaagggagattacatgtccttcaaatcatttctatggaagcctatttccaataccatgacaaaacactgacagggcaccaacatgtgtaagcctaaagtaaggactgtttttccactgtgaccctaaagtgcatcacagtttgcaaaaaacatatcactgtcacattaatgaaaagtatatattcttcatatttacagaatatcttctgtatacaaataaatgctaaaggaccacaaaatatactatactggtaaataatccacaacaagctcatgtaagggtaaccaaaatcaatggaaatgctgtattgtcaaataatcatagcacaaagaagataagaaaagattacaaaattagccaggcatggtggcttgcgcctgcagtcccagctactcaggagactgaggcacaaggatcgcttgaacctgggagggaaaggttgcagggagccaagattgcgccactgcattccagcctgggtgacagagcgagactccatctcaaaaaaaaaaaaaaaaaaaaaaaaaagaaaagaaagaaaaagaaaacaatgttaatacaatatttttctgaatacctgtcataaaattacctataaccacacagaacaggcacttattgaaattaacaagtgcagtgtatcagttatattacatatcacatactgaaaagccatatgtgaaatcttaaatattagtcagtaaactattgtaacccatgataaaaccagcaagcaaataagtacatttatataggctgcagaattctaaacaattccctcttaagaaaaaagccacaacttttgcttatcaccagcacacaatataagaattgaaatacgtgttaagatcactatcttctgatgtatgagttcaagtaaatacacagcattataaggaataagaactgactaaccatgtcggagggtgcaattatgatgtcacaggtacagctgcatatcaccaggcaatacagcaattttgtatatatgcattgtccttcgttatctagtcaactgtgcaaaaaatatagaaagtgtactgggaaaatttatcaactgagatcacagaaaacattgtataaaacaaattgcacaataaaaccataaaaaacatgatgtaggccgggcgcggtggctcaagcctgtaatcccagcactttgggattccgaggcgggcggatgacgaggtcaggagatcgagaccatcctggctaacatggtgaaaccccatctctactaaaaatacaaaaattagccgggcatagtggcgggtgcctgtagtctcagctactcgggaggctgaggcaggagaatggcatgaacccgggaggtggaggttgcagtgagccgagattgcatcactgcactccagcctgggcgacagagccagactccgtctcaaaaaaaaaaaaaaaaaaaaaaaaaaaaaaaaacatgatgtaggctccttggtctgaaagattatattggccaaaagcgatgttcagagttgtgtccaataggatgttcctgcagatggggcctgtgagagaatttggtcatgggtgttgactacacatgaataggtctagtgcttttatttttattatttatttatttgtttactttttgagacggagtttccctcttgttgcccaggctggagtgcaatgtcacgatcttggctcaccgcaaactttgcctcctgggttcaagcaattctcctgcctcagcctcctgagtagctgggattacaggcatgcaccatcacacccagctaattttgtatttttagtagagacggggtttctctattttggtcaggctggtctcgaaccacctacctcaggtgattcacccgcatcagccttccaaagtgctgggattacaagtgtgagcccccgcacacagccaagactactgcttttataaagagagacattaaagagctgattgttatttctttttgtttgtttgttttttgagaccaagtcacgctctatcactcaggctggagtgtagtggcatgattctcctgcctcagcctcccaagtagatgggactacagatgcatgccaccacccctggctatttttttttgggggtgggggagacagagtctcactctgtcacccaggctggagtgccgtggtgcgatcgtggctcactgcaacctctgcctcccagctgggtccaaataattctcctgcctcagcctccagagtagctgaaattagaggcgtgtgccaccacgctcagctaatttttgtatttttggtagatacagggtttcatcatgtaggccaggctggtctcaaactcctgaccttaagtgatttgctcccaaagtgctaggattacaggcatgagccaccacgcctggctttgatgttcctttctttttctttatttttttttcagacggactctagctctgttgcccaggctggcatgcagtggcgcaatctcggctcactgcaacgtctgcctcccgggttcaaacaaacctctgcctcctgagtaggtgggattacaggagtctgccatcactaccggctaatttttgtatttttttttttgtagagatggggtttcactctgttggccaggctggtatcgaactcctgacctcgtgatccacccaccttggcttcccaaagtgctgggattacaggcttgagccaccgtgccctgatgtcccttttgaaaactactatgggctaggcgtggtggcttacgcccgtaatcccagcactttgggaggccgaggcaggtggatcacctcaggtcgggagttagagaccagcctggatcaacatgaagaaaccctgtctctactaaaaacacaaaattagccgagcgtggtggtgcatgcctgtaatcccagctattcaggaggctgaggcagtagaatcgcttgatgctaggaagccaaggttgtggtgagctgagatcatgccatcgcactccagccttggcaacaagagcaaaattccctctcaaaaaaagaaaaaaaaatggccgggcgggtggctcacgcctgtaatcccagcactttgggaggctgaggcgggcggatcacgaggtcaggagattgagaccatcctggctaacacggtgaaatcctgtctctactaataatacaaaaaattagctggtagtggtgacaggagcctgtactcccagctactccggaggctgaggcaggagaatggcgtgaacccgggaggcggagcttgcagtgagctgagatcgtgccactgcactccagcctgggtgacagagcaaaactccatctcaaaaaagaaaaaagaaaacagaataactcacagtattgagttattctgaataactcacagtattgagttattctgaataactcacagtattgagttattctgaataactcacagtattgagttattctgaataactcacagtattgagttattctgaataactcacagtattgagttattcagaataactcacagtattgagttattcagaataactcacagtattgagttattcagaataactcacagtattgagttattcagaataactcacagtattgagttattcagaataactcacagtattgagttattctgaataactcacagtattgagttattgagttattcagaataactcaatgtattgagggctaagtaggccagacacggtggctcctccctgtaatcccacccgtaatcccagtaatttgggaggccaaggcaggaggatcctttgagcccaggattttgagaccagcctaggaaacatagtgaaactccgtttctacaaaaaaaaaaaaaaatacaaaaactagccgggcttggtggctcatgcctctggtctcagctactcagaaggctgaggaaggaggatggcttgaacttaagaggtcgaggctgcagttagaggagatcacgccactgcacaccagcctgggtgatagagtcagaccctgtctcaaaatattaattaattaattaattaaatgtattttgtaacaacagacagtgactattttcccacttcactgacccacgtcctaccccatcctaggaaaaggggagacagtgattcacaactgaataagtgactgccctctggcaaatagggattccaagtggaacataacctctgatgccaagatttatagaatgtacatgtcttatagatacgaattttaaaattctcaatctcatctgtgtaatttaaacaagtttttagttattagattatatatacagaactcaacatgtcacaaccaatcatatccaatgaactcacccactcatctgaacccagtctctcgcccctttttttttgtttggagacaaggtctcgctctgacgaccaggctgcagtgtagtcacatgatctcagctcactgcagcctggacctcctgggctcaagtcatcctcccagcttggccaccagagcagctgggagtacaggtgcacaccattatgcccggttatttacttacttttttggcgggggggaggtctcactatgttgcccaagctggtctcgaactcctggactcaagcaatccccttgcctcagtctcctaaagtgtggagactacagactacaggcgtgagccactgtgtccagaccctctttcttcattactgtgcttccctccctaattctgtacatatctctcattctccccttctctctctagctcttgttttcttttctttttccctgggattctgctcttcattttgtacccctctcctctcctgctattcatccccttcttccctttattccttctcttccacctcttctcctccatcctcacaacttatttaacctcttattgctccttctccccaatctttcaatcgtcctcaatctccatctatttctgcctcttctcccatctctgcgcctcctctgctctccctgttaaattccatcttccccgatatactcccttgtccccactctgtgtctccccagatcccagctgtcctctctgctgtggttctccctctgttctccttgacacaagcaccactctgctctgtctgccctggctccaaatccttccctctctccctcactctgatgagtctccctctttgctgccactccccctaccttgtgatccttcatctctctgtacatctatctagcctttctctacatttctccggttgcttttctcctcctgctttcttaggtttttttttttttttttcacttctgccatctcttggcatatccctcaccaatcctctattttgccatctgttatgggcctttcttattcttcttttctctgcctcaggttttctactgctctctgtctcctgattcctttggcccacacaatcgcaacacggtttggagtaagacgcctgcatcccggaggagcgcattttccacgccctggagctccgcaggcaagaataccccgtgccgcaggacaggcccctgggacctccccagtgcaggttcaatgaaagcggtgactgcggaggggagacctggggagcagcaggccccggcatgaggaggaaggtgcggggcggggggggggggcgcgacggcgccttaggaccaggatggggtctgcaggatcccaggacctggcagaggactcggcctccccgggactggggctgcggcgcggcgctcccggggctgaggagggggaggctgggaggcgccctgggcaagaatccacatcgcgggtgaagactttaaaaagcgcggggcgcgaggagtcagaacaaggttttcagcaggaaaactacgcaacagaaagtgtatacattgacctatagcagaaagaccggggacgagaccagcctcaggacgactttaaacccaaaaggaagcgaccctcgggctctcacggggatgtctcaatttgctctgggcaaaggaagacgccggagaatttccaggtctgtggggaccccacgtcccagggacagaagccctgggaacctagttagcgcagacttaatacaacacagagcaaaactcaccgcggcgatatgacctacactccacccgatccgcttccgggtttgcgttaatctgcgcgcgcaggacaaaagccaggcctgggcgggaagtgggaggtaggcggggcctgggcgaggtaggggcggggcgcgaggcggagagaccttgccttttagaaccggcagagggcagggccggggcgggatctgcgcgtctctcagcctcgctcccagcgtctctgttttcaggttttggaggcgagagcgccagaaagtctgaggcatgatacaaaagccctgttgagagaagagagagaccctctgacattgttttatattgttttatagtcagtaaaaacaacaggaagtaaaaccaaagacaggcagccccgcgccaggcccgaaaccaggcctggatccgcctggcctaaacccagtagttaaaaatcaacttatgatttagaagctgatgttaggcatagattccagacattgtatagaagaacacggtgaaactcctgccctgttctctctctccctgatcaccggtgcatgcagcccctgtcacgtatcccttgcttgctcaatcagtcactatcctttcatctgaaatctttagtgttgtgagcccttaaaagggacagaaattgtgcactcggggagcttggattttaaggcagtagcttgccaatgctcccagctgaataaagcccttccttctacaactcggtgtctgagaggttttgtctgcgactcgtcctgctacactgtaattgtctggaacagggatacaaactagaatgtgaaatgcaaagccctgcctgggcggtatgtaccatgtcatgctgaggtcccacagaacagatagatatcctctccctttctattgtccattcactccggaaggagactccgccctgtgctcagcttcagagacttccctgaagccaccgcctggaatgccggacggagtgctcaggccgagaaggagtgaggtcaccacctgctgcttaaagacagcagaggcgcgggggcgggagcctgaggtcccagctactcaggaagcagcggcgggaggatccctgagcctcgggttccaagccagcctgagcgacaaaataacgcccactgccgcggtctccctttcttgtctctctctctctctttttttttaaaaaaaactttcgcaaataaaatttttgattgtgtgacatagggatccaacattattcttttccatgtggatatccagatagttgtcctagcacatttatggaagagatctattactttcttgtattattattattattattattattattattattatttttgagacagagtatttctctgttgcccaggctggagtgcagtggcgagatctcgactaaatgcatcctctgcctcctgggttcaagcgattctcctgccccagccttgggaacagctggcattacaggcgtgcgccaccatgccaggctaatttttgtatttttagtagagacggggttgaccatgttgaccaggccggtatcggactcctcactccaagttatttgcctgcctcagcctcctaaagtgctggggttacggcgtgagccaacatgcctggctaattttttgtatttttagtagagatgggatttcatcgagttagccaggacggtctctatctcctgaccttgtgatccgcccgcgtcggcctcccaaagtgctgggattacaggcgtgagccaccgcgcccggccagaaatattctttttttttttttttttttttttaaacggagtctcactctgtcgcccaggctggagtgcagtggcgcaatctcgactcactgcaagctccgcctcccgggttcacgccattctcctgcctcagcctccggagtagctgggaccacaggctcccgctaccacgcctggctaatttttttgggtttttttttttttgtatttttttttagtagagacggtgtttcaccatgttggccaggatggtctcgatctctagacctcgtgatccacccgcctccgcctcccaaactgctgagattacaggcgtgagccaccgtgccatgccgcagaaatattctttgcttcgctttttaaatgttgacaaaatataactgaaaactaaaaagtctcctcccaaatgagaaatcatctccacgacgataacagagaaagaaataaaaaccattttattaataaataaaccttagaccagaatgtgatgggaaatagaggcaaacagctaaaagattgaaaagagagaaagaaacttcactgttctatacaacccattaaggacatattttcaagataaatactaatcagtcctcaaggaagaggacttgacaacacccttggtcacacatagttcatcctggctctacttggtaatggaggtgaccatctgtgtcagctaactagcgtcatcctgagggagggggagaaactctaacccatgtctttttggcaagtgtgagttttacaacatggcgacaggtgccctctctggtgaggctcctaccatacgacagacactgatgtcagcagtaaataataaaatttaaagtatatgattaagtacagagttaatgtgaacacagagcttgaagaaagccacctggaaacatcaactccaaatgaatgggatcagcgttcccaagtagagacgttaaggtttcacacacagggaaagacagagaagctttagcagaatcaccacactttccattcaagaccagtgcacaggctgcagcaacttgactggtgatgatttgatacacttcaaggaaagttactttatcattacataagaagggacaatgctctgaggaggtcttatcactggggctctgtagtcttcctaatttttttattgttattgttatttatttatttattttgagatggagtctcgctctgtcaccaggctggagtgcagtggtgcaatctcggctcactgcaacctccgactccctggttcaagtaattctcgtggctcagcctcccgaatagatggtactacaggcaagcaccaacatgcccagctgatttttgtattttttttagggatgagatttcaccatgttggccagtataatctctatctcttgacctcgtgatctgccagaatcagtctcccaaagtgctgggatgacaggcgtgacccactgttcacggccagttttccaaattatttacagaaaaactcctagaagttgcgcctgcattcctctgaactcaggttgcatgaccacattcctctcaaggctcagaattatttaaaggtccatggctttaaattggaatcacttgatatttgaattacttaatttcctactgagacacaagtgctatctctgttgtttgcctttcagacagagctcccaagtccttcggaaatacattcctgggtcattaagctaaaaagcggtttagttagtttctaaaaaaattccatttctgtccgagcgcggtggctcacgcctgtaatcccagcactttgggaggcagaggcgggcggatcgcctgaggtcgtagtttgaggccagcctgaccaacatggaaaaaacccttctctattaaaaatacgaaattaactgggcatggtggcacatgcctgcaatcccagctactcgggaagctgaggcaggagaatctcttgaacctgggagacagaggatgccgcgagcggagatcacgccattccactccagcgtgggctacaagagcgaaactccatctcaaaaaaaaaaaaatactgtttcagaagacagagaaaattcatttacacattttctaaataaatgtcctaagaaaagagtctacaggaaagaaaatctcttactttattttcgaaggaggaattatgcctctcacttatttgcttgtttgtttgagacagggtccagctctgtcatccaggttagagtgtgctagtgagatcagggatcagtgcagcgtccaactccctggctcaagtgatgtttcaatctcagtgcccaaagcagccgagaacacaggtgtgcaccaccacacctggctgagtttttttatttttagtagagacgaggtctcactatgttgctcaggctgatcacacactcctgggctcaagcaatcctccggcattggcctctcaaagtgctgggatgacaggtgtgacccaccgctcggagttctggctttatttccatgaaataagaaattttcttccaccttctgtgtataataggcagttctatatgtcacctttctactttcattatccgctcaaacaacccaggaccttgcttggtttactaagccattcaaattatcagtccccgttgtaagcagcgccccactccacccctttaccgaggtacctgcccctgtaccccaacctgtcccagcctgaggggagcttgccccgcctgcaggacgcgcgactccacctgctcaaaaaaggcactttgccttaaaaccattttcaacttgggagaaaaaacgattcagcattcagtacaaaatggcccactaccaaatgttattttaccttcgattgtttgaaatgttaactgaaaacgggcaggaagcctccctgtgatattaggggtaatatgacggcacatcagaaacaatccaccaatcagaacccgggggatcgagtgctggagatcaagaggatgacagcaggccacatcatggacccagctgaggagagagccccgacgcatcgctgccaggccccgcccttaagaacaacaccccatttcaggccccgcctccaagaccagggtaaacctccggccccccagcaccgacccgctgtccagcctggcctccagcctcctccctcttgactcaccccaggccccgcccccaccttctaaccaggccccgcccccaaattgtggagtcaaatgcattagtaaatcagatacaaaatatctccccttattggtctctttttcagaatttaccggttatctgtgcacattaacatatatatttcacatgttatttctctgatctggtccacaaagagctgacatccagatgtggcccctgaaccatccaggctgcccagcagcactgacaccatggtgcccacaccccgtgtccatccatgtctgggtgtgagcccctcccaggaccatgcccagtggagcttcttaagaagttcttgtcactgggtcacaggagatggaatctcagagcagctgagaggaactgagggcaggcatgggtgagtgtgagtgaatgtgtcaggcaaaatgcttcagactcggaaaagactggctgctacaatacctggcatttcagaaaagaaagacacagattaatccacagaggaatatcacttcacctgaggaagagccagccctggctcctttcctttcctcttctgagctgcttcctcatgtaacattagtctttagaaatcaatcccgaatgtgaaaaatgaaaggggcctgccactccacacctgtggatatttctcgtcaggtggagacgagagactgagaaaacaaataagacacaaagacaaagtatagagaaagaacagtgggcccaaaggacaggcacactcagcatgcgaagacccgcaccagcgctggtctctgagttccctcagtatttattgatgactatttttactatcttggcaaggggagtgcagcagggcaacagggtgatggtggggagaaggtcagcagggaaacgtgagcaaaggaatctgtatcgtgaataagcttaaggaaatgtactgtgcctggattgtagggaaaagaaagagagatcagattgatactgtgtctatgtagaaaagggaactcgattttgatctgtactaagaaaaattgtttctgctttgagatgctgttaacctgtaactttagccccaaccctgtgctcacagaaacatgtgctgtattgaatcaaggtttaatggatttagggctgtgcaggatgtgccttgatttgttttgtttttcggaggtggagtctcattttgtcgtgctggctgcagtgcagtggcatgatctcggctcactgccacctctgccacctgggtcaagcgattctcctgcctcagcctcccgagtagccgggattacaggcaccggccactacgcccggctaatttttgtatttttagtagagacgggttttcaacatgttggtcaggctggtctcgaactcctgacccgcctcggcttcccaaagtgctgggattacaggcgtgagccaccatgcccggccaggatgtgccttgttaaccatgtttgcaggcagtatgcttggtaaaagtcatcgccattcgccattctcaattaaccagggagaaaatgcactgtggaaagccgcagggacctctgcccaagaaaccctgggttttgtccaaggtttacccccactgagacagcctgagatatggcctcatgggataggaaaggccttaccatctgccagcccacccataaagggtctgtgctgaggaggagtagtgaaagagggaggcctctttgcagttgagataagaggaaggcttctgtctcctgctcatccctgggaatggaatgtctcagtatagagctgaccattcccattcgttctattctgagataggagaaaaccgccctgtgggcgggggcgagatatgcgggcagcaataccgctctgttactctttcccacacggagatgtttgggtgaagagaaacataaatctagcctatgtgaacattggggcacagttcctttccttgaacttattcatgatacagattcctttgttcacatgtttccctgctgaccttctccccacctgttgccctgctacattcccctcactaagatagtaaaaataatgatcaataaacactgaggaaactcagagactgtgcgggtcctccgtatgctgagcgctggtcccctgggcccactgtactttccctatactttgtctctgtgtcttatttcttttctctgtctctcgtcccacctgatgagaaatactcacaggtgtggaggggctggcgcccttcactggatgtgcacgtaggccagatttatgtttcactttacacaaacatctcagcgtagcaaagagtcacagagcagtattgctgccagcatatctcacctccagccacagggcagttttctcctatctcagaatacaaagaatggtcagctttacacctagacattccattcccaggacgagcaggagacagatgccttcctcttatctcaattgaaaagaggcctccctctttcactaatcctcctcagcacagacccttcactggtgttgggctgggggatataaggtctttcctttcccacaagaccatatctcaggctgtctcagtgggtggaaaccttggacaatacccaggcttacttgggcagaggtccctgtggctttccgcagtgcattgtgtccctggttaatagagaatggagaatggcatgacttttacaaagcatactgcatgcaaaaatactgttaacaaggcacagcccacacagccctaaatccattaaaccttgattcaatacagcacatgtttccgtgagcacagggttggggctaaatttacagatttatagtatctcaaagcagaacagttttgcttcatacagatcaaaatggagtttcttatgtcttccttttctatatagacacagtaacaatctgatctctctttcttctccccacaaaaaaaaatatgagacttcatgttagaaatgactcattcccttcctggggcaaaaacccacagacaggagagatttcacccgtagaaagatggtcgtctgcttcccactgcaccagagatcatgcagagataagaaagtcccacaggaagacctacaagtgtatatttgacccaggtcttcagatctcactcccctcctagaaaacacccacatacgaggtaacgggggggcgggggggagctgggctggattgatctcccctcggcacagactcgtccctcatccctcatcaatccccatctggaggacagcccctcactctctgtggatcacaggctgagctcagcactcagaaatggaggacacagagcttccatgctcaatgctgcacacagatgacaagcacctgcgccactgcaggtattactgagggtgggttccaacccatcagaataagaatccctgctaaagcaacacaaaagctctatttgcaaaatgctctgcactctaatgtgaagccagggttgagctccactcagatggggcgagcccagcacagccccaagttcttgctccgccctccccttggggccttgtgctcactaggatccagagagtggatgacaaaggcacaaaagtaatcacacagaacaggcaagatagaccagaggtggtgtgagggttgggctgtgtgaaaggaaaataaatttggggaccccaaatcactaagcaaaagggaaaagtcaagctaggtactgcttagaaaaccagactcaccttctattcaaagtcaccactctgctccctgacatacatgcttatctgagtgcctcctttggcaacgctaatcagaaactcaaaagaaggacccagcacagtgcctcaggactgtaatcccagcactttgggaggccaaggcaggcagatcacttggggtgaagggttcaagactagcccggccaacatggtgaaacatctctactaaaaatacaaaagttatctgagcatggtggcatgcacctgtagtcccagctacttgggaagctgaggcaggagaatcacctgaatgcaggaggcagaggttggagtgagtcaagatcctgccattgcactccagcctgggccacagagcaagacttcatctcaaaagaaaaaaagaacctcaaaagatcgcaaccatttgtgcctcacttatctgtgacctggaagccccctccctgcttcaagttcaagtctccctggctttgtttaaagttgtcctgcctttccagaccaaaccaacgtacttgttactatattgactggtgtctccctaaagtgtataaaattaagctgtgccccgtccacctggggcacatgtcatcaggaattcctgaggctgtgccacgggtgtgtcctcaaccttggtgaaataaactttctaaattaactgagatctgtctgagaagtcctgggctcacagctgcaatgtcaaatgcggatctgtgtgagatcacaaaggtttccacacagaaggtgataccagaacaaacacctagggaagaaatgatgcttgtcacttgcagctgaggggacagagagtcctaggcagagggacagctcaagcaaaggccctgagacaggagcaatctcagccccaggaagaggaaagtggcccgtgtgggtggagcagtggaagaaaggagggcacagatagatgaggtcagagaggtcctgggggcacagatccatagggacaaggtcttcaaacatttttctcccacaacccaaaagaatattgaaaaccaactctgatcccagctattcgagaggctgaggcaggagaatcgcttgaacccgggaggtggaggttgcagtgagccgagatcgcaccactgcactccagcctgggccacagggcgagagtcagtctcaaaaacaaacaaacaaacaaacaaacaaactgagcactaacctctcgagaagaaaagccacacactgtattttgccagtcatttcaggggtcactgtcactgtgactgagcttttccagtcttattcctcacctctatgttaaggggggctcactgaggctcacaacgggagacatttcaccaagttatcctgagaagctctgaggtgagtagaaaataggtgtggctgactcccacgagatggcctggaagggccaataggctgccttggtcttcctcctctggaaaattgcaagatcagacgggagtcgtggcccagctgggtaatcccagcactttgggaagttgaggcaggcaggtcatttgagcccagaagtttgagaccaacatgggcaacaagggagtctggtttaataactatatttcctacaactagcatataagggggctttacacaactttgcaaaggaactgttagactggaatttaggtcgatagtataaaatggcttacgatctcttgtttctatagcttgatttccagaccaaattttaatgcggtatgaggccacagtaagactctataattttggatgttcaggaccagaaacagaacttattatctttgttcttggagtagagatttttttttctccccattcccaagggtagaaagacggcaattttttgtgcttatgtttggctaaactttttgttaagtcactgttaacagctggactcacttctgcactgggacatgactgagtttgtcctgtgcaattgtggtagaattgacctcgaggtgcccaatctataatagttccgaatttatcattttgtaatatcaccgcactattggccacacattcttcccaaactaaaacttttgtgtcttttgatcctttgggattttttgggggtaaggctttcctttaggcctaaattttaatgatctttgataagaaaagtcttgtaaataatttacctgtggcctgagtgacattccacttaccgcgtgattagtgaatctactggtggtaccgacagtaggtacttctaccaaccaatttttgactgcaggcattaaacatcctggtgctctcccgaggcaaataggaggataatgatacccagtggaaatatttatcatcattccttcttcctcaggtttggcagggcaacgatcatctgtggggccaggtacccatacactattattaacgtatacttcaataggattatccatccatgagactgcccgaattaagggcgggaaaggcacataggcccagtaggtataattagctgcagctgctcctgcaggcgtggggagacttaccaccgttgatacaatcatcaaagctgcaagcagcgtgttctctggagtttgtgtcacctttgtgttctctaggcttttttaagctaactgtgtcagcttttaaattgtgcccaagttggcatctccgccttcgtggtggatggcaacttcatctgtttttttgacatcaccattttgtttatcttgtgagtcaatggtgctcgattgcggtgtttccgtctctgtggaggcgcttttttttttgtttgtttgcatctctaatgggttcattgtagaactttaaatgtctagtgggtatctaaacaggaagctgattttctcctggtgaaacacaagcaaaacctctcccccacgttaccaccttccctatttctcatgtcttattgttgttgtctttttatcaaatcagttttccttcacgtaggctgttctttttaccagtaagatgttgttttgcagaggtagtagtctgatttctataagtgtttaaaacatttaaagtatagagtgctagattaagttgcatctgaggagtggtacactccttactgtctcccccttctctttaactgagttttgagtgttctattagtttttttaactatggcctgtccttgggaattatagggaattcctgttttgtgtgtaattttctactgatttcagaatttttggaaagctttactatagtatccaggtgcattgtcagttttgatttttttctggaactcccatgacagcaaaacaagataataaatgttttttcacatgggaagtactttctcctgtctggcaagttgcccacatgaaatgtgaataagtaccaactgttacacggacacatcataatcttttaaatgaaggtacatgtgtgacatctatttgccataatgcattaggacatagacttctgggattaactcctgcctcttgagtgggcaggtgtaggacttgacactgggtgcaatgttgtacaatatcttttgcctgttttcatgtgacatcaaatttgttttttaatcctgctgcatttacatgagtcaaagcatgaagttcttgtgcttttatgaatgcagatggtaccagtaagtcagcttgttcatttgctttagctaaaggccctggtaaattagtgtgtgctaaaatatgagtaatatgaaatgggaaatttttttttcagtttgttgtaataaactgaacagctcgtttaactgatcatctatgctatatttaattagagctgtctcaacatcccttgtagcctgcgctacatatgcagaatctgatacaatattaataggttgatcaaagtcttataacactgtaatgactgcaaccaactctgctctttgagccgattgatattgagttttgatgactcgctgttttggccctgtgtaagctgcttttctattgctggaagcatcagtaaacactgtcagagcattttccaaaggtttatgtctggtaattttaggtaaaatccaagtagtcaattttaaaaactggaagatttttgtttttgggtaatgattatcaataattcccacaaaattagtaagaccaatctgccatgcatcagaattgataaaggcttgtctaacctgttccttgtttaaaggaacaactattttgtctgcgtcattttcacacaattttattatttgtaatcttgcctgaccaattaatgtagctatttgatccaagaacaatgtaaaagtcttaattgtactgtgaggaaggaatgaccactccacaagatcagtattttgaacaatgatgtctgttggagaatgtgcagtagcaaaaatcaaaagttggagtggggttaagggacctttgtgctgactgatttttttcttttactaacttaattttttttgttgcctctggggttaatattcttttactatttaagtctgggtcccctcttaagatagagaacaaatttgacatggcataagtaggaatgcctagagttggctgaatgtaattaatatctcctagcaagttttgaaagtcatttaatgtttttaatgtgtcttttcttatttctactttttgtggcttaatttttctattttctatctgcatctctaaataatgaaaaggagtagaggtttgaatcttatcagatgctattgccagtcttgcgttggcaacctctgcttgcagaaatgtgtaacagtcagttaatttgtctcttgtttctgcagcacacaaaatatcatcaacataatgaatgatataacagtctgaaaacttatctctaactggttgaagagcttgacctacgaaagtctgacaaatagttggactattaagcattccctgaggtaacactttccactgagacctggtggctggttccttataatttatggctggtatagtaaaggcaaatttttcaaaatctttctccaccagaaaaatggtaaaaaagcaatcctttagatcaattataattaaaggccagtcttttgggatcatgaccagagaggacaacccgagttgaagaggccccatgggttgaatgatggcatttacggctcttaagtcagttaacatacaccatctgctggattttttctgaattacaaacacaggagaattctaaggagagaaagtgggtgaaacgtgtcctttttaagtagttttttaactattttatgtagcgcccccaaattttccttagggagcagccactgtttgactcagacaggatgctgcaaggcaagtctgaattgctccttcaccataatgaactgtaagttgggcaataatgggcacagcgagccaagttgcagtgagcctagtttcaggctccctcccccagcactcacttggctgaggaggaggtggccatcgtggttttagcccctatgaccccgatgattctggacctttttcttttaactttaatgtttcagaatatattacctcttgtaattgattgtagtcaacattttgctttgaccgacccattacagactctgctacatatttacaatgtgaactttccgttcctttctgggattctgtccctgtctcttcttcacaatctattacatagcttttagggccatcagaaactgaaacgctgtcttctcctgtttgaaacggttttaaagctgctttaataatggcccaatcattccataccataagtgggatgattttaccctccctacttctctgttttaattctttgccaattttttcccaatcttttagatctaaagttccctgttctggaaaccatgggcagaattgttctattgtttcaaatagcttgattagattttctgtagagactctaactcccccttttcttaaaagaattttaataaagctgagataagaggcatatttacttttagcttgtcccattgttaccctggcttttttcgagctcaggagcttaccgcaaggctgaccgtagaagtacttgggaatctctcgttgacttgtcctcaataaccacgctcaagcgtaggtttaccctagagaaaagccccacattagacaccaggtgaaggtggccagcccctctacacctgtgagtcttttttgtcaggtgggacgagagactgagaaaagaaataagacacagagacaaagtatagagaaagaacaaagtatagagaaaggaccggcgctcagcatatggaggtcctgcacaggcactggtctctgagattcctcactatttattgatcattatctctaccgtctcagagagggggatgtggcaggacaatagggtaatagtggggagagggtcagcaggaaaacatgtgaacaaagatctctgtgttatgaataagtttaaggaaaggtgctgtgttttgatgtgtacgtacacaaacatttcagtgcattaaatggtagtattgctgccagcatgttttacctctagccctaaggtggttttctcttatctcagtaaacagaacatacgatcaggttttacaccaagacattttatttttagggaggagcaggagacagatgccttcctcttatcttaactgcagaggccttcctcttttattaatcctcttcagcacagaccctttatgggagtcaggctgggggacagtcaggtctttcacttcccatgagacaatatctcaggctatcacatggggagaaaccttggacaatacctggttttctgaggcagaggtccctgcggccttccgcagtgtattgtgtccttgggtatttgagattagagaatggggatgacttttaccaagcatactgcctttaagcactttttaaacaaagcacatcctgcacagccctaaatccattaaaccttgagttgacacagcacatgtctctgcaagcacagggttggagctagggttacagattcacagcatctcaagacagaagaatttctattagtacagaacaaaatggagtctcttatgtctacttctttctacatagacacagtaacagtctgatttctctttcttttcccctcacttatcttttctaccatctgaccattttgttcagatctgctgaacatagtgtgaacgtgacacatagactgagaagtgcaattcaagctaaatatcccttaggggaccagtcaataatgattccatgggaatcattgtgcagcacctctgcctgttctgcaatgcaatcttgctaaacaaatacgttcattttttctaactgagtccaatcctgtttacaaataggtttttgggggttgtatgcctcaattacaggagcagatttattatggtaaatactgagatcagaaagcatgtgtaactgtgtcatacagtgatttacatccaggcattattaccagctaagattgataaatatgcctaataagtacaattgttctctgtgtcagcctttgttgaaggaatactcacagaaatggtgatcactgccatcatagctaccattaaattattcactgtgagtggttgtcctgctttcctcaggttgtcttcctggatctgtgacagcttcttgatctgtctccaggtcggtggctgtattcgatgggtgttgctcgtgacagttggggtcctcctcggcaccagccttgacatggctgcaaccgggggggtcctcaggatcctcccggaatctcttccttggcatctggcccatgacaagatttcaggtgtcttgatggtatccaaactgactgatgattttggcctggagaaacacaagcataacctctaccccaagttattattttacctatttcccaaatttttgttattggatctctctgccaaatcattcttctgcttctgtctttgcagctggtttctgtagatgctgttcagctgctgataacatctggcctttgggcaggctcaaaaaatttaaagttaataatgccagattcagttgctcctgtggtgttccatattctctgtctccccctttctgcttttgcaactgctgttttagggagagattcattctttccactatggcttgtccttgagaattgtacgggataccagtaatgtgtttaatattcctcatagagaaaaatgtagctagaacttggctagtatagcctggggcattatctgtttttatagaagcgggaatgcccatcaccacaaaacactgcaaaagatgacatttaacacaggcagaagactctcctgtttggcatgtaagcccagacaaagtgagaaaaggtgcccacacatacatgtacataagctagtctcccaaacgagggaacatgtgtgacatccatttgccaaaccgagttaggttccaatccttgaagattaactcctcctgtaaaagatgaggaatgtatcatttggcaagttgggcatcagtggataatatttttagcttctttccaggtaatgctgtatctgcatttgagaccagaggcattaacgtgggttaaatggtcaaaatgtctagcattagatattgcattagcaactaagtgatcagccatttgattcccttcagtcaaaggtcctagaagaggtgtatgagcccaaatgtgagtgatgcaaaaatggtgcattctacttctaactgctgtttgcaattgggtaaataaagtcatcagttgttcatctgtatgaaattgtaattgagcattttcaattaactgtgtggaatgaaccacgtatgaagaatcagaaatcacattaataggtatatcaaaagcagtcaataactcaattacagctactcagctttttgagctgaagtatagggcgtctgaaaactttactttttgagccaaactaagaagctttaccattactagacacatctgtgaaacaatgaaaacgcttagcaggctgcaggttgtttactgcaggaattgtaaatgcaaaccattcacagtcttgttcagctaaggggatagtaaagaaacagtcttttaaatctatgactactaaaggccaatttttggaattttagtaagagaaagcaatccttgctgtaatgctcccataggttatatagttgaattgatagctcttaagtcagttaacatcctccatttacctgattttttcttaattatgaaaactggagaattccaaggggaaactgttggagcaatatgcccattttctatctgttcagtaactaatttctctaaagcctccagtttctctttacttagtggccattgttctatccaaattggcttatctgtgaaccattttaaaggtataggttctggaggcttaacaatggccaccatcaaaaattatttcctaatctttggcgggaactttttaaaccttgcaaatttttttgtagtcccataccagggacataccccatttcatgcatcatatgttgactttgagggctatataattgttctggaattagaacttgggctctgcattgttgtaataaatctcttccccataaatttatagatacagaagttataattggttgaatagtctcgggttgtccatcgggcccttcacaaggcaaaacagaactactctgatatacttcaggggcttcaccaactccaactatgttaaattgagtgggttgaattggccacgtggacggccagtgctgtagagaaatgattgaaatgtccgctcttgtatctaccaaacctttaaatttctttccctgaatagttatttcacaggtaggacatttatcagtaatttggttgacccaataagctgctttgccttgtttatttgtgcttccaaatcctcctgttcgtttaatttcactttttcccatttccacatatggcacaatcaggagctgtgctatgggctctcctggctctgctttccaggaaacataagtaggtataacaatttgaatttccctattgtaatctgaatcaatgactcctgtatgtatttgtaccccttttaaacctaaactagactttcctaaaagtaatccgattgtacccgctggcaagggtccacagactcctgttgggaccttttgcgggggttccccaggtagaagtctcacagcttttatgcagcataaatctactgtggcactaccggctatggcgggggacagacattgtacaggggtgagggaatggtctgagctggaaatgcccccgtttagaatggggcccgggacaggcccctcatggcatttcccgaaatcgtattcccatctttatgaaacttagagggacactgattagcccaatgttttccttttttacattttggacatatttcaggatctgcagttttcttttttcccctatctggtggcctgattcgctgattttttctacatttgtttttagtatgaccatgcttcccacagttaaaacaagcgccaggaaatggagtatttcctttgtccactctcagtcctgccattgcctgtgccaacaaggcagctttatgcagattacctccgataccatcacaagccttgatataattaactaaatgtgctttccttctaataggtcacagagcagcgtggcaattgggattacagagcgagactccatctcaaaaaaagaaaaaaaaaaagcattgtcaaaacttaataactgcaacactatatcctgagcagctgaatctgcaatcatctttttaagagacttctgtaaccaagctataaaatcaacgtatggttctcttggtccctgtttcatagcactaaaggaagggtattgttctccacatgaagtgattttttcccaagctctaatgcacactcctctaagctgttctatggcatcatcctgcatgaccagttgggcacctaagccagcccagccaccaacccccaaaagttggtctgcagttacattaatttgaggttgggcctgggcattgcgagcagcctgaatggaagcttcatctgcccaccaagttttaaattgtaagaactgagcaggagttagataagctcaagtaagacagtcccagtcagtaggtatcatctgactggaaatagcaacattctttaacagtcccattacaaaaggagaacctggtccatactgatttataacttgtttaaattctttgagtaacttaaaaagaaaaggctcaaatatagttgtaatatttccctgttgatctggggggtgtattctaacagggaactgccaagtctctaaatcaccctctcttctagcttgctgaattcctgcctgaatagaactaagagcgattgcttgaggcactgatcaaacagtcactggggcaactccttttcacccagtgttctccagaaaagaaagatctggaaggtcattttcttcaaaataataatgagggggtgcagaaaggtagggatgaacctcttcctcttttgccgctttagctttagctggcaaataaacctgctctgtaacctcttctgtcacttcctcctcatcataactgtgaataagttccaaggtggaacgaaccagaccccacacctgtcccattgttaccctgaggcttctgagctcctcttgttactcaccacagggattgctttaagagtacttgggtgtcctccagctagttttccattccaactgtcgctccggtgacccttcaacctggattcgagcccccatgaaggtacgccacttgccgagaccagctcagtcagggagaccctaacccagtggtgctacaggaatgaaagacacacacacagaaagatagaggtgtgaagtaggaaatcaggggtctcacagccttcagagctgagagccccaaacagagatttacccacgcatttattaacagcaaaccagtcattagcattctttctatagatattaaattaactaaaagtattccttatgggaaacgaagggatgggccaaattaaacgaataggttgggcttcttaactgcagcaggagcatgtccttaaggcacagatctctcatgctattgtttgtggcttaagaatggctttaagtggttttccaccctgggctggccaggtgttccttgccctcattcccgtaaacccacaaccttccagcatgggcgttagggccattatgaacctgttacactgctacagagattttgtttttggggggcttgctcccaacaagtttggccttcccacctctatacagtccgataacggaccagcctttattaggcaaatcacccaagcagtttctcaggctcttggtattcagaggaaccttcatactctttaccgtcctcaatcttcagaaaaggcagaatggactaatggtcttttaaaaacacaccttaccaagctcagccaccaacttaaaaaggactggacaatacttttaccactttcgcttctcagaattagggcctgtccttgaaatgctacggggtacagcccatttgagctcctgtgtgaatgctcctttttattaggccccagtatcattccagacaccagagcaacttggactgtgccccaaaaaacttgtcatccctatcttctatctagtcatactcctattcacccttgtcaactactcataaatgccctgctcttctttacactgccagtttacactgtttctccaagccatcacagctggtatctcctggtgctatccccaaaccaccactcttaactcttaaagtaaataaataatctttgctggcaaggctatgctgaacctccttaggcactctctaattggatgtcctgggtcctcccaattcttagtcttttaatacctgtttttctccttctcttattctgtttagtttttcaattcatacaaaaccatatccaggccatcaccaataattctatatgacaaatgtttcttctaccaaccccacaatatcaccccttaccacaaaatcttccttcagcttaatctctcccactctaggttcccacgccgcccctaatcctgctcaaagcagccctgagaaacatcgcccattctctttccataccacccccaaaaattttcgccgccccaagacttcaacactattttgttttattttttatttattataagaagacaggaatgtcaggcctctgagcccaagttaagccatcatatagcctgtgacctgcaggtacacatccagatggcctgaggtaactgaagaatcacaaaaggagtgaaaatggcctgttcctgccttaactgatgacattactttgtgaaattccttctcctggctcagcctggctcaaaagctcccccactgagcactttgtgacccccggccctgccctcaagagaacaaccccctttgactgtaattttcctttatgtacccaaatcctataaaacagccccacccctatcactctcgctgattctctttttggactcagcctgcctgcacccaggtgaaataaacagacttgttgatcacacaaagcctgtttggtggtctcttctcacagacgggagtgaaatttactgcagaatatttcccaaagtctcataatgatgcagaaatacatgtgtacaagacttgttctgacacctggcacagaactgacagtagtggctccccagggaggctggaaggagggtggaggacgtgacagggaagtgacagggaaaggagatgctttatggacaagggcctaagctgcagctttgcttggagcgttaccacaaaacaaatacatacatcatgtgatgtttaaatatcacaatatatatttaataataattggtggggctgagcacggtggctcgtgcctgtaatctcagcactctatgaggctgaagcaggcagatcacctgaggacaggagttcaagaccagcctggaatcccagcacttagaaaggcaaaggcgggcggatcacgaggttaggaaatccagacagtcctggctaacaaggtgaaattctgtctctactgaaaataccaaaaaattatccgggcgttgtggcactcaactgtagtctcacctactcgggagcctgaggtaggagaatcgcttgaacctgggaggcagaggttgcagtgagtcgagatcacgccactgcactccagcttggctacagagcaagactccatctcaaaaaaaaaaaaattaaccagccatggtggtacgcacctgtggtcccagctacttgggaggctgaggcttggggatggcttgagcctgaaggaggttgcagtgagctaagatcatgccactgcgctccagcctaagcaacacagcgagaccttctctcaaaataaaatcaaatatatgaaaacagaataactcaaagtacgaaaatccattttgtttatataggtccgcaaaataataaaacctacacagactcacaagaaactagatgttaacaaaaaaagttgtcattttccccagattttcttttctttcttttttttttttagacagggtctcgttctgtcgcccaggctgcagtgcggtaatgcaatcttggctcactgcaacctctgccttctgggttcaagtggttctcctgcctcagccagagtagctgggattaccggtgcccaccaccatgcccggctaacttctgtatttttagtaaagatggggtttcaccatgttggccaggcttgttgtgaactcctgacctcaggtgatccacccacctcggcctcccaaagtgataggattacaggcatgagccaccatgcccagcagattttcaaaatatatacatatgtgtgtgtaaatatgcatgtatatgtatgtgcatgtgtatgtgtgtgtgtgtatatatgtatatatatatatatatatatatataaagattttaaaaatataaaaagtaacaagatttgtttaactgaagaggaatctcatcttgctagaaaatgacactttggcagttgggggtaggggggaatcttgtcagatctaagaaaacaggaaatgccccatgctagaagaagcaatcaccctttcaactgactgacctggaggaagcttcagatatctgtagtaatgcaggcatgtggagaggcagccactatggcactccttatacaaggaaaaatctcaaaggatccacatgttgtcattcagccaatttccaaagcagatgtcaaagagcaagctagccatgtttactaacttgacaacatgtaaattttcgcaactagcaggatcaaatatcaaagtaaaatatttactaaaacacaaagaagaaaacaacagacgctggggtctacttgagggtagagagtgggaggaaggagaagactagaaaaaatagctattgggggctgggcacagtggcttacacctgtaatcccagcactttgagaggctgagaggcttcgatcatctgacatcaggagttcaacatcagcctggccaacatggtgaaaccctgcctctactaaaaatacaaaaattagccaggtgtggtggtggcatgtgtttgtaatcccagctactcgggaggctgaggcaggagacttgcttgaacccaggaggctgaggttgcagtgagccgagatcatgccatcacactcgagcctgaataaacaagtgcaaaacttagtgtcaaaaaaagaaaaaagaaaaaaaaaactattgggtactgggcttgatactggagcaatagaataatctgtacaacaaacctcaatgacatgagtttgcctatgtaacaaaccatcacatgtagccccaatcctaaagtaaaaacataaatataaaacgttttatttttttaatttactacagaattatttttaaagtctcataatgatgcagaaatacacgtgtatgagacttgctttgacacctaacacagaattgccagtagcggctccccagtgaggttggaaggagggtggaggacgtgacagggaaaggagatactttatggcaaagggtctaagctgcagctttgctcggggttttactagaaaacaaatatatccatcacgtgatgtttaaatatcaaaatatctatttaataataattggtggggctgagcacagtggcttgtgcctgtaatcccagcactctgggaggctgaggtgggcagataacctgaggtgaggagtttgaggccaccctggccaacatgatgaaaccccacctctactaaaaatacaaaaaaattaaccgggcctggaggcacatacctgtaaccccagctacttgggaggctgaggcaggagaatcacttgaacctgggaggcgcaggttgcagtaaactgagatcatggcactgcactccagcctgggtgacagaggctgactccatctcaaaaaataaattgtaaccatttttaccgaaaacacctgtttcacaagcctctccacagtaaccccacagtctccatgagcttaatgtgctaagaatggtttaatgaatctcctgctattatttaggttgatttcctattcttaaactaatgatggaataaaacaccttctatcattcatgtctgtgtatgaactttccattctaattagtacaatttttggagtcagaaacacagtaattcactaaattacctaaaaatgtagtataaaatcagggagaaaagattttttcttattggtctccttttctagaatttagacctactttgtgcacattaatacgtgacttccattggcagctgctctaatcctggtccacagagagatgacagagcatccagatgtggcccctgaacaatccctgctgcccaacagcactgacaccatgggaccctcactccgtctccatccatgtctgggtgtgagcccttcccaggaccatgcccagtgcagcctctcctatgttcatgtcactggatcatgaaagataaaatctaagccagataagagggaatgagggaaggcatgggtgagtgtgagcaaacctgtcaggaaggatgcttcagactcagagaagactcccaactccaaggcccagcgttactcaaaggaaggagacagaacaatccaccgagaatatcatctcacctgaggaagagccatccctgactcctttgctttcctcttcctcttctgggtttcttcctcacgtaccaaaagtctttagaagtcaatcctgaatgttaaaaatatgttatttattgctcagaatcaacacatgccctccctgtaacacaatcacacaaagtgtaatgcacgtccgtgtgaagagaccgccaaacacaatttgtttaaataatgaggctgtttatttcacctgggtgcagccgggctgagtctggaaagagagtcagcaaagtgtggtgggattatcattagttctcataggttttgggacaggcggtggagttaggagcaatgttttgcgggcagggggtggatctcaccaagtacattctcaagggtggggagaattacaaagaaccttctgaagggtgggggagattacaaagaacctttttaagagtgagggagattacaaagtactttgatcagtcagggtggggcagaaacaaatcacaatggtggaatgtcatcagttaaggccattttcacttcttttgtggatcttcagttgcttcaggccatctggatatatacgtgcaggtcacaggggatatgatggcttagcttgggctcagaggcctaactaaagacctcaccctgaggaaatagtccccccttctgccctcctaaccatggatgataaactcctacagggaaactcccgctccccttctggaggagtccacacacaagctgcagcagtggggagctgggctggaatgagctccccttcagggcacagacccagccctgaccgaaccccacgcagaggctgggtgcggtggctcatgcctgtcatcccagcactctcggaggccaaggcgggtagatcacttgagctcaggagtttgagaccagcctgggcaacatggtgaaaccccatctctaccaaaaatacaaaacttagccaggtatggtggtgcatgtctgtgtgtctgtggtcccagctacttagaaggctgaggtgggaggatcacttgacctgaggagtttgagagcagcctggccaacatggtgaaaccctgtatctactaaaaatacaaaaatgggccgggcgtgtgggtcatccggtaatcctagcactctggaaggccgaggtgtgctgattacttgaggtcaggagatcgagaccagcctggccaacatggtgaaaccctgtctctactaaatacacaaaaagtagccgggcttggtaagtgtctgtaatcctcactacttgggagacagaggtaggagaatcgcttgaacccgggaggtggaggttgcagtgagccgagattgtgccactacagtccagtcttggtgacagacaaagactcaaaaataaaagaaaataaaagtaaaaatacaaaaattagccaggtgtggtggcagacacctgtaatctcagctacttcggaggctgaggcacaagaattgcttgaacctaggagacagaggttgcagtgatccaagatcacgagactgcgctcacagcctggacgatagagtgactcagtctcaggaaaaaaaaaaaaaaaaaaaagcgcatttctgatgtgattgatgcagagataataaaacctgagtaacatgatgcagactgatgggcagagggaacttcagacgggggtgggagggcatgggagacagctctgagcctagatctggaggagaaatggacagggtacatagggtaagagcagggacaatgacagggttttgatgtttgggaaaagagaaaagcaaatgtgactggggcaaagggattcatgagatgagggcaagctcccaggaggaggctggacactggcaggggccctggacacagggctgtggagccacagtgaggggttgggcttttgtcctggggaacacgggaagccggtggagggttccctgccagggattgacgtgacctgctttagatttcgctgtgatatcctcatacagagaaaggccccgaagatggtctctgtgtctgagtctacctctgtttcttccattcttctgcttttgttttttattttgagggcactgcatcccattgaaaattctaatcacaactgggcactcctctcctcaaaaaaataaaaaaaaaaaagccacacccagacacgcactccattttgccaatcatttcaggggccagggtcactcgggttgagcttttctggtctagtccctcgtcgccaagttgcagggaggctcactggggctcagatcggaagacattttcaccaagttaccctacgaatgtctgagaggagtgagaaggtgtgcctgaattcttacatgggggcctggaggggctaataggaagggttggtcttatcatcctcatcctggaaaattagagaagcctctttcacaaacctgggctaaagaaacttcttttgcaaggttctgatgccattgattcctgacagttaattcttccttacaggaaaatcacaggaatatttataaaatgcagaagtgtgaacacacagctattgaccttgaaaacagggaaagaaggtcaactgtagcactaagaaataagcaaattgtttcaatcaagaatacatgagtggtcaggcatggtggctcacgcctgtaatcctagcacttttgggaggtcgaggtgggcagatcacctgaagtcaggagttcgagaccagtctggtcaacatggtgaaaccctgtctctactaaaaatgcaaaaaattagccaggagtggtggaaggcacctgtaatcccaactacttacttggtaggctgaggcaggagaatcgcttgaacccgggaggcagatgctgtagtgacacgagatcgcaccattgcagtccagcctgagcaacaagagcaaaactccatctcaaaaaagaaaaagaaaaagaaaaaaaaaacagaggccaggcggggtggctcatgtctgtaatcacagcacattgggaggccgagtcgggcggatcacaaggtcaagagttagagaccagcctgacaaacatggtgaaaccctgtctctactaaaaatacaaaaattagccaggcatgttggtgggtgcctgtaattctagctactcaggagactgaggcaggagaatcacttgatcccgggaggcagaggttgcagtaagctgagatcacaccactgccctccatccaaggcgacagagcaagactccatttcaggaaaaaaaaagaaaaagaatacatgggtgcttttggaggagagttccatgccaatccagcccatgtttcaacatttttccagaatggaccagagggccttgagggaaacacgcaataaatagctcccagctcaagattttaacaaatgacataaggaaagaaaactgaaaaacagactaactggttaaactacattttgatgtttagttaaaaggtcactgacatctataccaagtacacactgaaacaatcaaacttaagtattgggtatgaaacgcttccaataaataacaaagaccagaaagcatgcagacttcgatctgaactggatgcaactaatttcaaacagcaactattttttttaatctaatgaattctggggtcaactggaaaagaacaggagaatatacaagtacagaaatgaatgatgtgagctgactatacgatgctgcaaaggcatctttcagatgtgattatatactatgaaagaaatacaatttttaaaactaagatttatctcaaactcaaactgcaaaaaaaaaaaaaagagagaaatgaagaggaatcagaaaggaaaaaaaaggaagtctattgaacaatgagaacaaaagcatttttaatgtttttttttaatattttttgtttgctggtttctttgagatggagactgactctactgcccaggctgagggcagtggcacgattttgcctcacggcaacctctacctcccaggtttaagcgactcttgtgcctcagcctctcaagtagctggaactaaaggtgcacaccaccaccccccggctaacttttgtatttttagtagagatggggtttcaccatgttagccagggtgctcttgaacttctgaccttaggtgatccactcacatcagtctaccaaagtgttgtgattgcagggatgagccaccatccagctttgatatcctttttttttttttttttttgagacagattctcactgtcgcccaggccggagtgcagtggcacgatgttggctccctgcaagctccgtctccaggattcacaccattctcctgcctcagcctcccaagcagctaggactacaggcacctgccaccacgcctggctaatattttatatttttagtagagatggggtttcaccgtgttagccaggacggtctcgatctcctgaccttgtcatgggcccgtctcggcctcccaaagtgctgggattacttacatgagcctccgtgcctggcctgatctcccttttataaagtactatatcaaaaaagtactatctctttaaaaagtactatctcaaaaaagaaaaatagaaaataagaatcaaaaaacaggctgggaaaagtggctgacatctgttggccatgctggtttcaaacttctgacctcaagtgacctatgtgccttggcctccaaccgtgctggaattacaggtgtgagaaaccacacctggcccaatcctcttaacataaacacttgaatgtcaattaagggttgaactcaatgttaagtcaacacaaactcaagtcaatgctggactgactctagtgtcaattaatgcttgatggtttgctatactcactgcattgggaacagttatctcaaaaatgaattttctgatgttctgcaaggagtgacctcggactcaagaccttgccacacttctgacatttgtaagatttctgtccagtagggattctctgatgtctaatgaggtgtgaacatgaagtaaaggctttgccacaatcatcacacatgtgaggtttctctcctgtatgaattctcctatgttttgcataggatgaagcttgactgaagaccttgccacagtcatgacatttgtaaggtttctctccagtatgagtgtgtcaatgaactgcaatgtatgaatgatgtctgaaaaatttgccacatttattacacttgttagatctttattcattatagattctccaatgatttgcaatggttgtagcgttactgaagactttgtgacaatcattacattagtcaagtttccctacaccatgaactgcctgatggtgaataagtgttgactgcttgctaaaggctttgccacactcattacacttgtaaggtttctctccagtgtgaagtccagtatgttgtttcaggtgtgaatcactcccaaaagtcttgtcacaaaccttacatttgtatggtttctttccaggatgaattctcctatgtcttttaaggtgtgatttgcgactgaaaactttgtcacatgtttcacatttgtaaagtttctccccagcatgaattctatgatgaagtgaaagttgtgattgttgattaaaagccttcccacattcattacacttgtaaggtttctctgcagtgtgaattctggtatgtcttgccaggtatgaattacgcacgaaagccttgtcacaaaccgtacatttgtaagatttctctccagtatgaagtctacgatggtgaacaagggatggcttgtgactgaaggtcttgccacactcattacacttgtaaggtttctcaccactatgaagtctacgatggcaatgaaggtatgacctctgactgaaggtcttgctgcactcattacacttgtaaggtttctcaccactatgaactctgcgatggcttgcaaggtatgacctcagacggaaggtcttgctgcactcattacacttgtaaggtttctctccactatgaattctagtatgttttgccagataggaatgacacgcaaaagccttgtcacaaaccttacatttgtatggtttctctccggtgtgaattatcttatgtgtctcaagggttgatccacaactgaaaaccttttcacattcttcatatttgtaaggttgctctccagtatgaattgacttatgaattagaagatctgaattttgaccaaaggtcttcccacattcattacacttgtaaggttttcctccactatgaattctagtatgtcttaccaggtgtgaattccacgcaaaagccttgtcacagaccttacatttgtaagatttctctccaccatgaagtctatgatggcatacaagggatgacttgtgactgaaggtcttgccacactcattacacttgtaagttttctctccagtgtgaattcttttatgtcttgccagctgagaattccatgtgaaagctgtgtcacaaaccttacatttgtatggtttctctccagtatgaattctcttatgtgactcaagggttgatttccgactgaaaactttgtcacattcttcacatttgtaaggtttctctccagtatgaattctacgatgacgtgcaaggtttgattgctgattaaaagctttgtcacattcattacacttgtaaggtttttctccagtatgaattgccttatgaattacaagggctgaattttgaccaaagatcttgccacactcattacacttgtgagattttactgcagtgtgaagtctacgatggcatgtaagggatgatacctgactgaaggactttccacactcattacacttgtaaggtttctctccagtgtgacatctacaatggcatgtaaggtattgcttgtgattaaagagcttgccacatacatcacatttatattgtttgtctcctaaatggggtatctggtgtttccttaagagtgagctacaattaaaggctttgccactctcattacattggaaagatttttctctcatgtatacttcctgtttttgtgggagtagtgaagaattcggggaattattcccatagttattagaaatatggatttggggcctaggagaaattctttgggatgttgaaaccgagggagcatcactggtagacttctcaaattgattaccaattttacctttgatctgaattatgtggagttcaggcagatgtgaataaaagcttgatccaagctgatctttaataggcttgtttccagcatgcctgtgatcatgttggtctgtgctaccagtcaacttttttatttttgtcatgggtgcttcatggccatttctttcatcttcttgacactgaaactcaatatcatgaatttctttctcaatttcctggaagcaaaaatctccaatgtgataactttgatatctttgcaatgtccctgtgtggatcacttctgtattgccttgccctgttgacaagacctccttcatcatgcgtttggaagagatatctacaaaatataaacaacaataggtttccaattaagtacagatggtaaatcatactgaagtgtgtaaatatgacacaaaaaacaatacttattttgaacttcccaaatatcatcttcaaagtttaggaacacaaaaggagtaagattctttaataaacaaggggcaattacatgtccttcaaatcaattctatgaaagtctatttcctatgtcatcacaaaacactgacagggcacaaacgtgtaagcctaaggtaaggagtatttttccactgtgaccctaaagtgtatcacaatttgcaaaaaacatatcactgtcacatcaatgaagagaaaaatatatatttttcatatttaaaccatatttactgtgtacaaatgctaaaaaaaaaacaaagaaacccacacaatatactatattggtaaataatccacaaactcatgtaaggataaccaaaatcaatggaaattctgtattttcaaacaattatagcaccgagaagagaagattacaaaaattaaccaggtgtgctggcccgtgcctgacagtcacagcaacttgggaggctgaggcataagaatcacctgaacctgggaggcagaggttgcggtgaggcaagattgcacctctgcactccagcctgggtgacaaagtgagactccacctcaaaaaaaaaaaaaaagcaaaaaaaaagttaattcaatatttttctcaataaatgtcataaaattacctatatccacacaggacaggcacttaatgacttttcaaaaaatttttgtatttttatttttttgagatggagtcttgcactccagcttggagtgccatggcatgatctcagctcactgcaacctctgcctcctgggttgaagtgatcctcctgcctcatcctcctgagtacctggggttacaggcatgcacaactatgcctgggtaatttttgtgtttttagtagagatgtgtgggcagcaagccaactaggtgccaaggcaagagttcgagggcacaagctgttccaatataataaaatatataaaataacaagagttatactagatctagatcatagacatgattatatatgaatgtcattaatcattagttggtagcaattactctttattccaatattataataatcctcgctctataatcataacctaagaaaagccaggccatacagagataggagctgaggggacacagtgagaagtgaccagaagacaagagtgcgagccttctgttatgcccagacagggccaccagaggactccttggtctggcagtgatgccagcgtctgggaagatgcccgttgccaagcggaccatggtctagtggtagcatcagtgccaaggaacaacacccgccacttagcagaccgggaaagggagtctccctttccccgggggagtttagagaacactctcctccaccacctcttgcggagggcctgacatcagtcaggcccacctgcagttatccggaggcctaaccgtctccctgtgatgctgtgcttcagtggtcacgctcctagtccaccttcgtgttccgtcctgtacacctggctctgccttctagataacagtagcaaaatgagtgaaagtactaaaagtgtctgatatgcagaaataatggcgcaagctatctctctctctccctctctctgcctcggctgccaggaagggaagggccccctgtctagtggacaggtgacccacgtgaccttacctatcactggagatggctcacactccttaccctgcccctttgtcttgtatccaataaatatcagcgcagcctggcattcagggccactacccatctctgcatcttgctggcagtggtcccccgggcccagctgtcttttcttttatctctttgtcttgtgtatttatttctacagtctctcatctccgcatagagagagcaaaacccaccgaccctgtggggctggtccctacagagatggggtttcaccaggttgaccaggctggtctcaaactcctgacctcaagtaatcttcccgcctcagcctcccaaagttctgggattacaggtgtgagccactgtacctggtggcactttgtgacattaatgagtggagtgtggcagttatattgcataccacataccgaaaagccatatgcaaaattataaaaattaattaataaaatattgtaacccatgataaaaccagcaagcaagtaagtacatttatacagcctgcagaattctaaacaattccctcttaagaaaaaagccacaacatctacttaaccaccagcacacaatataagaactgaaatacatgttaagatcactaccttctcatgtatgaggtcaagaaaatacacagcattttaagaaataagaattgactaatggctggtaacggtggctgacacctgtaatcccagtactttgggaggtggagacatgtggagcacgaggtcaggagttcgagaacagcctggccaacatggggaaaccccatctctactaagaatacaaaaaaaacagctgggtatggtggcagacacctgtaatctcagctactctggaggctgaagcaaaagaatcatttgaacccaggaggcaaaggttacagtgagccgagattgtgccattgcactccagcctggttgacagggctagactccatctcaaataaataaataaataattgactaatagtgtagaaaagtacaattatgatgtcacaactacacttatgtaacagccaggcaatacagcaattttacatttgtgcattccccatagttatctagttcactatgcgtaagatataaaacatagaatgtgtactgggaaaatttataaacagatcagagaaaatattgtataaaacaaattgcacaataagaacaaaaaatatgatgtatgttccctggcccgaatgttcaccttggctaaaagtcattatcagatttcttattctccaataaggatgttcctgcagttggggtcttttagagaatttggtcatgggtgttgactaattgtgaataggactagggcttttaattgtattttttctttctttatctacttttgagacagagtttcgctcttgttgcccaggctggagtgcaatagcatgatctaggttcaccacagtctctacctcccaggttcaagcgattctcctgcctcagccacccgagtagctgggattacaggcatgtgcaatcatgcctggctcattttgtatttttagtagagacatggtttctccatgttggtcaggctcgtttcaatctcccgacctcatgtgatttggccgtcttagcctcccaaagtgctgggattacaggtgtaagccaccacgactggccaggactactgtttttataaaaagagacagtaaagagctcattgcctgctcctctttcccccatgtcaggacactgcaggaaggtggctgggctaaaccacgaagaaggctctcaccaggagccaatctagctgacatcttgttcttggatttcccattttccagattcatgagaaataaatttctatgtcttaagctttcaagtttcagctatttctttttttttgtctgtcatgcttcatcacccaggctggagtgcagtggcacgactctcctacctaaagagattctcatgcctcagcctcttgagtagctggcactacagatacatgccaccatgcctggctaattttttttttggaaacagagtctcactctgtcacccgggctggagtgcagtggcgcaatcatggctcactgcaacatccatctcccaggttcaaatgattctcctataggtctcagcctcacaagaagctgggattacaggtgtataccaacacacccagctaatttttgtatttttaccagagatggggtttcaccatgttggccaggctggtcttgaaattctgacctgaggtgatccacccgtctttgcctcccaaatttttgggattatagtcgtgagccatcacgcccgtccaattttttttaatttagtagattcaaggtttcattatgtttgcccgactgctctcaaactcctgacctcaagccatctacccacctcagcctttcaaagtgctggaattagaggcctaagccactgcggctggccagtctaagctatttctgacagaacagtgaaaagagtgagataggaaaagaggcatctcatcatcaacatcactgaaggctgacaaatcttattaaacaaaggaagttgagtgtgtactataaaacttatatgaagccatctaatagtattcacttgttttaaaaagcaggtggacgaatcacctgaggttgggagtttgagaccagcctgaccaatatggagaaaccccatgtctactaaaattacaaaaattagccagacttgcaccaggcataatcccagctacttgggaccctgaggctggacaatcacttgaacccaggaagtggaggttgcggtgagctgagattgaaccaatgtactccagcctgggcaagaagagggaaactccatttaaaaaacaaaaaaggccagacacagtggctcaggcctgtaatcctagctctttgggaggctcaggcaggtacatcacttgaggtcaggagttcgagaccagcctggccaacatggtgaaaccccatctctactaaaaatacaaaaattagccaggcgtggtggtgcatgcctgtaatcccagctacttgggaggctgcagaaggagaatcccttgaacccgggaggtggaggttgtggtgaactgagattgtgccattgcacttaagcctgggcaacaggagcaaaactccatctcaaaaaacaaacaaacaaaaaccaaaaaccaaccctggaggcaaattaacattatttctcaaataacaaaagcaggcccgcggtgttcatggacatgaccccagtttgcacgtacggtaagtgagggacaagacttgatcctgggcatgaaggatcccatgacatgttcttaggcacaatagtcagcccaggcaggacaggaaatgaccagacacagaaaatacaaggagaacagatagaagtacatcaagggggatacaaggactgagctgggacacaagcgctgagctgcgctgctgacagtggttctgaagccatccctcatggatcatgtgctgagtcatgatgccctgcacacactgatttaagcggcctcctataattttgtccagtggatgaacaaggtcttgacttactcagtgagagtagtgttggaggggaggggctcacggggaaattggggtgttcactattacaaagtcaataggctggtatttgcatccagatcaatgtatcatgtgaggcaaggccaggaaaggaagggcaagggtggagagcaggaagtaatgggcatgtaggagtgaactttgtgcatgcatgtctgtgggaatataattccactaggatagaccaaatcttgagcttggaagaaagtggaactaatttagcaaatggtaaaatattgacccaaggttaaatattcaaattacaatatgggcaagggacaagaatgaaagagatccaaaaaagcagcagtatggtggcctgaggtgaaagcaattttacatctcttaaattaaatgcctctgatttctagtttcaagcatatactcaacaataatcccctgtgtagattccagaaatgtgtacacacaaaaaaataagtaaaccctatgaagagtacagtagagcaatgtaggagaccatggggttgaagaaggatgccctggctgagtaggtagagatgtgtttgtgaaaacagagccaggctgagtgcagtggctcacgtctgtaatctcagctcattaggaggatggatgggtggatcacaaggtcaggagttcgagaccagccaggccagcatggtgaaacactgtctctactgaaaaaatataaaatattagcccggcatggtggtgcatgtctgtaatcccagctactcagaaggctgaggtaggagattgcttgaacctgggaggtggaggttgcagtgagctgagattgcaccactgcactccagcctgtgtgacagagcaatactccatctaaaaaaaaaaagaagaaactataactttaatagaaatgtggtttcaccatgttggccaggctggtcttgaactcctgacctcaggtgattcacccacctcagccttccaaagtgctgggattacaggcgtgtgccactacacccagcctggcagcattatttataatagtaaagagaagaaaccaacccagatgtccatcaacagataaatatatgaacaaaatgtggtatacacatacaatggaatattattcagccttaaaaacaaacttggatgggtccaggggctgtggctcatgcctgtaatcccagcacattgggaggccgaggtgggtggatcacgtaaggtgaggagtgagagacgagtctgaccaacatagagaaaccccgtctctactgaaaatacaaaattagctgggtgtggtggcacatgcctgtaatcccagctacccaggaggctgaggcaggagaattgcttgaacctgggaggcagaggttgcggtgagccaagatcataccattgctctccagcctgggtaacaagagcgaagatccatctcaaacaaaaaaacaaaacaaaaaaacaaccaaaaaaaaaaaaaaagccatgcatggggcaaaatcacaaaagagaacacaaaaccaggaagggccaagatagacaagagcagactcctcatgtctgggggacatcattttcctcacccacagcttccaggttcctgtagttctccaacatcacttccctgtacaaagccctctgcgaagggttcaggcatttccactctgccaatgagaattctatagccacatccctgaaagtcaagcgtccctaaaatgaaacacacatttccacaaaacattatggaggattgagttatcaccttcatgggaaatgagaaaagagaaaataagtatttgatcaaagactgtgttctgacaaaatgttaaggtattttgaatattttttccctatagttgcattttattgtacttttctttgaaagattttaagatgccataagtcactatggaagtctcaatttcatagacaacataaaaagtataaaaataaaaaggaaacacagggccaggcatggtggttcacacctgtaatcctaacacttcgggaggccaaggcgggcagattatttgatgtcaagagttcgagaccaccctggccaacatggtgaaaacctgtctctactaaaaatataaaaatttgtcaggcatggtggcaggcacctgtaatcccagctacacaggaggctgaggcaggagaatcacttgaacccaggagatggaggctacagtgagccaagatcgcaccactgcactccatcctgggcaacagactgacactccatctcaaaaaacaaaacaaaacaaaacaaaaaaacaatgccgggcagtgactgtcacctgtaatcccagcactttgggagaccaagacgggcagataatgtggtcaagagattgagaccatcctggtcaacatggcaaaaccatgtctctactaaaaatacaaaaattagctgggtgtcgtggtgcaggcctgtactcccagctactcaagaggctgaggcaggaggatcgcatgaatccgagaggtggaggttacagtgagccaagatcgcaccactgcactttagcctggcaacagagcaagactccatctcaaaaacaaacaaacaaacaaacaaacacagggttttttctacagacatgtcagatattatgttcaacataccaggtgatattaagtctctagatgagctaagatacaagtggtgtttcagagaggacaaaatccaacggctttgaatgaaaagtctgaatctaaaaactgtcatgactgcgcaggcacagtggctcatgcctgtaattccagtactttgagaggtcgaggcaggtggatcacgaggtcaggagtttgagaccagcttgggaacatgctgaaaccccttctctactaaaaatacaaaaattagctgggagtgatggtgggtgcctgtaatccccaatactcgggaggctgaggctggagaattgcttgaaactgggaggtggaggatgcagtgtgccaatatcatgccactgtacttcagcctgggtgacagagcaatactctgactccaaaaaaaaaaaccaaaaaccaaaaactgttatgatgacagcaatagccatgactaacatttttgaatgcttcccactgttctaagtgcttcccatgtcttaagccataaaataacatactgtcccatgaagaaaggtctgtacttggagacaagtgcatcacacatactaggaaaattaccacaaatcaaatagctaaaaatgtcaacacaagcactgaatccagatgtctgggattcacatttgaatataaacgctgaagtaacagatacagctttaaactaaactgacatgggtttatctagtggagagaatgtgacaaaggtccaagggtaagaacacggagcatcctacaaggtcgctgaatggacacacacaggcatacatataatccttcccaatacttcttactttttttttttttgagatggagtctcactctattgcacaggctagagtgcagtggcagaatctcagctcactgcaacctcggccacccaggttcaagcaattctcttgcctcagcctccccaggagctgggatttgaggcacctgccactgcgtccatctaatttttgtatatttagcagagacagggtttcaccatcttagccaggctggtctcgaactcctgacatcgtgatctacctgcctcagccttccaaatgaaaaatagttaaaatcattacaattattataaaaaataaaacttattgcaaatgaaaaatacttaaaatcattacaattattataaaaaataacttattgcaaatgttgtgttttctacataaaccatgggcttatccacccatgtattcatgcacacacatcacatcacggcgttacccacgtggtggcccacctctaatccaagctactggagaggctgaggcaacagaatcactgtaatctgggagtcagaggctacagtgaaacaaaatcaccccactgcactcctgcctggacaacagagactcaactcaaaacaaattaaaaaataaagtaaaatcaatgatgtaagaaagcatcctgtaccactgatgcctatctccactttccactccatcccaagtcattaaaagtgcagagtttggctaagcgtggtggctcaggcctgtaatcccagcactatgggaggctgaggtggatgaatcacaaggtcaggagttcgaccagcctgaccaatacggtgaaaccccatctctactaaaaatacaaaaaattaaacaggcgaggcagcaaatgcctgtaatcccagatactcgggaggctgaggcaaaagaattgcttgaagccagaaggcagaggggcagggagctgagatcccaccactgcaatccaacctgggcaacggagcgagactccatctctaaaaagtaaagagtccagctgggctggctgtctcccatctggaatgccagcaatttgggaggccaaggtgggaggatcactggaggccaggatatcaaggctatagtgagctatgattgcaccactgcactccagcctggacaacaaaataaaaatacgatataaaaaataaggccggacacagtggtgcacacctttaatcccagcactttgggagtccaagacaggcagatcatgaggtcaggagttcgagaccagcctaaccaacatggtgaaaccccgtctcaaataaaaatacaaaaattagctgggtgtggtggtgcatcctgaagtcccagcaactcaggaggctgaggcagaagaattgcttgaaactgggagatggaggttgcagtgagccgagatcattccattgcactccacctttggggactgagcgagactccatcttaaaataagtaaataaatagatagagagatacatatatacatacatacggtgacccatgcctatcactcaggctctttgggaggctaaagcagggattagttgagctcaggagtttgaggctgctgtaaactctgaattgtaccattgtactccagaactaagccacagagcgacaccttctccctctctctctcttttcttttgagacagagtctcactctgtctcccaggctggagtgcagtggcataatttcggcatacagtaacctccacgtcctgggtttaagtgattatcctgcctcagcctcctgagtagatgagattacaggcatgcaccaccaccccaagctaatttttgtacttttagtagaggtggggtttcaccatgttggccaggctggtctcgaactcttgacctcaagtggtcttcctgccttggcctcacaaattgctggtattacaggtgtgagcacctgaaccaacatcctgtctcttaaaaaaaaaaaaagtttggaatcacagacatcttgatctactagtgtggcttcaaatgcattaccaaatcagatacaaaatacctccccttatttgtctccttttccagaatttactagatatctgtgtacactaacatatgtatttcatatgtagtttctctgatctggtccacaaagagctgacatccagatgtggcccctgaacaatccagcctgcccagcagcactgacatcaatgggcccacaccccatgtttatccatgtctaggtgtgagcccttcccaggaccatgcccagtggagcttcttcccaagttcacatcactgggtcacaggagatggaatctcggagcagctgagaggaactaagggcaggcatggctgagtgtgagtgaacgtgtcaggcaaaattcttcaaactcagaaaagactggctgctacaatacctggcatttcagaaaggaaagagacagattaatccacagaggaatatcacttcacctgaggaagagccatgcctggctcctttcctttcctcttctgagctgcttcttcacataacatgagtctttaggaatcaatcctgtatgtgaaaaaaaatgagacttcttgttagaaatgactcactcccatcctgtgacaaaaccacatgaacaggggagacctcacccagcagaaagaagtcccccaccgcccactgcaccagagatcatgcagagataagaaagtcccacaggacgacctataagtgtgtttgaccccggtcttcagatctcactcccctcctggagaagcccccacacactaggcagcagtggggagctgggctggactgatctccccttcagggcacaaacccatccttcatcaatccccatccagaggacagcccctcacctctctgtggatcacaggctgagctcagccctcagaaatggaggacaaagatgctcaatgctgcacacagatgacaagcacctgcgccactgcaggtattactgagggtgggttccatcccatcagaataagaatccctgctaaagcagcacaaaagctctatttgaaaaatgcctctagactctaatgtgaagccagggttgagctccactcagagggggcgagcccagcacagccccacgttctggctctgccctccccttggggccttgttctcaccagcatccagagagtggatgacaaaggcacaaaaataatcacacagaacaggcaacgtggaccagaggtggggtgaatgatgggctgtgtgaaaggaaataaatcttcgagccccaactcactaagcaaaagggagaagtcaagctgggaactgcttagtgagccagactccccttctattcaaagtcacccctctgctccctgacatagatgcatgtctgagtgcctccttcgaaagactaatcagaaactcaaaagaaggacccagcacagtggctcaggactgtaatcccagcactgtgggattacacaggtagatcacttggggtcaagaggtggacaccagccagccaacatggtgaaaccacatgtctactaaaaatacaaaactgatccgggcatctacttgggaagctcaggcaggagaatcacttgaacccaggaggcagaggttgcagtgagccaagactgtgccactgcactccagcctgggtgacaaaaggagacttcatctcaaaaaaaaggaaactcaaaagattgcaaccgtttgtgccacatttctctgtgacctggaagcccactccgtgcttcaagtcttcctgcctttgtttaaagttctcccaccttcccagaccaaatcaatgtacttcttacatatattgattgatgtctcatgtctccataaaatgtataaaattaaactctgcgccgaccaccctgggcaaaataaactttctaaattaactgagatctctgtaagattttctggtttcacagctgcagtgtcaaatgagggctgtgggagatcacaaaggaaacccggagaagatgatatcagaacaaggacctaggaaagaaaggctgcttgtcacttgcagctgaggggaagagagtcctagagagagggacagctcaagtgagggccctgagacaggagcaacctcagccccaggaagaggaaagcgaccagtggggctggaacagtggaagagaggagggcacaggtaggagatgaggtcagagaggtcctgggggcacagacccataggaacatgtcttcaaacatgtttctcccacaaccttaaagaattttgaaagtcgactgtgatcccagctactcgggagtctgaggaaggagaatcccttgatcccaggagtcagaggttgcagtgagctgatatcatggcattgcactccagcctcagccacaagagtgaaaattcctctcaaaaaaacaaacaaacaaacaaaaattggaagtgatgtatcttctcactcttttcacgtatacatctaagtttctctttatattataaattacaacacttacaaataaagtaatttatttcacaaatttaaaatacatgctgtcaagttcggccgtttccggaagtacgtagtcaccctcatctgagatgtgcagactgcaaggaaatgtgtttgggggtttagaaagccactcgtggacacctgaaggtggggatgcctgtttgatgacccaggagacagctgaggagacaactggacacaggattgtagagctcaggggcgaggcctgcaggggacatggagtcatgtaggtgggttaaagctgtgagatgataaggttcaaggtgacttgagtctaattaccccgtttttgttcatcttgtgcttctttttttttttttttaatatttggagaactggaattcatttaaaattcgagttaaaactgagcactaccctctcccagaagaaaagtcacacactgtattttgtcagtcatttcaggggtcagtgtcactgactgagcttttccggtcttattcctcacctctatgttacaggtgggctcactgaggctcacagtgggagacatttcaccaagttattctgagatgttctgaggtgaggaggaaggacgtgtggctgattcccatgtgattgcctggaaggcccaataggctgccttggtcttcctcctctagaaaattccaagaccagccaggattggtggctcacccttgtaatcccagcactttgggtagttgaggcaggccgatcactggagccgagaagtttgagaccaacatgggcaacatataaaccccatctctaccaaaaatacaaaaaattagccaggcatcatggcatgcatctgcggtcccagctacctgggaggctgacgcaagatcacttgagcctgggaggcagaggttgcagtgatccaagattgttccactgcattccagcctaggtgatagggtgacactctatcttaaaaaaaaaaaaaacagcggtcaggcaaggtggctcacacctgtaatctcaacactttgggaggccgaagtgggtggatcacaaggccaggagctcgagaccaacctggccaatatggcaacatcccatctctactaaaaatacacaaattagccaggcgtaggggtgtatgcctgtaatcccagctattcaggatgctgaggcaggagaatcgcttgaccccgggaggcggagtttgcagtgagacgagatcgtgccactgcactccagcctgggtgacagagagtctcaataaataaatatatatatctaaacattagccaggcctcgtggggcgtgcctgtggtcccagctactccggaggctgaggtgggaaaatcacttgagcccaggaggttgccgctgcactgagctgtgatcctgccactgcactccagcctggacagcagtaagagtgtctcaaaaaaataaaaattaaaggctggacgcagcagctcatgcctgtaatcacagcaccttgggaagctgaggcgggaggatcacctgaggtcaggagttcaagaccagcctgaccaagatggagaaaccccgtttctactgaaaatacaaaattagccggccatggtggtgcgtgcctgtaatcataactactcaggaggctgaggcaggagaatcacttgaaccccagaggcgaagtttgtgatgagccaacatcacgccattgcacttcagcctgggcaacaagagcaaaactgcatccaaaaaaaaaaaaccgacaacagcaaaaataagtaaatttaaagtaaaattaaaaaataacaactaatgaggcccagtgtgatggctcacgcctgtaatcccaacacttcgggaggccgaggcgggtggattacgaggtcatgaattcaagaccagcctggccaagatggtgaaaccctgtctctactaaaaatacaaaaatcgacaggacaggtgtggtggcggctggctgtaatcccagctgctcgggaggctgagacagagcactgcttgaacccgagagccggaggttgcagtgagtaaagatcgctccactgcactccagcctgcatgacagagaaagactccatctcaaaaataaaaaataaataaataaataatcacacaaaaaaccaactaaactaatgaagagaggaactagaaaaaaaaattacaaaaagagaacaaaagcacttttaatattcctttcatcacgttccatatagtaacagagactcagtcacttcttactctacttctctccctcactccccaccccatccatgaaaagggaagagggtgatccacaaggaatgagtcaagtcactgtcctctggctgaagaggggttgcagagggaagctgcctctgacgccatcattataaaatgcaccacacttagacacaggagtttggcaactctcattctcatctgtataatttaaactaattttaaatttgttacattataaacagagaaaacaacatgtcatcacttcatcatcacatccaatcaactcaccactcatctgcacccagggtcccccttcgtcttcattacttttcccctccatcattcctttttttgtttgtttgttttgagaccgagtctcgctctgtcgcccaggctggagggcagtggcgcgatctcggctcactgcaagctccgcctcccgggttcatgtcattctcctgcctcagcctccggagcagccgggactacaggcgcccgccaccacgcccggctaatttttagttttcttagtagagacagggtttcaccgtgttagccaggacggtctcaatctcctgacctagtgatccgcccgcctcggcctcccaaagtgctgggattacaagcgtgagccactgcacctggcctcccttcggcattctatacatagctctttctcaccttctctctccatctgtttcttttctgcatttccccctggacttctgctcattttatgcccctctcctgttttgctccattcttttttgttttttgtttgtttgtttgttttttagacggagtttcgctcttgttgcccacgctgaagtccaatggtgcgatctcagctcaccacaacctctgcctcccgggttcaagtgattcttctgcctcagcctcctaatccaaaattagcagggcgtggtggcgcatgccagtaatcccagctactcgggggaagtatcacaagagaatcgcttcaaccctaaaggcagagatagtcattagccaagatcgtgccagtgcactccagcttgggcaaaaagagcaaaactccacctcaaaaaaaaataataataataattagtaggtaggcccggcatggcggctcatccctgtaatcccagtactttgcaaggccaagacaggaggaaactttgagcccaggatcttgagaccagcctgggaaacatactgaaaccctgtttctacaaaaaaacaaacaaacaaagaaaaaaaacaactagctgggcttggtgtctcacacctgtggtctcagctactagagagactgagggaggaggatcgcttgagcctaggaggtcgaggctgcagttagagtagagaacgctattgtaatccagcctgggtgacagagccagaccctgtctcaaaatataaactaattaataaattaaaagtattatgtaataagagaaagtgattttttttcccccacatcactgtcccacttcctaccccaccctgggaaaagggaagagactgactcacaactgaataactgggattccaagtagaagctaacctctgataccaaaatttatagaatgtacatgtctcatagacaggagttttaaaattctaaatctcatctgtataatttaaacaaggtattagatgatatacacagaagtcaacatgtcacaactaatcatatccaatgaactcacccacttatctgtacccaaagtcccccaccctttttttcttttgagacagggtcttgctcttttgaccaggctggagtacagtggcatgatctctgctcacagcagcctggagctcctgggctcaagtgatcctcctgcttcggcctagagaagctgaaactgcaggtgcacactatcacacccggttaaattttttttttccttttttgacagagatggggggagcctcactattttgcccaggctggtcttgaactcctagactcaagcaatccctttgcctcagtctcctaaagtgctgagattacaggcatgagccactgcgcccagcccctctttcttcattactgtgcttccctccctaattctgtgcatatctctcattctccccttctctctctagctcttgttttcttttctttttccctgggattgtgctcctcattttgtacccctctcctctcctgctgtttatccccttcttccctctattacttctcttccacctcttctgctccattctcacagcttatttaacctcttttttttttttcctttttgagatggagtttcactcttgttgtgcaggctggagtgcaccggtgcgatcttggctctcaccgcaacctctgcctcccaggttcaaaggtttctcctgcctcagcctccctagtagctgggattacaggcatgtgcaaccgctcccagctaattttatatttttaatagagacggggtttctccctgttgatcaggctggtctcgaactccggacctcaggtgatccacccgcctcagcctcccaaaatgctgggattacaggcatgacccacagcgcccggtccttatttaacctcttgttgttctttctccccaatctttcaatcttcctcaatgtctatatattacagcctcttctcttatctctccgtctcctctgctctccctattaaattctctcttccctgttatacccctctgtccccactctccagcacctcagatccccaggtgtcctccctgctgtggttctccatctgttcttgccaccagcaccactctgctctgtctgccctggctccaaatccctcctcctctccctcactctggtgagcctccctctttgctgcccctctccctaccttgctgtccttcatctttctgtacatctagcttttctctacatttctccagttgcttttctcctcctgctttcttagttttttttctttcacttttgctgtctcttggcaaattcctaacccatcctctactttgccatctgttatgggcctttctcattcttcttttctctgtctctggttttctactgctctctcagtccctctctctatctcctgatccctttggcccaggcgggtttggagtaatcacaggcgggtttggagtaagacgcctgcatcccgtagaagcgcattttccagggggtggagctggacaggaaagaacacctggtatcataggacaagcccctgcgacccaccccaaccctggctcaggggaagcgaagacttggggagcagcagggcccggcaccaggagggacgtggtgggcgacggcaccctaagacaaaggtgggacctgcaggatcccaggaccaggcagaggacgcagcctccccggggctggggccggggcgccgcgctccaggtgccaactggggcgaggctgggaggcgcccagggctggaatccacctcgcgggtgaggactttaaaaagcacggggcgggaatagtcagaaaaatgttttgagcaggaaaaatacgcgataggaagtgtatacattgccctatagcagaaagaccggggacgggaccagcctccgagcgacttcaaacccaaaagcaagcaacttccagactcttaccgggacgtctcaatttgctctgggtgaagggaagacaggcgagaatttccaggtccgtggggatcccacgtcccaggggcagaagcgccggggacctgggaagtgcagacttaatccaaggcagagcaaaactcacgcgccgtggtaggaccttcactccacgcgatccgcttccgggtttgtgcgcgcccaggactgaagccaggccggggcaggttggctggacctgggcggggtagaggcggggccccaggcggagagaccttgccctttagaaccggcagagggagggcccggggcgggacctgtgcttctcagcctcgcactcagcgcctctgtttttcgagtttttggaggcgacagcggccaggaaggctgaggcatgattcaaaagccctggaattatctggaacgggaatgcaaactagaatgtgaaatgcaaagccctgccagggcggaacatacgatttcatgctgatggcccacagaacagaacagaaatcctctccctttctattctccattcactcaggagggagggtccaccccgtgctcagcttcaaagtgttccctagggcctccgcctgggatgcgggacggagagctcaggccagggaggagtgaggtcaccacctgctgcctaaacacagcagggatgcgggcacgaggcggaagcctgaggtcccagctactcaggaagcagcggcgggagaatccctgaacctgggggtccaggccatcctgggcgacaaagtaacaccccctaactgcagggtcctcttcctgatctctctctcgctcttttactttttttttttttttttttttttgagacggagtctcgctgtgtcgcccaggctggagtgcagtggcacgattttggctcactgcaagctccgcctcccgggttcacgcccttctcctgcctcagcctttcgagtaactggaactacaggagcccgcctaacccaaacaaaaacaagaccgggcgcgctggctcacacctgtaatctcagcactttgggaggctgaggcgggcagatcatgaggtcaggagatcgagaccatcctggctaacacagtgaaaccccatctctactaaaaaatacaaaaaaattagccaagcgtggtggtgggtgcctgtaatcccagctactagggaggctgagacaggagaatggagtgaacccgggaggcggagcgtgcagtgagccaagatcgtgccactgcactccagcctgggcgacagagcgaggctacgtctcaaaaaaaaaaaagaaaaagaaaaagaaaaagaaatatctcccctagtttgtctccttttccagaatttaccagataccagtacacagataccagtgcatacattaatgtatgactttcatacatagattctctgatctgatccacaaagagctaaatgtgcatccagatgtggcccctgaacaatccctgctgcccaatatcactgacaccttggggtccacaccccatctccatccatctctggtgtgagcccttcccaggaccatgcccagtgcagcctcttcccaagctcatgtcactaggttatagaagatggaatttaagtgaagatgacaaggactgagaaaaggcatgggttagtgtgagcaaacgtgtgaggcaggatgcttcagactcacagaagactggctactacaatacctggcatttcagaaaggaaagagacagaagaatccaccgaggaatattactccacctgaggaagagccatccctggctccttttctttgctcctcttggtgtcttcctcacgtaacatgagtctttggaaaatcaatcctgtatgtaaaaaaaaatacgagatttaatttttagaaatcactccctcctttcctgtgacaaaacacacacacaggggagacctcaccagggataaagatggttctctgctgcccactgcaccagagattatgtggagataagaaggtgccacaggaagacctacaagggcaattttgacctgttttgaggtcttgctccctcctgcaaaagtccacacacacgctgcagcaggacacagatcttcagggcacagatctggccctaaccaaaccccatgcagagcacagccccctcacctccctgtggatcacaggctgatctcagctctcaacatggaggaaactgccttgatgttcaatgctggagacagatgagaatcacctgcaccattgtaggtattattgagggtgggtcccatactgtgataatagcaatctctgataaaacagcatagaagctatatttgcaaaatgcctgaaaaccctaatgtgaagccaagtttgagctccactcagggcaccagccccgcagagccccaccttctggctctgctctccgcttggggacttgttcccaccaggatccagtgaacagcgaaggagcaaaaaggatcacacagaacaggcaacatgggccagagatgggggtgaaggtggggctgtcatgtcaaatgggggactgtgggagaacacaaaagttttcatagaaaaagtgatgtcagaacaaagacttagggaagaaaggctgcttgtcacttgcagctgagtggccagagagtcctaggcagagggacagcccaggtgaaggccctgagaaaggagcaacctgagtcccagaaaaagaaaagaagcctgcatggttacagtagaggtagggaggaggacagaggcaggagttgatgtcacagagctcctgggactcagatatctagggatgaggtcttgaaacatttttctctcacatctcaactcaaaagaattttggaaatgtattttctcactcattttatgtatacatgtaactttctcttctatactttgtctctgtgtctctttcttttcaaagtgtctcgttccacctgacgagaaatgcccacaggtgtggaggggcaacccacctcttcaccaatgcaatccatcctgggcaatggagcgagactctatcacaaaaaagtacagagtccagccagggaggctgtctcacacctggaatgccagcaatttgggaggccaacatgggaggatcccttgaggccaggagatcaaggctatggtgaggtatgattgcagcactgtactccagcctggacaacaaaattaaaaaaaatatgaaaaatacggccgtacactttaatgagcattcgtgtgaagagaccaccaaacagcctttgtttgagcaacatggctgtttatttcacctgggtgcaggcgggctgagtccaaaaagagagtcagtgaagggagataggggtggggccgttttataagatttgggtaggtaaaggaaaactacagtcaaagggggtttgttccctggtgggtaggagtgggggtcacaaggtgctcagtgggggagctttttgagccaggatgagccaggagaaggaatttcacaaggtaatgtcatcacttaaggcaaggaccggccatttacacttcttttgtggtggaatgtcatcagttaaggtggggcagggcatattcacttcttttgtgattctttagttacttcaggccatctgggcgtatacgtgcaagtcacaggggatgcgatggcctggcctgggctcagaggcctgacatacatgtgccccacgcctttaattccagcactttaggaggccaagaagggcagatcatgaggtcaggagtttgagaacagcctggccaacatggtgaaaccctatctctactaaaaatacaaaaattttgcaggtgtggtggtgcacacctttagccccagctacttggatggctgaggcagaagaatcgcttgaacccaggaggcagaggttgcagtgagttgagatcgcatcactgcacttcagcttgggcaacagagcgagactccatttcaaaataaataaataaataaataaaacaattacccacatgtggtgacccatgcctatctttcaagctctttgggagtctaaagtcggaattacttgaacctaggagtttcaggctgctgtaaactctaaattgtgcctttgtactctaaaactaagccacagagcaacattatctctctctctctccttttttttttttttttttttttgagatggagtcttgctctgttgcccagcctggagtgcagtggcacaatctcggcttactgtaacctcgacttcccggattcaagtgactctcctgcctcagcctcctgagtagctgagattacaggcatgagccatcactcccaactcatatttttagtagagatgaggtttcaccatgtgggacaggctggtctcaaacccctggcctcaagtgatccacccaccttggactcccaaaatgctgggattacaagtgtgagccaccacacccagaccaacatgctgtctctttaaaaaaaaaagtttgaagtcagagacatgttgatctactagtgtgacttcaaatgcactaccaaatcagatacaaactatctccccttataggtctccttttccagaatttaccagatatctgtgcatattaaagtatatgtttcatatgtggtttctctgatctcatccacaaagagctgacatccagacatggcccctgaacaatgcaggctgtgcagcagcactgacaccacggggcccacaccccatgtccattgatgtctgggtgtgagcccttcccaggaccatgcccagtggagcctcttcccaagttcatgtcactggctcacaggagatggaatctcagagcagctgagaggaactgagggcaggcatgggtgagtgcaagtgaatgtgtcagacaagatgcttcagactcagaaaagactggctgctacaatacctggcatttcagaaatgaaagagacagattaatccaaagaggaatatcacttcacctgaggaagagccatgcctggctcctttcctttcctcttctgagtggcttcctcatgcaacatgagtccttagaaatcaatcctgaatgtgaaaaaaaaaagacttcatgtcagaaatgactcactcccttcctgtgacaaaaacacacaaacaagggagacgtcaccctctggaaagatggtcctttgctgcccactgcaccagagatcatgcagagataagaaagtcccacaggaagacctacaagtgtatgtttgaccctggtcttcagatctcgcccccctcctggaggagcctcccccacgaggcagcagtggggagctgggctggactgatctccccttcagggcacagacccatccctgatcaaaccccatccagaggacagcccctcacctctctgtggatcacaggctgagctcagccctcagaaatggaggactcagagcttcgatgctcaatgctgcacacagatgacaagcacctgcgccactgcaggtattactgagggtgggttccatcccgtcagaataagaatccctgctaaagcggcacaaaagctctatttgaaaaatgcctctagactctaatgtgaagccagggttgagctccactcagagggcgtgagcccagcacagccccacgttcaggctctgccctccccttggggccttcttctcaccaggatccagacagtggatggcaaaggagcaaaaataatcacacagaacaggcaatgtggaccagaggtagggtgagcgttgggctgtgtgaaaggaaataaatctttgagccccaaatcactaagcaaaaaggaaaagtcaagctgggaactgcttagggaaccagactccccttctattcaaagtcacccctctgctccctgacatagatgcatgtctgagtgcctcatccaaaaggctaatcagaaactcaaaagaaggacccagcacagtggttcatgcctgtaatcccagcactgtgggaggctgatgcagtgagctgagatcgtgccactgcactccagcctgggcgacaaaacgagacttcatctcaaaaaatacaaaaaagaaactcaaaagattgcaaccatttgtgcctcatttatctatgacctggaagcaccctcgctgcttcaagtccttctggctttgtttaaagttgtcccgcctttccagaacaaaccaatgtatgtgagccaccatgcccggctcaatcctctttttatttatttatttatttattttatttttgagacggagtttcactctgtcgcccaggctggagtgcagtgttaggatctcggctcactgcaagctccgcctcccagcttcatgccattctcctgcctcagcctcccgagtagctgggactacaggtgcccaccgccacgcccaactaattttttttttgtattgttagtagagacagggtttcaccgtgtttgccaggatggtctcgatctcctgacctcgtgatccacccacctcggcctcccaaagtgctgggattacaggcgtgagccactgcacctggcccggcccaatcctcttaaacactttaacgtcaattaatgctcgaactcaatgttaaatcaactcatcctcaggtcaatgctgagttgactgtaatgtacgccttgatggtttgctatactcagtgcattttgaactattacctcaaaatgtacttcttacgtatactgattgatgtctcacgtctccatgtaatgtataaaattaagctgtgccccgtccaccttgggcacatgtcatcaggacttcctgaggctgtgtcacagatgcgtcctcaaccttcacaaaatacactttctaaattaactgagatctgtctgagattttctcagttcaaagctgcaatgtcaaatgggacagaaaggctgcttatcacttgcagctgaggggctagagagtcccaggcagagggacagctcaagtgaaggccctgggacaggagcaacatcaccctcccaacaaaggaaagcagcccgtgtggctggagcagtggaagagagaagggcacaggtaggagatgaggtcagagaggtcctggggacagagatccatagggttaaggacttcaaacatttttctcccacaacccaaaagcattttgaaagtccactgtgatcccagctactcggggggcagaggtaggagcatcgcttgaacccggaagaaggaggttgcagtgaatcaagattgagccactgaactccagcctgggtgagaagagccaaactctgccacacacacacacacacacacacacacacacacacacacacacacacacacacaaaagtgatgtatcttctcagtcatttcatgtatacgtgtaactttctctttatattataaattacaacatttacaaataaaggaatttatctcccatatttcaaaaacatgctgtcaagtttggctaagtccccagaagtacacagtcaccctcatctgagacgtgtaggactgcaagggaatgtgtttgggggtttaggaagtcacttatggacacgtgaaggtggagatgcctgtttgatgtcccagcagagagctgaggagacaactggacacaggattgtagagctcagtggagaggcctgcaggggacatgggtaggtgggttaaagccctgagatgagataaggaaaagcagtgggtgtggacagagacaagaataagttcaagatgatttgagtctaatcccgtttttccattccggtatttgtgggtttttttacatttttggaggacaggaatccatttaaaattcaaatcacacctgagcatcaccctctcctacaggaaaagccacacacttatttggcaaagtatttcaggggtcagcgtcactctgactgagcttttctggtcttattcctcacctgtacattactggttgagtcactgttgttacgagcaggagacacttcaccaagttatcctgagaagctccgagttgagtcagaaggaggtgtggctgattcccacgtgatggtctggaagcgccaataggctgtgttggtcttccttctctagaaaattccaggatgggccgggcatggcggctcaccctgtaatcccagcactttgggaggctgaagtgggtagaccattgagcccaggaatttgaaaccaacgtgggagacgtggtgaaaccgcgtctctaccaaaagtataaaaaattagccaggtctggtggtgtgcatctgtggtctcagctatttgggaggcggactggggtggatcactgggcctgggagatggaggttgcagtgagccaagattgtgtccctgcactcaagtatgggtgacagagtgacactcttgtctcaaaaaaggaagaaaaaagtttcaggaccattctatatacctgagcaaatgaaatgtctctttcaatgtctaaggttttgatggcatgaatcctaaacataattattttctgagaaaaatgattgtaatacgttcaaaataaacacaattttgaacacatagctataagtgtttaaaacattgaaaaagaagcagcggtacaaatgagatctgagcaaatgttttcgtcatgaacatatgggctctgctggaacaaggttccaggtcaatccagcccatccttcaacatctgcaaagaatattatggaccagaggaacttgaagggaacatttacttaaaagctcacagctcactatttagtcagatgacataaagaaaatggaataataggctacatgaactaaattttgatgttagcataaagaaaaagttccttgatatctttatcaagtacacattgaaacaagctaaaatcatttatcaggtaccagaaaatgtttccaatatatgacacagactagaaagcatgcagtcctcaatgtaaactaaacacaataaatttcagagaaaaacaatttacagtggttaaaaaaatatatatatatataataaaatgtggggtcaaagaaatttttcaatacatatcatagttggaaaacaatgatgtgacttcgtaagattataccaaagcttatttgagaagcagttatttactttatttttattttgttgagatggagtctcaccctgtagcccagctggagtgtaggtgcgccatctcagctcattgcaatgtccgcctcctggattcaagcgattctcctgcctcagcctcctgagtagctgggattacaggcactcgccaccaaaccaagctaatttctatattttagtcaagacgaggattcaccatgttacccaggctgttctcaaataccttgcctctggtgatccgcctgttgtggcctcccaaagtgctgggattacaggtgtgagccacagcacctggcttttttttttttttttaattaagaaacaagccgggcttggtggctcatgactgtaatcccagcactttgggaggccgatgcagctggatcgcctcagccctggagttcgagaccagcttgggcaacatggtgaaagcccatctctactaggaacacaaaaatttgccgggtgcaatggcgcatggctgtggtcccagtgactttggaggctgaaatgggaggatcccttgaacccaggaggttgaagctgcagtgagctctgatgctgtcactgctttcatgcctgggcaacagaatgagacccatctccaataaaaatgacaaaagaggaaacacatgcgtcctgggtctggggacagggggaatctaaggccaattaacacgaacctcaggaggtcctgacgatgtgtgcccaaggtgttgaggctgcagtttactttcacacattttatggacacgagacagcaatcaatacataaaacatatacattgttccggtctggaaaggtggaataactggaattggggggcttccgggtcacaggtagataacaaatgatcacattctttgagtctttgatcagcctttcactaaatacacaatttatatgtgagagcgggaggaggaatagtcacttacgtcttagactggagtacagtggcatgatcacggctccctgcagcctctacctcccaggctcaagccatcctcccaatgcagtctccacagaagctgaaccagcagacatgtgccaccatgcccagctaatttttgtattttttgtggagacaggggtttcaccattctgtccaggctggtcttgaataccggggctcacatgacccagctgtctcaacctctgaaagtgctggtattacaggcctgagccactgcatctggtctcatcgcaaatttgatatttcttcttgtttcaattttagcagaatttacattgctttgattgagtctcttttcaaactgattttacccttctgagtgcctcaaactagaccctgttcagacatgttataacagatttgtaccattttattttggtgcaaaaaatgtgacatcatgcacaattttctcataacatgtattttttcatgaacttcgtgaagaccccttgtactagcaaactgtattcaagaggatataaaaaggattgtagatatgcaagtgccacttatttctgagatacaaggatggttcaacatattcaagcaaatcaatgtgatataccacttgaacataatgaaagatgaaaaccacatcatctcaatacatgtagaaaaagcatttcacaaaattcaacatcatcatggaaatcctaccaaaaatagttagagaaggaaatttacctcaacagtacaaagacaatccatgaaacgaccacagtggaaataaacaatcagggaaaatggaatgcttttcctgtaggatctcacatgatgcaagaatgctctcaccctttctattcaatcaatgctggctgtcccagccagaacaatgaaatagcaatagaaatcgaactcatccaaatcagaaagaaagaagtcaaattttatttgtttgtagatgacatgatctgtgaagaaaatcacagtcaaccaaaatacaactggaactaataaacatattcagtgtatttgcagaatagaataatagcaccaaaaattagttgaatttccatacattaacattaaataattttaaaataaaattaaaaaccacttccatttgctaaagagcttaaagtaagaaatatttaggaataaacatataaaggtgagaagtttgtaccttgaaatctacaaacattgatcaaaatgattaaaaacatataaatacacatacaatccatactgattggaaaaattagtattgctcaatgattatataaccgaatgtgatttagattcaacacaatactcatagaaatccccataactttttgttaaagaaacaaaaaacaggccagtcacggtggctcacgcccataatctcagcacttcgggaggtagaggtgggtgaatcataagatcagaaaatcgagaccatccaggctaacacagcgaaacccagtctctactaaaaatacaaaaaattatccaggtgtggtggcatgcacctgtagtcccagctagtcaggagactgaggcaggaggatcgcttgaacctgggaggcggaggttgtagtgagtcaagatcatgccactgcactccaacctggatgacagagcaagagactccatctcaaaaacaaaaacaaaaaaaagaaaaaagaaagaaagaatagaaatgaaaacacaggctgggaaaagtggctcccgtctgttggccaggctgttctcaaactcttaacctccagtgacctaccagtcttggcctctcaaagtgctggcattgcaggcgtgagccacagtgcccagcccagtcctcttaacataaacagtttaatgtcaattaatgcttaaactcaatgttaagtcaactcaaactcaggtcagtgctcatttaactgtaatgtcaattaatgcttgatggcttgctatactaatggcatttgaaacaactgtctccaaaaggaattgtctgatggtctgcaaggagtgatctcggactgaagaccttaccacactgatgacatttgtaagatttctgtccagcatggattctctgatgtctattgaggtgtgaatgtgaagtaaacgctttgccacaatcatcacacttgtgagtttctctcctgtatgaatcctcctatgttttgcataggatgaaacttgactgaagaccttgccacaatcatgacatttataaggtttctctccagcatgagttcgatgatgaatagcaatatatgaacgatatctgaaaaatctgtcacatttattacacttgtaagatctctcattatggattctccaatgatttgcaatggttgtagcattactgaaaactttgtgacaatcattatattagtcaagtttccctatactatggattgcttgatggtgaataagtggtgactgcccactaaaggctttgccacactcattgcacttgtaaggtttctctccagtgtgaattctagtatggtgtgccaggtgtgaatcactcccaaaagccttgttacaaaccttacatttgtatgttttttctccagtatgaattctcctgtctttcaagctgtgatttgtgactgacaactttgtcacagtcttcacatttgtaagatttctctgcagtatgaagactatgatgacttgcaaggtgtgactgttgattaaaaactatgccacattcattacacttgtagggtttctctccaatacgaattgccttttgaattacaaggtatgaattttgaccaaaggtgttgccacactcatcacatttgtaaggtttctctccagtttgaattctaatatgttttgccaggtatgaattatattcaaaaatcttgtcataaaccttacatctgtgtggtttctcttcagcatgcattttcttatgtgtttcaaggtttgatttgcaaccgaaaactttgtcacattcttcctatttgtaaagtttctctgcagtatgaattctatgatgacgtgcaagggttgttttttgattaaaaaccttgccacattcattacacttgtaaagtttctctccagtatgaatggctttgtgacttacaagggttgaattgtgatggaaggtgttgccacactcattacacttttaaggtttctctccactatgaagtctatgatggtatacaaggtttgacatctgactgaaggtcttgccacactcattacactttcaaggtttctctccactatgaagtctatgatggtatacaaggtttgacatctgactgaaggtcttgccacactcattacacttgtaaggtttctctccagtatgaactctctgatgctgtgcaaggtgtgcttgttgattaaaaaccttgccacattcattacacttgtaaggtttctctccactatgaagcctatgatggtatacgagggatgacatctgactgaaggtcttgccacactcattacacttgtaaggtttctctccagtatgaagcctacgatggattataagcgatgatgtctgacggaaggtcttgccacactcattacacttgtaaggtttctctccagtatgaactctctgatgttgtgccaggtgtgaatccctccggaaagccttgtcacaaaccttacatttgtacggtttctctccagtatgaatcctcctatgtctttccatgtgtgatttgcgactgaaaactttctcacattcttcacatttgtacggtttctctgcagtatgaagtttatgatgacatgcaaggtttgcttttgtactaaaaaccttgccacattcattacacatgtatggtttctctccagtatgaactctctgatgttctgtaaggcatgaatcactccggaaagccttgtcacaaaccttacatttgtatggtttctctccagtatgaatcctcctatgtctttcaaggtgtgatttgcacctgaaaactttgtcacattcttcacatttgtatggtttctctgcagtatgaagtctatgatggcgtgcaagagttgattgttgattaaaaaccttgccacattcattacacttgtaaggcttctctccagtgtgaattatactatgttttgccaggtatgaattatatgcaaaagccttgtcacaaaccttacatttgtatggtttctctccagtatgaatcctcttatgtctttcaagatgtgatttgcgactgaaaactttttcacattcttcacattcataaggtttctctccagtatgaagcctacgatggcgtgcaagggttgacagtcgattaaaaaccttgccacattcattacacttgtaaggtttctctccagtgtgaattatagtatgttttgctaggtatgaattacatgtgaaagctttgtcacaaaccttacatttgtatggtttccctccagtataaattatcttatgtgtttcaaggtgtgatttgcgactgaaaactttgtcacattcttcacattcataaggtttgtctgcagtatgaagcgccttgtgaaggaagagggatgtattgtgaccaaagatcttgccacactcattacacttgtaaggtttctcatcaatgtgagatctacgatggcatgcaaggtatcgcttctgattaaataccttgccatatacatcacatttacattgtttctcttctaagtgggttatctgatgtttttttaaaagtgagctacaattaaaggatttgccactctcaatacattggaaagatttttctctcatgtgtacattccgtttttgtgtgagtaatgaagaatggagggaattatttccatacttattagaaatatgggttttgggcctacaacaaattctttgggatgttgaaactgaggaagcattgttgatagacttctcaacttgattaccaattttcccttcaggctgaaatatgtgcagttcaggcagatgcgaatgaaagcttaatccaagctgatctttaatatgcttgtttccagcatgcctttgatcatgttggcctgtactaccagtcaactctttgatttctgtcatgggtgctgcatggtcatttgtttcatcttctttccactgaaactggaagccatgaatgtctttctcaattttctggaagcaaaaatctccaatgtgatgacttgcttgtctttgcaatgtccctgtgtggaacgcttctgtattgccttgccctgttgagaagaatgtcttcatcatgcatttggaagagatatctacaaaatataaacaccaataggtttccaatgaagtacagatggtgtataatactgaaatgtgtaaatatgacacaaaaaacaatacttattttaaacttcccaaacatgatcttcaaagtttaagaacacaaaaggagtaagattctttaataaataaagggcgattatatgtctttcaaatcaattccatgaaagtctatttcctatatcatgacaaaacactgacagggcacaaacatgtgtgagcctaaagtaaggagtgtttttccactgtgaccctaaagtgtatcacactttgcaaaaaacacatcactatcacatcaaaaaaagaaaaatatatattcttcatatttacagcgtatttagtgtatacaaataaatgctaaagaaccacacaatatactatattggtaaataatccaaaacaagctgttgtaaggataaccaaaatcaatggaaattctgtattgtcaaacaatcatagcactgacaagataacaaaagattataaaaattagccaggtatggtggcccgtgcctgtactcacagctactctgaaggctgtgtcacaagaattgcgttaagccaaaggcaaaggttgctgtaagccaatattacaccactgcactccagcccaggtgacaaaatgagcctccatctcaaaaaaacaaaaaaacaaacaacaaaaaaaggcagggcatggtggctcatgcctgtaatcccagtacttctagagggcaaggcaggcagatcacctcacgtcaggagtttgaccagcctggccaatgtggcaaaaccccatctgtactgaaaatacaaaaagtagctggcatggtcacaggtgcctgtaatcccagctacttgggaggctgagtcaggataatcgcttgaacttgggaggcaaagattgtggtgagttgagatcgcaccactgcactccaccctggatgacagagtgagactccatctcaaaaaaaggaaaatgttaataccatatttttccaaataactgttacaaaattacctatatccatgtggaacaggcacgttgtgactttttttttttttttttgcgacgaaatcttgctctgtcgcccaggctggagtgcagtggcatgatctcggctcactgcaagctccacctcccgggttcacgccattctcctgcctcagcctccccagcagcttggactacaggcacacaccgccatgtccagctaacttttttgtatttttagtagagacagggtttcactgtgttagccaggatggtctcgatctcctgaccttgtgatccccttgcctcagcctcccaaagtgctgggattataggcatgagccaccgcacacggccgacttttaaaaaaaattttatgtatttttatttttttgagatacagtgtcactctgtcacccaggctggagtgcaatggtatgatcttggctcaatgcaacctctgccttggggttcatgtgagtctcttccttaggttctgagcacctgggaatgcaggcacatgccactgtgcccggctaatttttgtatttttagtagagatggggtttggtgaaacctgttggccaggctggtctcgaactcctgacctcagatgatccacacatctcagcctcccaagacctgggattacaggcatgagccactgcaccctgtggcactttgtgacattatctaggggagtgtcagttatattgcataccacataccgaaaactcacatataaagtcataaaaatcaattaatcaaatattgcaacccatgataaaacaagcaagaaaataacaagtagatttatacagactgaagaattctaaacaattccctcttaagaaaaaagccaaaacttgtacttaccaccagcacacaacataagaactgaaatagatgttaagatcactactttctgatatatgaggtcaagaaagtatacagcattataaagaatgagaattgactaacagccaggcacggtggcgcatgcctgtaatcccagcactttggtaggctgaggcaggtaaatcaggagttcgagaccagcctgggcaacatggtgaaaccccatctctactaaaaatacaaaaaaattagctgggtgtggtggagggtgcctgtaatcccaggtacttggtagtctgaggcagaaaacatttgtacccagaaggtgaaggttgcagtgagctgagatcatgccactgcattccagcctgggcaacaggatgagactccatctcaaaaaaataaaataagataaataactacttctcaaataagctttggtagatgtggtattctctaataggatgttcctgcagatgcagaccttgagagaatttagcatgggtgtcgactactcatgaataggactagtgcatttatagagacattaaagagcgtgttgcctgttcctcttttcactgtattaggacacagcaggaatatggctggtctaaagcatgaagaaggctgtcaccaggaaccaatttggctggcaccttgctcttggatttcccactttccaaattcatgagaaatcaatgtctttgtcttaagcctcccagtttaagcaatttccttttttgtttgtttttgagatggagtcatgctctatcacccaggctggagtgtagtggcatgattctcctacctcaagtgattctccctcctcagcccagtcttactctgtctcccggtctggagtagagtagcgtgatcttggcgcactgcaacctccacctcctgggttccagtgattctcctgcctcaacctcccaagtagctgggattacaggcgcacgccaccatacacagctaatttttgcatttttagtagagacagggtttcaccatattggccaggcttgtctcaaactcgtgacctcaagtgatcaaccgatcgcagtctcccaaagtgccaggattacaggtgtgagccactgcacctagcccatttttggcatttagtaaattcgaggtttcaccatgttggccagactggtctcaaactcctgacctcaagcgatctacccaccttggtctctgaaagtgctgggattagaaaagtgagacatcacagctggccagtctaagctatttctaacaggacagtgaaatgacagagacaggagaaagagcatctcatcatcaacatcaccaaaggctgacaaatcttattaaacaaaggaagttaagagtctgtactgtaaaacttgcaatacttgaagccatctaatagcactaacatgttttaaaaaacttgagacaggccaggtgcggtggctcatgccagtaatcccagcattttgggaggctgaggtgggaggatcacaaggtcaggagattgagaccatcctgcctaacaagctgaaattctgtctctactaaaaaaatacaaaaaattagcccgcggtgttggcactcacctgtagtcccagctacttggaaggctgaggcaggagaattgcttgaacctgggaagtggaggttgcagtgagccgaggtgacaccactgcactttagcctgggtgacagaccgaaaatctgtctcaaagaaaaaaaaaaaagaaatgaaagaaggctaaagagtaactccaacccacaagcatatataaagttctccaggcctggtgtggtggttcacgccaataatcccagcactttgggaggctgaggctggcagatcaccaggtcaggagattgagactatcctggccaaccaacatggtggaaccccatctctactaaaaatacaaaacttagctgggtgtagtggtgcacacttgtagttgcagctactcgggaggctgaggaaggagaattgcttgaacccagaaggtggaggttgcagtgagcagagatcacaccactgcactccggcctgggcgacagagtgagactccatctcaaaaataataataataaaaataaataaataaataaataaataaagttctccagtaaaggtagtaaaaacagataggccaagcatcgtggttcatgcctgtaatcccaacactttgggaggatgagctgggcagatcacctgaggtcaggagttcgagtccagcctggccaacaaaaagaaacagtctctactaaaaatacaaaattagatgggtgtggtggtgcatatctgtaatcccagcttctcaggggcctgaggcaggagaatcggttgtacccgagaggcagaggttgcagtaagctgagatcgcagcatcgtacttcagcctgggtgacaacagcaaaactcagtctcataaatacataaagtaattaattaataaaaggacagatacagaaactggcatatgtataccttcataactaaacttttttcatatttaaaataaaaggcatgaaaaacactgtacatatatgttaacaaaaatgcaacatacacagaaataattctgacaaataaaaaaatgttctagtggagaagaagaagtcatttttgcaggttacagaattttttttttcttcttttgaaacagagtttcactctgtctcccatgctggagtgcaacggtgcgatctcggctcactgcaacctctgccttccagattcaagtggctctcctgcctcagcctcctgagtagcttggattacagccacccaccacggcgcctggctaatttttgtaactttagtagagacgaagtttcaacatgttaaccaggctagttttgaactcctgacttcaggtgatatgcccatctcagcctctcaaagtgctgggattacaggtgtcagccactgcacacgtccaggttatggtaattttaagtttctttattatgctataactttaatatgtttaacatacctgcaacaataacctctgcccaaatatctaaagaactacaagacaaaactatttaaaataataacaatggttaggcatggcagctcatgcctacggtcccagtgttttgggaatctgaggcaagtgggtcacttgagatcagaagtttgaaaccagcctggccaacatggtgaaacactgtctctactaaaaacacaaaaattagctgggcatggtggtgagcgcctgcagttccagctactcaggaatctggggcataagcatcctttgagcccaggaggcagaggctgcagttagccaagatcgtaccagtgcactgtagcctgggcaacagagtgagactctgtcataaaaaaagagagaaagaaagaatagaaagaaagagcagagagataagcgggggcaaagaaagatatcttttcagagatgtgaggatttaaacttttcttttgccacagaattctcccacttgcagagagtttccccacacactatttgaaggtggagcttccactctgcccatctgagctcttacctgcgtttgcacctgtaatacattcccacccatctggatttttttgttattttcacttaactctccacagtccagggctctttcccttgctccaacatggagacagcaggtcagaaagagactcctgcttataaaaagaaaggaccataacatgctggagcttttctagagtcccagccctatgtttctgtaggaaagaagacattacagatgaatctaggaaaatatttcacaaattcctccactgactgcctcattctgaatgcttggggagcactgtaatatgtagtatgtggacatcgagctctcttccaagaactacagaatcgaaagcacaggagaagcaaacagggaactggatatctttaaagtctgccataaggtttgtttttgtctttgttttttgagacagagtcttgctctgtcgtccgggctggagtgcagtggtgtgttctcagctcaatgcaaaacttggcctcctgggttcaagtaattctctttcctcagcctctctaggagctgggattacacatatgcatcaccatgcccggctaacttttgtatttttagtacagacagggtttctgcatgttggccatgctggttttgaactcctcacccatagcgatccacacgccttggcctcccaaggtgctgggataacaggcgtgagccaccacgaccaggctgccataaagttttatgcctactttacttctggaagctccactgagctatcatgaagaatgcagaacctctaaacaaaggggacagtgaaagtccagatgctacatcatgaagcttttcatttcaaaatcaatacggcttccattttagtcaagtaaggatgtggctcccaagaggcaacaagagaaaatacaaagatacacaagggcacatccccaggaggttatcctcacccagggagaccaggttcctataattctccagcatcacatccctgtaaagagtcctctgagcagggtccaggcatttccactcctcctgagagaattctatggccacgtccctgaatgtcaatagaccctgaaatggaaacacattttaaccaaatggttatggtggagttcttatctttacagaaaatgacaagagagggggaaagcatggatttagttgtagtgaatgttctcacaaatccgagtgacggatttttcaccacatgatgtttttattatactttttgaagtgatcaagacacactttcagtatgaaattcctaagtttgtgaaaaattcaagaaataaataaaaaatcagtgttggattcctgttataaaaatgtttgaaacttttatagacacaccaagtgacattcattatctagatgagagagagcatgactgatgtcttaaaagatgacaatgtccacagtaagagacaggctgggcacagtgacacatgtctgtaatcccagctacgcaggaggctgaggcagaattgcctgatcctgggaggcagaggttgcagagatcccagacagtgtcactgcactccagcctgggcaacagaaactccatctcaaaaaaaaaaaaattaaaaaaaaaaacaaaaaacattagctggacctggtggcaggcacctgcggtcccagctacttggaaggctaaggagggaggatggcttgaccctgagggtggaggttgcagtgagctgtgatcccaccagggcactcaagcctgggcaacaaaccgagaccccatctcaaaataaaataaaatacgtgaaaacaaaattactcaaagtacaaaaatcaattgtgtttctaaattttcacaaaataataaaacctagagactcacaaaacactagatgtgaatacaaagggttgtcatttgtcccagattttcaaaatataaaagattttcaaaatatatacagatgtgtgtatatatgtatttgtatgtatatgtgtgtgcatgtgtgtggggatatatatgtacatatatgaagttttaaaaaatataaaaagtagcaagttttgtttaactgaagaggaatctcatcttgctggaaaaggacacttgggcagttgcgggcagggggaatcttgtcagatctaagaaaatggaaatgccccatcctagaagaagcaatcaccctttcaactgcctgacctggaggaatgttcagatatctgtagtaatgcggacgtgcacagaggcagccactatggcactctttatacagggaaaagttgcaaaggacacatgtgttgtcattcagccaatttccaatgcagatgtcaaagagcaagctagccatgtttactaacatgacaacatgtaaattcacaactagcaggatgaaatatcgaactaaaatatttactggaacacaaagaagaaaatagacactggcgtctacttgagggtggagggtgggaggaaggagagaaacagaaaacataactattatgggcctggcgcggtggctcacgcctgtaatcccagcactttaagaggtcaaggcgggtgaataaccaggtcaagagttcaagaccagcatggccaagataatgaaagcccttctctactaaaaatacaaaaaatagccagacgtggtgttggctgcctgtaatctcagctactcgagaggctgaggcagcaaaacgctttaacccaggaggagggggttgcagtgagctgagatcatgccacttcactgcagcctgggtgacagagcgaaaaaaaaggagcccagtctgagcggcgaaggcggcggcggcggcggtggcggtggtggcagtagcactgggcctgcgggcggtccgggatccaggccggggcggcgccatcttgtgcccggggccggtggggaggccggggaggttgccccggggggcgcaggggacgatgggaacggcctggagtctgaggaactggagcctgaggagctgctgttggagccggagcccgaagaggagccgctccagccccgcgccccatgcctgggagctccaggacctgggcctcgttcaggagccaccggcagccaagaggagggggaggagccgggactggtcgagggtgacccggggctggaagctatcgaagctggagtcagggaggtggaggaagaagctgagaagctaaaggagctacagaacgacgtagagaagcagaggaatatgagtctacctccaggcaatgctggcccagtgatcacgtccattgaggagaagatggaggctgatgcccgttccatcaatgctggcaatgtggactgcggtgcaacagcagaagagctggaagctcactttcatggctgtggttcagtcaaccacgttaccatactctgtgacaaatttagtggccatcccaaagggtttgcatatatagagttctcaaagagtcagtgaggacttccttggccttggatgagtccctatttagaggaaggcaaatcaaggtgatcccaaagcgaaccaacagaccaggcatcagcacaacagaccggggtcttccacgagcccgctaccgcgcccgaccaccaactacagcagttcctgctctccattctacagtggttttaacagcaggctctggggtcgcgtctacaggggccgggctagagcgacatcacggtattccccttactaaaaaaaatgtgtattaggagagagaggaaaaaaagaggaaagaaggggaaaaaaaaagaataaaaaaaaacccaaaaaaaacagaagatgaccttgatggaaaaaaatatatatatatttttaaaaaaagagtccctctccctctccctctccccctccccctccccctccccctccccctccccctccccctccctctccctctccctccacagtctccctctgatgccgagccaaagctggacggtactgctgccatctcggctcactgcaacctccctgcctgattctcctgcctcagcctgccgagtgcctgcgattgcaggcacgcgccgccacgcctgactggttttcgtttttttttttggtggagacggggtttcgctgtgttggctgggctggtctccagctcctaaccacgagtgatccgccagcctcggcctcccgaggtgccgggattgcagatggagtctcgttcactcagtgctcaatggtgcccaggctggagtgcagcggcgtgatctcggctcactacaacctccacctcccagccgcctgccttggcctcccaaagagccgagattgcagcctctgcccggccgccaccccgtctgggaagtgaggagcgactctgcctggccgcccattgtctgggatgtgaggagcccctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccaccgccctgtctgggatgtgaggagcgcctctgctgggccgcaaccctgtctgggaggtgaggagcgtctctgcccggccgccccgtctgagaagtgaggaaaccctctgcctggcaaccgccccgtctgagaagtgaggagcccctccgtccggcaaccaccccgtctgggaagtgaggagcgtctccgcccggcagccgccccgtccgggagggaggtcgggggggtcagccccccgcccggccagccgccccgtccgggaggtgaggggctcctctgcccggccgcccctactgggaagtgaggacccctctgcccggccagccgccccgtccgggagggaggtgggggggacagccccccgcccggccagccgccctatccaggaggtgaggggcgcctctgcccggccgcccctactgggaagtgaggagcccctctgcctggccagccgccccgtccgggagggaggtgggggggacagccccccgcccggccagccgccctatccaggaggtgaggggcgcctctgcccggccgcccctactgggaagtgaggagcccctctgcctggccagccgccccgtccgggagggtggtgggggggtcagccccccgcccggccagccgccccatctgggaggtgaggggcgcttctgcccggccgcccctactgggaagtgaggagcccctctgcccggccacgaccccgtctgggaggtgtgcccagcggctcattgagaacgggccatgatgacaatggcggttttgtggaatagaaaggcgggaagggtggggaagaaattgagaaatcggatgattgccgggtctgtgtggatagaagtagacatgggagacttttcattttgttctgtactaagaaaaatacttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagggacctctgcctaggaaaaccagagacctttgttcacttgtttatctgctgaccttccctccactattgtcctatgaccctgccaaatccccctctgcgagaaacacccaagaatgatcaataaaaaaaaaaaaaaaaaaaaaaaaagttttaagtgtgctgtgtagagagtggcatgcttggatgacataaactgggcaagcctttgaggaaatgcatcaccctgattactatagttttaaggctacttaaaaggtccctatgtccaaagaataccctctctgctcactggatagcaggtgaaattccacaatctgagcttcaatccttgaggttaatgcttagtaataaagttaaactaaactatcacccaatttaagcaatttatacattgtgaaaagagaacaatgcaactcagatgaaattttcctaaatctccagttgtggtaatcttggttaatgctttattgtcactataccaatacttttgcatgtatttaaaatgacgctactcatagtaattgcttatctgctcagtggagcaatttaggactacccagcagtcttttaaaaccttggcatttatgaagattaaaaacttgaatggtgaaaaaaaaaaaaaaaaaaaaaagacatactgtggaaggacagagaatccctaacaaactgctgaggagggacctgttttggggagcaggggaaggcccagggagtggggcagggggcggcttattcactctggggattcgccatggacacgtctcaacagtgcaagctgctccccgtgtttccctgccccacttcgcccccgtaggggctgctccagggtaggcgggcgggggtggtaggaggtttttttttttacccagggctctggaaggacaccagactgttcggcttgtcaccttccctccgtcttctcctcacctttcacagtcccctcctgcctgctcctgtccctccaggtctaccacccaccccacccctcttctctggccccctgcccctccagattgcctggtgatctattttgtttccttttgtgtttctttttctgtgttgagtgtctttgtttacaggtttctgcagccagaagatctccgttccgctcccagcagctccactgtaaattccccttccccatggggaaatgcactaccttgttttggggggtttagaggtgtttctgtttttcagttttttgttttgttttgtcttcctttgccttttttcccttttatttggagggaataggaggaagtgggaacagggaggtgggagatggactctgtttatttttttaagctcatttccaggggtgggaattttttttaatatgtgtcatgaataaagttgtttttgaaaataaaaattgtttggacttttacaaaaaagaaaaaacttttttaagttactacagaatttcttctaaagcctcataatgctgcagaaatacacgtgtacaagacttgctctgacacctggcacagaactgacagtaacggctccccagggaggctggaaggaggatggaggacgtgacagggaaaggagatgctttatggccaagggtctaagctgcagctttcttggagcgttaccaccaaacaaatatacacatcgtgtgatgtttaaatataaccatatatatttaataacaattggtggggctgggcatgatggctcgtgtctgtaatcccagcattctgtgaggctgaagcaggcggatcacctgaggtcaggagttcaagaccagcatggccaaaatggtgaaacaccgtctctcctaaaaatacaaaaaaaattagccacgggtgatggcacgtgactataatcccagctacttaggaggctaaaacaggagaatcacttgaacctgggaggcagaggctgcagtgatccgacatcacaccactgcattccagcctggacaaccgagactttgtctcaaaaagaaaaaaaaaagctgggcgaggtggctcacgcctgtgatttcaaaactttgggaggctgaggtgggcagatcacgaggttaggaaatgaaaaccatcctggctaaaaaggtgaaaccccatcactactgaaaataccaaaaaattatctggacatggtggcactcgcttgtattcccagttactcaggagcctgaggcaggagactcgcttgaaccaggaaggcagaggctacagtgagccaagatcacaccactgcgctccagcctgggcaacagagccagaccttgtctcaaaataaaataaatatatgaaaacagaattactcaaagtacgaaaatctttttttgcatatatatgccccaaaaataataaaaccttcaaagactcacaagaaattagatgttaataacaaagtggtcattttccccagactttcaaagtatacatgtgtgtatatatgtatgtatatgtatagatatgtgtgtatgtgtgtgtatatatatatttatatatatatataaaggtttttaaaatataaaaagtagcaagatttgtttaaccgaagaggaatcttgccttggtggaaaggatactttggcagtgggaggaaggagaggagcagaaaaaataactattgggcccgggcacagtggctcacacctgtaatctcagcactttgggaggctgaggctgctggatcacctgaagacaggagttcaacatcagcctggccaacatggtgaaactcttgtctctattaaaaatacaaaaattagccaggtatagtggcaagcacctgtagtcccagctactcgagagtctgaagcaggagacacacttgaacccgggaggtagaggttgcagtgagccgagatcatgccataatactccagtctgggcaacaagatcataactcagtctcaaaaaaataaataaaaaaaataactgtctgggcgtggtggctcacgcctgtaatcccagcactttgggaggccgaggcgggcgaatcatgaggtcaggagatcgagaccatcctggctaccacaatgaaaccccatctctactaaaaatacaaaaaaattagctgggtgtggtggcaggtgcctgtggtcccagctactcgggaggctgaggcaggagaatggtgtgaacccaggaggcggagcttgcagtgagccgagattgcaccactgcactccagcctgggcgacagagcgaggctccatctcaaaaaaaataaataactatcgtgtactggccttgacaacggtgtgatgaaataattggtacaacaaactccaatgacgtgagtttgcctctgtaacaaaccttcacatgtagccccaaacgtaaagtaaaaaaaaatacataaaaatttttctttaatttacaacagaattttttttaaagtctcataatgatgcagaaatacacgtgtacgagactcgctctgacagctaacacagaactgacaatagtggctcgccagtgaggctggaaggagggtggaggatgtgacagggaaaggagatgccttatggcaaagggtctaagctgcagctttgcttggagttttaccacaaaatatatacatcatgtgatgtttacatataaccatttatattcaataataattgttggggctgggcatggtggcttgcacctgtaatcccaacactcttgggggctgaggcaggcagaccacctgaggttaggagttcgaggccagcctggccaacatggtgaaaccctgtttctactaaaaatacaaaaaaattagccaggcaagccgggcgcggtggctcaagcctgtaatcccagcactttgggaggctgaggtgggaggataacgaggtcaggagattgagaccatcctggctaacacggtgaaaccccgtctctactaaaaacacaaaaaattagctaggcatggtggcgggtgcctgtagtcccagctacttgggaggctgaggcaggagaatggcatgaacccaggaggcagagcttgcagtgagccaagatcataccaaagcactccaccctgggtgacagagtgaaaacatcatctcaaaaaaagaaaaaaaaaattagttggggatggtggcgcgcacctataatcccagctactaggtgggttgagacagagaatcgcttcaacctgggagacagaggttgtagtaagctgagatcatgccactgcactgcagcctgggcaacaaagcaagactccgtttcagaaaataataataataataataataataataataataataaaacgtggaatgagaatacagctttatcctcttagataaaaaagcagtactctccaatattagagaaaaattgcaaccacttttaccaaaaacacctgtttcacaagcctctccacagtaacaccatagtctccgtgagctcgatgtgttaagaatggttgaatgactctcctgctattatttacattgatttcatgttcttaaaataatgaaggaataggccaggaacggtggctcacgcttgtaatcccagcactttaggaagccaaagtaggcggatcgcctgaggtcgggagtttgagaccagcctgatcaacatggagaaacctcgtctctactaaaaatacaaaattagctgagcatggtggcgcatgcttgtaatgccagctactcgggaggctgaggcaggagaatctcttgaacccaggaggcggaggttgcggtgagctgagatcacgccattgcactccagcctggataacaagagtgaaactccgcttcaaaaaaaataataataatgaaggaatcattaatgtattattcatctatgtatgaacattccattctaattagtaagatttttggagtcagaaacacaggaactcactcaattacctaaaaatgtggtataaaatcagggagaaaagattttcccttattggtctccttttctagaattgaccacgtactttgtgcacattaatacttgactcccattggcagctgctctaatcctggtccacagagagctgacagtgcatccagatgtggcccctgaacaaaccctgctgcccaacagcactgacaccacgggaccctcaccccgtctccatccatgtctgggtgtgagaccttcccaggaccatgcccagtgcagcctctcccatgttcatgtcactgggtcaccagagatggaatctaagcgagatgagatgaactgaaggaaggcatgggtgagggtgagcaaacatatcaggcaggacacttcagactcagagaagactcccaactccaaggcccagcgtttctgaaaggaaggagacagagcaatccaccgagaataccatctcacctgaggaagagccatccctgactcctttgctttcctcttcctcttctgggtttcttcctcacgtaccaagattctttagaagtcaatcctgaatgttaaaaatatgttgtttattgctcagaatcaacacatcccctccctgtaacacaacaacacatacaaaggagacttcaccttgaggaaatatggtcccctatgctgcctaccgcaccacgaacaaaaaattcctacaggaaaactcccactctactcctggagaagcccacacacacgctgcagcagtggggagctgggctgggatgagctccccttcaggaaatctctaccataaatacaaaaacttagccagatatggtggtgcgcatctgtgtgtctgtggtcccagctacttaggaagctgaggtggaaggatcacttgagctcagaagttcgagaccagcctggccaacatggagaaaccctctctctactaaaaatataaaaattgggctgggctcagtggctcatgcctgtaataccaacactctgaaaggccgaggtgggtggattacttgaggtcaggagttcaagagcagcctggccaacatggtgaaaccctgtctctactaaaaatacaaaaagtagccgggcttgatgcgcatctgtaatcccagctactcaggaggctgaggtagaattgcttgaacctggaaggtggaggttgcagtgacccaagatcgcgccactccactcctgcctgggtgacagagtaagactcaaaaataaaaaaatacaaatacaaatacaaaaattagcagggtgtggtggcacacacctgtaatcttagctacttgggaggctgaggcacaagaatcacttgaacccaggagatacaggttgcagtgagccaagatcacaagactgcactcatagcctggaggacagaatgagagtctgtttgggaaaaaaaaaaaaaaaaaaagtgcatttctgatgggactgacacagagataagaagacttgagtaatgtgatagacactgatgggcagagggaacttcagatgggggtgggagggcatgggagacagctctgagcctagatctgaaggagaaagggacagtgccatcttcatttagaaacattgaataagaacagggacaacaacctgagacaggaaggattttgatgtttgaaaaaagagaaaagcaaatgtgactggggcagagggagtcagatgagggtaagctcccaggaggaggctggacactggcagggaccctgaacacagggctgtggagccaaagtgaagagttgggcttttgtcctggggaacacgggaagcaggtggagggttccctgccaggcactgacatgacctgctttagatgtagctgtgatattctaatacagacaaagtcctccgaagatggtctctctttctgagtctaccactctctttcttccattctattgcttttttttttcatttttggggtactgcatcccactgaaaattctaattacaactgggcactcccctctaccagaaaaaaagccacacccagacacccactctattttgccaatcatttcagtggccagggtcactcgggttgagcttttctggtctagcccctcatctccaagttgcaggggaggctcactggggctcagagctggaaacattttcacgaagttaccctgagaaggtctgagatgagtgagaaggtgtgcctgaattcttacatgggggcctggaagggctaatgggatggactggtcttatcatcccatccttaaaattagagaagcatctttcacatgcctgggttaaagaaaattcttttgaaaggttctgatgaaattgactcccaacattgaattcttccttacaagaaaatcacactaacatttataaaatgcagcagtgtaaacacacagctcttgaccttgaaaacagggtcaactgtagaactaagacataagcaaattatttcaatcaagaatacatgggtggacagctgaggtggttcacacctgtaattccagcactttgggaggtggaggtgggtggattacctgaggtcaggagtttgagaccaacctggccaacatggtgaaaccctatctctactagaaatacaaaaattagctgggctccatccttgcaacttatttaacctcttttttttttttttttttttgagacggagtctcgctctgtcgtccaggccggactgcggactgcagtggcgcaatctcggctcactgcaagctctgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccttatttaacctcttgttggtccttctccccaatctttagatcgtcctcaatctccatagatttccacctcttctcccctctctgctctccctgttaaattctctcttctctgttataaccccctggacccagtctggcaccccagatccccaggtgtcctccccgctgtgcttctccctctgttctccttgccaccagcaccactctgctctgtctgacccggctccacatccctcctcctctccctcactctgatgagcctccacatttctgcccctctccctaccttgctgtctgtccttcatctctctgtacatctagcttttctctacatttctccagttgcttttctcctcctgctttcttatcttttatcacttttgctgtctcttggcaaatccctcaccatcctctactttgccatctgttatgggtctttctcattcttcttttctctgtctcaggttttctactgctctcttagtccctctctctgtctcctgatccctttggcccacacgatcacacgagggtttggagtaagacacctgcatctcggagaagcgcattttcccagagctggagctgggcgggcaagaacaccccgcgtcacaggacaagccccaggcacctctccaacgcgggctcaggggaagcggtgactgcggaggggagatctggggagcagcagggcccagcaagaggaggagggaggtggggagcgacgacgccttcggacaagggtgggatccgcaggatcccaggaccacagaacgcagccttcccgggactggggtcgccgcgctgtgctccaggaacccaggaggatgaggctgggaggcgcacagggtgggaatacacctctagggtgaggactttaaaaagagccgtgcggaaggagtcaaaaaaaggttttgagcaggaaaactacgagataggaagtgtatacattgccctgtagcagaaagacccgggacgggaccagcctcagggcgactttaaacctaaaaagaaggggcttccggactcccagtagaacatctccatttgctctgagtgaacgaagaaaggggagaacttccaggtctagggggaccccacatcccatgtacagaagtgccggggacctgggaagctcagacttaacaccacacagagcaaaactcaccgcccgccgcggcgtcaccgtcattccacgggatccgcttcctggtctgcgcgaatctgcgcgcgcaggacagaaaccaggcctgggtggagccaacgaggaggcgagcggggcccgggtgaggtgtgggcggggcgcgaagcggcgagaccttgccctttagaacccgcagagggcggggccggagcgggacctgtgagtctcagcctcctcccaggccatgttctcaggcttttgaacccgggagatacagcttgcattgggccgagatcgagccactgcacaccagcctgggcaacagagccagactccgtctctaaaaaaaaataaaaaaataaaaaaataataaaaaaaaaatttgcttgtgcgagacagggatacaacattactcttttccgtgtggatatccagttagttgtcccagcacatttgtaaaagagatctattactttctcctttttatttacatttttttcttttctttttcccttttttttttttttttttttgaggctatttctctgtcgccctggctggagtgcagtggcgagatcttgactcactgcagcctctgcctcctgggttgaagcgattcttctgcctcagcctccggagtagctggcactacaggcacacccaccatgcccggttaatttttgtattttgtgtagagacaggatttcgccatgttggacaggctggtctcgaactcctgacttcaagtgatccgactgccttggcctccccaagtgctgggattacaggcctgagccactgtgcctggcccaggaaatactctttactttgctttttaaatgttgagaaaatacaactgaaaactaaaaaatcttccccgaaatgagaaatcatcttcatgacaaaacaggaagaaataagaactattctattaatgaataagccttagaccagaatgtgttgggaaatagaggcaaacagctaagaggttgaaaagagagaaagaaacttcattgttctatgcaacccgttaagtacatgttttcaagataaacactaatcagtcctcagggaagattagttgacaacagccttggtcgcacatagttcatcctggctgtacttggtaatggaggtgactatctgtgtcagctagttagcttcatgcagagagaggggaattactttaacccacgtctttttgacaagtgtgagttttacaacatggaggcaggtgccgtctctagtgaggctgctacagtccgacagaaactgacgtcagcagtaaataataaaatttagaatacataattaactatagagtttattggaacacaaagcttgaggatagccacctggaaacgtcaactccaaatgaagggggcccgtgttcccaagtagagacgttaaggtttcacacacagggaaagacagagaagctttaccagaatcacattttccattcaaggccagtgcataggctgcagcaaattgattggttatggattgatacacttcaaggaaggttactttatcactccataagaagggacaatgatgccaacaggttagtcttcctaattatttacaggtaaactttttttaaaatttatattaggaaactaaattttattgcactttttgttttgttttgttttggtttggtttttggtacggagtcttgctctgttgcccaggctggagtgcagtggtgcaatcttggctcactgtgacctccatctcccgggttcaagcagctctcctgcctcagcctcctgagtagctgggattacaggcacacgccaccatgcctggctaatgcttttgtattttcagtagacacggggtttcaccatgttggccaggctggtttctaattcctgacctcaagtgatccacccaccttagcctcccaaagtgctgagactacaggcgtgcgccaccgcacctggccagtaaaactcttagaagttgcgcctgcacaccactggactcaggttgcatgaccacgttcctctcaaagctcagaattatttaaatgtccgtagctttaaatttgaaatatttgatgtttgaattatttaacttcctactgagatataggtactatcgcccttgtagtttgccttacaaggatcgttcccaagaccttcagaaatacatccttgggtcattaaactgaaaaaaggcttagttactttctaaaaaataccacttcaggccaggcgcggtggttcaagcctgtaatcccagcgttttggaaggccgaggaggacagatggcctgaggtcggaagttggagaccggcctgaccaatatggagaaaccccatctctcctataaatacaaaaattagcctggcctgttggcatgtgcctctattcccagctactcgggaggctgagggaggtgaatcgcttgagcccaggagacacggaggttgtggtgagccaagatcacgccattgcactccagcccaggcaacaacagtgaaactccgtctcaaaaacaaaaaataaataataataataataataataataaatatggccggcgcagtggctcatgcctgagtgagactccgtctcaaaacaaaataaaacaaaacaaaacaaaaaacaaaaaaaacacattaccagttccacagtagggtgtcctcaaaaacaaaggaaatgcctcctctttaagtttttcttacataggcatccaggtaaatacaaagatatgtctacctgccggttggctgacagtctaacacaacttattactttgttgatttaaagctatccatgactggtcgcggtggctcatgcctgcaatcccggcactttgggtggccgaggtgggcagatcacctgaggtcaggactgtgaaaccagcctggccaacagggtaaaaccccatctctactaaagatacaaaaattagcgaggtgtggtggtgcgcgcctgtagtcccagatactcaagaggatgagacagaagaatcaattgaacctgggaggcagaggttgcagtgagctgagattgtgccactgcactccagcctgggtgacatagagagactccatctcaaaaaaaagaaataactaactttaaagacgaaaataaagaaaaatctggagaggtctcaggaatctctagccagtctgattggagagtgttcttcctcactgaagtcagacaccaaaaaccgtgaaagctggctgatttctgaactgctgaagttccaacagaacataaccagatatacaaagagataacgtggatgatcccaagaaattatacacaaatttataaaacagagacttagaaataacgggactaaaaattcaaaataagcctgggcaacatgttgaaaccatgtttctaccaaaaatacaaaaattagctggacacggtggtgcacacctgtagttccagctacttgggaggctgagatgggaggattgcttgagcctgaaatgcagaggctgcagggcacatggtgctctctcatgttctcagagagggcgcttttacacctgggggtagggatggaatcttcccagatctaagaaatgaggaaatgccacgtcctagaagaagcaatcagtttctcaatagcccctcctgcaggaaccctccagatacatgtagcgaagtcagcacactcacaggcagccagtgtggcattcttggtaacagtgacaaactgggaaggactcacgtgtcttcattcagaaaatgctccaaggagaatgaaaaacagtaagctatcttgcttcctaccttgaaaacatggaatattttaagacttgcaggataaaataccacaacaaaacatttatcatgttgagctcagtggctcacgcatgtaatcccagtacttgggaggccgaggagggaggatcacttgaggccaggagtctaagaccagcctggccaatatggagaaactccatctctactaaaaatataacaattagccaagcatgatggcacatacctgtaacacagctactcagttggctgaggctagagaatcatttgaacccatgaagcagaggttgcaatgtgctagtaagttccagcctgttgacagggtgagacaccggtctcacaaaacatacaaaacaaaaaacaacaacaaaaaaatcatttggccgggcacagtggctcatgcctgtaatcccagcacttcgggaggctgagggggatggatcactagaagccaggagtgccagaccaccctggccaacatggtgaaactccatctctattaaaaatacaaaaaacttatccaggcatagtggcacacacctttagtcccaggtattcaggaggctgaggcacaagaatcacttgaacctggaggaaagagtctgcagtgaggcaagattgcgccactgcgctccagtctgggtgacaggcacattcatcaaataattttatctaaaatctcataatggtgtctgaatacatttctgtaggacttacgctgacttgccacagtactctcagcagtgattccccattgagccaagggaactggtggaaggctggacaggaaaggggatgcctaagtgaactttctttgtccgggagtggttgctcaacgcctgtaatcctagcactttgggaggccgatttcttgttttaaaagcaataatagaacaaattatcctctaccactgatgttacctccactttccattccattctaagtcattaaaagtgcagagtcaaaactgggaattgcggcaaatgcttgtaatcccagcattttgggagtccaagatggatggatcacctgagttcagaggtctgagaccagcctgaccaatgtggtgaaaccctgtttctactaaaagtacaaaacttagcgctgggtgggctggctcacacctgtaatcccagcactttgggaggatgaggtggaaagatcatgaggtcaggattttgaaagcagcctggccaacaaggcaaaaccccatctctactaaaaatacaaatattagctgggtgtgatggtgcatgcctgtagtcccagctactcagaaggttgaggtaggagaattgcttgaacccgggaggcagaggttgcagtgagccgagaccacaccaatgcactccagcctgggtgacagaatgaggctccatctcaaaaaacaaacaaacaaaaactcagctgggcctggtggtgcacacctgtagtcccagctacttgggaggctgagccaggagaactgcttgaacccaggaggtggagggtgcagtgagctgacagatattgtgccactgccatccagcctggcgacagagcaagactccattctcacccacctaaaaaagaaaaaaaagtgcagagtccagccaggctggctgtctcatatctgttatctcagcaatttgggaggctgaaatgggaggctgaaatgggaagatcacttgaggccaggagctcaaagctatagtgagctttgactataccaccgtactcctgcctggacaaaatagcaagatcccatagccacataataaaaaatgaaagacttagccagatatggtgacacatgcctgtcatcctagctccttgggagggtaatgtgtggatcacttgagaccaggagttcgaggctgctataaactagaattgtaccattgcactccagactgggccatagagcaaaaccctgtctctaaaaacaaaaaaaaaaaaagaaaaaaagaaaattggcttcaaatgcattacaaaatcagaaacaaaatatctccctttattggtctcctttccagaatgcacaagatatcagtgcacattaatgtatggctttcatatgtagtttctgggatccagtccacaaagagctaaacgtgcatccaaatgtggtgcctgaacaatcccagctgccccgcagcactgacaccatggggcccataccccatctccatccatgtctggtgtgagcccttcccaagaccatgcccagtgcagcctctatggaaattcacgtcactgagttatagaagaaggatttttttttttttttgagatggagtcttgcggtgtctgctcactgcaagttccgcctcccaggttcatgccatttttctgcctcagcctcccgagtagctgggactacaggcacccgccaccacgcctggctaatttttttgtatttttagtagagacagggtttcaccatgttagccaggatggtctcgatctcctgacctcatgatccacccgcctcagcctcccaaagtgctgggataacaggcgtgagccaccgcgcccggcctagaagatggaatttaagcgaagatgagagggaatgacagaaggcatgggtgagtgcgagcaaacgtgtcacgcaggacgcttcagactcagaaaagactggctactgtaatacctggcttttcagaaagaaaggagacaggataatccacaaggaatatcaagtatatccatgcaaaacaggcactttgtgattttttttaattttctgtatttttatttttttgagacaaagtcttgctctgtcacccaggctggagtaaaatggcgcgatctcacctaaatgcaacctccgcctcctgagttccagcaattctcctgcctcagcctcctgagtagctgggattacaggcatgctccaccatgcatggctaattgttgcatttttagtagagataaggtttcaccatgtaggccaggctggtctcgaactcctgacctcaagtgatccacccacctcaaccccccaaagtcctaggattacaggcatgaggcactgcacccggtggcactttgtgacattaacaagtgaagtgccatttgaacccgggaggcagaagttgcgctgagccgagatcatgcaattgcactccagcctgggtaacagggagagactttctctcaaaaaagaaaagaagaaatgactaacagtgtcagagggctcaattacgatgttacaactacagttaaataacagccaggccatacagcaattctatatatacgcatttcccttagttatctagttcaccatgcataagatataaaacatagaatgtgtactgggaaaattgataaactgggatcagagaaaacattgtataaaacaaattgtacaacaaaaacattaaaaaaatgatgcaggctccctggtctgaatgtttgtattggccaaaagccatgttcagagttcttattctccaataggatgttcctgcagattcggcctttcagataatttgatcatgggtgttgactactcatgaataagaccagtgcctttatttttatttttatttctttatttatttttttgagacggggtctccccctgtcacccaggctggaatgctgtggcaggatctcggctgaatgcaagctctgcctcccagattcacgccattctcctgcctcagactcccgagtagctgggaacacaggcgcctgccaccacgcctggctaattttgtttctgtatttttagtagagatggggtttcaccatgccagccaggatggtcttcatctcctgaccttgtgattcacccgcctcggcctcccaaagtgctgggatcacaggcgtgagccacctcactcagccttatttttatttttttctttttttattttattttattttattttattttattttattttattttattttactttaagttttagggtacatgtgcacattgtgcaggttagttacatatgtatacatgtgccatgctggtgcgctgcacccactaactcgtcatctagcattaggtatctctcccaatgctatccctcccccctcccccctatttttttctttatttttgagaaagagtttcactcttattgcccaggctagagtgcaatggcctgatcttggctcactgtaacctctgcctcctgggttcaagtgattctcctgtctcagcctcctgtgtagctgggatttcaggcatgtgccaccacactcagctaattttgtatttgtagtagagatggggttttaccatgttggccaggctggtctcgaactcctgacctcaggtgatctgcccgtctcggccgcccaaagtactgggattacaggcttgagccaccgcacccggccatccattgttttgtgttcagtagattcgaggattcaccatgttggactgactggtctcaaactcctcgcctcaagcgatctacccccctcagcctcccaaagtgctgggattagaggtgtgagccaccatggccagccagtctaagctgtttctgacaggacagtgaaatgacggagacaggaaaaggagcatgtcatcatcaacatcgctgaaggctgacaactcttattacacaaaggcagtttacagcctgtcatataaaagctgcaatgtgtgaagccatctaatagcactaacttgtttaaaaacctggaggcagctgggaacggtggctcatgcttgtaatcccaacactttggaagaccgcagtgggtggatcacctgaagttgggagtttgagagcagtctgactgacatggaaaaaccccgtctctacttcaaatacaaaattagctgggtgtgttggtgcatgcctgtaatcccagctacttgggagcctcaggcaggagaatagcttgaacctgcgggcagaggctggagtgagctgaggttgcaccactgcagtccagcgtgggcaacaagagcgaaactccatctcaaaaaacaaacaaacaaaaaatctggagaaaaattaacattatttctcaaataagttctcaaataagtacagcaggcccacagtgttcacgtacatgaccccaatttgcacatacagtaagtgagggacaaacttgatcctgggcctgaaggatcccacgacatgtttctaagcacaatagtccaccaagaaagtacagaaaacaaccagtcacaaaaaatacaaggagaacagaaagaagtacatcaagggggatacaaggactgagctgggacacaagcgctgagctgcgctgctgacagtggttctgaagccatccctcatggatcatgtgctgagtcatgatgccctgcacacactgatttaagcagcctcctataattttgtccagtggatgaataaggtcttgacttactcagggagagtagtgttggaggggaggggctcacggggaaattggggtgttcacttttacaaagtcaataggctggtatttgcatccagatcaatgtatcatgtgaggcaaggccaggaaaggaagggcaagggtggagagcaggaagtaatgggcatgtaggagtgaactttgtgcatgcacatctgtgggaatataattccaccaggatagaccaaatcttgagctcggaggaaagtggaactaatttagcaaatggtaaaacattgacccaagcttaaatatgcaaattacaatacaggcaagggacaagaatgaacgagatccaaaaaagcagcagtatggtgacctgaggtgaaagcagttttacgtctcttaaattaaatggcctctgatacctagtttcaagcatatactcaacaatatgccttgtatagattccagaatttcatacacacacacaaaatgagtaaagtctacgaggagtgcagcaatgaaggagaccatggatgtgaagaattccctggctgagtaggtagagatgtgtctgtggaaacagagacagactgagcgcagtggctcatgcctgtaataacaatcataataataatgacaggttttttctgttttctctttttttgagatggagtgtcactctattgctcaggctggagtgcagtggtgtgatctcggctcactgcaacccctgccacccaggtttaagcaattctcttgcctcagcctcccgagtagctgggataacaggcgcctgccaccaggcctggctaaaagtttgtatttatttttgtttttttgtttttttgtttttttttgagacagagtcttggtctgtctcccaggctggagtgcaatggtgcgatctcggctcactgcaagctccacctcccagattcacgccactctcctgcctcagcctcccaagtagctgggactacaggtgcccgccaccacgcccagctaattttttttgtatttttattagagatggggtttcaccgtgttagccaggatggtctcgatctcccgacctcatgatctgcccacctcggcctcccaaagtgctgggattacaggcatgtgccactgctcccatcctaaattttgtatttttagtagatacagggtttccccattttggtcaggctggtcttgaactcctgagcacccgactcagcctcccaaagtgctgggattacaggcataagccaccatgcccagccccttcttactattaactcattattgtgatagttgacaacaatgaaaaatcttaaaatcattacaattattataaaaaataaaacaatgcaaatgttgtgttttctacataaaccatgggcttatccatccacgtattcatgcacacacatcacatcacagtgtaatcccagctactcgagaggctcaggcaaaagaatcgctgtaatccaggaagcggaggctacagtgagaaaatatctcactactgcactccagcctgagtgacagattgaaactgaactaacaaaaaaataagtaaaatcaatgatgtgataaagcatcctgtaccactgatgtgtatcttcactttccattcctttccgagtcattaaaactgcagagacaggccgggcacggtggctcaggcttgtaatcccagcactttgggaggctaaggtgaaaaaacacaaggtcaggagttcctgaccagcctgaccaatatggtgaaatctcatctctactaagaatacagaaaaattagtcaggcaaggtggcacatgcctgtaatcccagccactcgggaggctaaggcagaagaattgcttgaacccaggaggcagatgttgcagtcagctgagatcccatcactgcactccagcttgggcaatagagcgagactccatctcaaaataaataaataaataaaacaattagccgcttgtggtgacacatgcctatcattcaagctctttgggaggctgaagtggggattacttgagccaaggagtttcaggctgctgtaaactctaaattgtgccattgtactccagaactaagctacagagcgacattttctctctctctctccttttttttcttttgagatggagtcttgccctgttgcctaggctggagtgcagtggcacaatcttggcttactgtaacctccacctcccggattcaagtgattctcctgcctcagcctcctgagtggctgagattacaggcatgagccacgacttccagctaatttttgtatttttattagagatgaggttttaccacatgggccaggctggtctcaaactcctgacctcaagtgatccacctgccttggctcccaaagtgctgggattacaggcataagccaccacacccagaccaacatcctgtctactagtgtgccttcaaatgcattaagaaattggatacaaaatgtctccccttattggtctccttttccagaatttaccagatatctgtgcacattaatgtatgtatttcatatgtagtttctctgatctggtccacgaagagctgacatccagacatgacccttgaacaatccaggttgcccagcagcactgacaccatggggcccacaccctgtgtccatccatgtctaggtgtgaggccttcccaggaccatgcccagtggaacctcttctcaagttcatgtcactgggtcacaggagatggaatctcagagcaggtgagaggaactgagggcaggcatgggtgagtgtgagtgaacctgtcaggcaaaatgcttcagactcagaaatgactggctactaaatacctggtgtttcagaaaggaaagagacagattaatccaaagaggaatatcacttcacctgaggaagagccatgcctggctcctttcctttcctcttctgagctgcttcctcatgtaacatgagtctttagaaatcaatcctgtacgtgaaaaaagtatgaaacttcacgtagaaatgactcactcccttcctgtgacaaaaacacacagacaggggagatgtcaccctgtagaaagatggtcctctgaggcccactgcaccagagatcatgcagagataagaaagtcccaccggaagacctacaagtgtatgtttgaccccagtcttcagatctcgcccccctcctggagaagccaccacacacgaggcagcagtggggagctgggctggactgatctcctcttcagggcacacactcatccctgatcaaaccccatccagaggacaacccctcacttctctgtggatcacaggctgagctcagcccccagaaatggaggactcagagcttcgatgctcaatgctgcacacagatgacaagcaactgcgccactgcaggtattactgagggtgggttccatcccatcagaataagaatccctgctaaagcagcacaaaagctctatttgcaaaatgcctctagactctaatgtgaagccagggttgagctccactcagagggggtgagcccagcacagccccacattctggctctgccctccccttggggccttgttctcaccaggatccagacagtggatgacaaaggcacaaaaataatcacacagaacaggcaacgtggacgagaggtggggtgaatgatgggctgtgtgaaaggaaataaatctgtgagcccccaaatcattaagcaaaaggcaaaagtcaagctgggaactgcttagggaaccagactccccttctattcaaagtcacccctctgctccctgatatagatgcatgtctgagtgcctccttcaaaaggctaatcagaaactcaaaagaagggcccagcacagtggctcatgcctgtaatcccagcactgtgggaggctgatgcagtgagctgagatcataccactgcactccagcctgggcaacaaaatgagacttcatctcaaaaaaacaaaacaaaacaaaacaaaaacttaaaagattgcaaccatctgtgcctcatttatctgtgacctggaagtcacctccctgcttgaacctgggagaaggaggttgcagtgaatcgagatctatagggtccagccctttggggcttagtgggtgttctccccatgtgcagagacaagagattgtaataaataaagacagaagacaaagagataaagagaaaacagctgggcccgggggaccactaccatcaagacgtggagaccagcagtggccccaaatggctgggcgcgccgatatttattgcatacaagacaagggggcagggtaaggagggtgaatcttctaagtgattgataaggtgaagcaaatcatgtgatcacaggacagggggcccttccctcttaggtagccgaagcagagagagaaggcagcatacgtcagcgttttcttctatgcacttataagaaagatcaaagacttcaagactttcactattccttctaccgctatctactacgaacttcaaagaggagccaggagtacgggaggagcatgaaagtggacaaggagcatgaccattgaagcacagcaccacagggaggggtttaggcctccggatgactgcgggcaggcctggatactatccagccttccacgagaagctggtggagcagagtgttccctgactcctccaaggaaaggagaccccctttcgtggtcagctaagtaacaggtgccttcccagacactggcgttaccgcttgaccaaggacccctcaagcggcccttatgcgggcgtgacagaggcctcacctcttgccttctaggtcacttctcaccatgtcccttcagcacctgaccctatacctgccggttattcctaggttatattagtaatgcaacaaagagtaatattaaaagctaatgattaataatgtttataataatgattgataattgtccatgatcatctctatatctaatttgtattatgactattcttattctaactattttctctattatactgaaacagtttgtgccttcagtctcttgcctcagcagctgggtgatcctccacccacagagataaagccctgcactacagcctgggcgagaagagccaaactccaacacacacacaaagaaagaatttcagaagtgatgtatcttctcagtcctttcatgtatacatgcaaatttctctttacattacaaattacaacacttacaaataaagtaatttatttcccatatttaaaatacatgctgtcaagttcggctaagtttccggacgtacacagtcaccctcatctgagatgtgcagactgcaagggaatgtgtttgggggtttaggaagtcacttttggacatgtgaaggtggagatgcctgtttgatgtcccagcagagaggtgagcagacaactgcacacaggattgtagagctcagtggagaggcctgcaggggacatgggtaggtgggttaaagctgtgagatgagataaggaaaagcagtgggtgtggacagagacaagaataggttcaagacaatttgagtcaaatctcttgttttttccattccggtatttttgttttttacatttttgtaggacaggaatctattaaaaattcaaattacacctgagcatcaccctctcctaaaggaaaagccacaaactatttgacaaagtatttcaggggtcagtgtcactctgactgagcttttctggtctcattcctcacctgtacattactggttgagtcactgttgtttcgagcaggagatacttcaccaaaagtacaaaaaattagccaggcgtggtggtgtgcatctgtggtctcagccatttaagaactgactggggtggatatttgggcctgggaggcagaggttgcgttaagccaagatcgtgtcactgcatgcaagtatgggtgaccgagtgacaccctgtctcaaaaaaagaaagaaaaaaaaacattccaggacaattttatacacctgagcaaatgaaatgtctctttcaatgtctaaggtcctgatggcatgaatcctaaacatgtaattattttcccagaaaaatgacagtagtacattcaaaatacacacaactgtgaacccctagctataggtgtttaaaacactgaaagagaagcagcattacaaatgagatctgaacaaatgttttcttcttgaacacacgggctttgctggaacaaggttccaagtcaattctgcccatccttgaacatctgcaaaaaatattatggaccagaggaacttgaggggaacgtttacttagcagctcacagctcaccattttatcaggtgacataaagaaagaaaatggaataataggctacttcaactaaattttgatgttagcataaagaaaaagttccttgatatctttatcaagtacacattgaaacaaactaaaatcatttatcaggtaccagaaaatgtttccaatgtatgatacagactagaaagcatgccgtcctcaatgtaaactgaacacaataaatttcagagaaaaacagttttaaaatggttaaaaaatatatctaatgaaatgtggggtcatagaagaatattttgaacacatattatagttgcaaaacaatgatgttacctcataagattatatcaaagcttttttgagaagcagtattttatttattttattttttttattttatttgagacagagtcttgctgtggcccagctggactgcagttgtgcgatctcggctcactgcaacctctgcttccaaaatgaaagccattcttctaccagcctcccgagtagctgtgttacaggcactcgccacaccaagctaattcctacattttagtcaacattgtcttgtcccaacttaaaatgacttatgcatttacaaaacagtgatttctttggggcatcgcccccataaccttttcataaagcattaatgatttcattgttcctctacccaaatttcaccatattcattttttgagacactgtctgtctctgtcacccatgctggagtacagtggcatgatcacggctccctacagcctctaactcccaggctcaagccatcctcccactgcagtctccacagaagctgaaccagcaggcatgtgccaccatgcctagctaatttatgtattttttgtagagaagggggtttcaacattctgcccaggctggtcttgaataccggggctcacgtgacccacctgtctcggcctctgaaagtgcttggattacaggcctgagccactgcatctgctctcatcataaatttgatgtttcttcttgtttcaattttagcaaaatttacactgctttcttttttcaaactcatgtcttccccttctgagtgcctcaaactagaccctgttcagacatgttataacagatttgtgccagtttattttggtgcagaaaatgtgacatcatgtgcaattttcacataatatgtatttttttcatgaacttcttgaagaccccttgtactagcgaactgtattcaagaggatattaaaaggattgtagatatgcaagtgccacttatttctgggatgcaaggatggttcaacatagtcaagcaaatcaatgtgatataccacttgaacacaatgaaagatgaaaaccacatcatctcaatacatggagaaaaagcatttcacaaaagtcaacatcaagtcatcatagaaatcccacacaaaatagatacagaagaaaatttacctcagcaatacaaagaccatccatgaaatgaccacagcagaaataaccaatcagggaaaacggaatgcttttcctgtaggatctcacatgatgcaagaatgctctcaccccttctattcaatcaatactggctgtcctagccagaacaatgaaatagcaaaagaaatcaaactcatccaaatcagaaagaaagaagtcaaattttatttgtttgtagatgacatgaccttctgtaaagaaaatcacaaagagtcagccaaaatgcaactggaactaacaaacacattcagtttatttgcagaatagaataacagcaccaaaaattagttgaatttccatacattaacaataaataattttaaaagaaaattaaaaaccaattccatttgctaaagaacttaaagtaagaaatatttaggaataaacataaaaagtgaggtttgtaccttgaaatctataaacattgatcaaaatgattaaaaacatgtataaatagatataaatcccatactgattggaaaaatgaatatcgctcaatgattatatactcaattgtgatttagattcggtacaatactcatagaagtctctataactttttgttaaagaaacaaaaaacaggccaggcacagtggctcactcctgtaatctcagcactttgggaggtggagtcgggtggatcataaagtcagaagatagagaccattctggctaacacggtgaaacccagtctctactaaaaacacaaaaaattacccaggtgtggtggcacacaactgtagtgtcagctacttgggagactgaggcaggagaattgcttgaacctgggaggaggaggttgcagtgagctgagatcgtgccactgcactccaacctgggcgacagagcaagactccatctcaaaaaaaaaacaagaaaaagaaaataaaggctgggaaaagtagctcccatctgttggctaggctgttctcaaactcgtgagctccagtgacctacctgtctttgcctctcaaagtgctggaattacaggcatgagccatggcccccagtgcaatcctcttaacataaacagtttaatggcaattaatgcttgaaatcaatgttaaatcaacaaactcaggtcaaggctgatttgactctaatgtcaattaatgcttgatggtttgctatactcactgcatttgaaacaactgtctccaaaaggaattgtctgatggtctgcaaggagtgaccttggactgaagacccttccacactgatgacatttgtaagatttctgtccagcatggattctctgatgtctaatgaggtgtgaatgtgaagtaaacgctttgccacaatcatcacacttgtgaggtttctctcctgtatgaatcctcctatgttttgcataggatgaagcttgactgaagaccttgcctcaatcatgacatttataaggtttctctccagcatgagttcaccagtgaaatgcaaggcatgaacgatgtctgaaaaatttgccacatttattacacttgtaagatctcttcactgtggattctccaatgatgtgcaatggttgtagcattactgaaaactttgtgacaatcattacattagtcaagtttccctataccatggattgcttgatggtgaataagtggtgactgcccactaaagggtttgccacactcattgcacttgtaaggtttctctccagtgtgaattctagtatggggtgccacgtgtgaatcattcccgaaagccttgtcacaaaccttacatttctatggcttttctccagtgtgaattctcctatgtatttgaagctggatttgtgaatgaaaactttgtcacattgttcacgtttgtaagatttctatgcagtatgaagtctatgatgacttgcaaggtgtgattgttgattaaaaaccatgtcacattcattgtgcttgtaaggtttctctccactatgaattacaaggtgtgaattttgaccttttaattacaaggtgtgaattttgaccaacggtcttgccacactcattacacttataatgagtttctctccagtgtgaattctagtatgttttgccagatatgcattatatgcaaaaaccttgtcacaaaccttacctctgtatggtttctcttcaatgtgaattttcttatgtgttttaaggtttgatttacaactgaaaacttttgtcacattcctcccatttgtaaggtttctctccagtatgaagtctatggtgatgtgcaaaggttgctttttgattaaaaaccttgccacattcattatgcttgtaaggtttctctccagtatgaattgccttatgacttacagggttgaattgtgatggaaggtcttgccacactcattacactattaaggcttctctccactatgaagcctatgatggtatacaagggatgacatctgactgaaggtcttgccacactcattacacttgtaaggtttctctccagtatgaagcctacgatggattataagcgatgatgtctgaccgaaggtcttgccacactcattacacttgtaaggtttctctccagtatgaactctctgatgttgtgccaggtgtgaatccctctggaaagccttgtcacaaaccttacatttgtatggtttctctccagtatgaatcctcctgtgtctttccaggtttgatttgcgactgaaaactttgcaacattcttcacatttgtaaggtttctctccactatgaatcctcctatgtctttcaaggtgtgatttgcgactgaaaactttgtcacactcttcacatttgtaaggtttctctccagtatgaagtctatgatggcgtgcaagggttgatagtcgattaaaaactttgccacattcattacatgtgtaaggtttctctccagtgtgaagtatagtatgttttgccagatatgaattatatgcgaaagcctcatcacaaaccttacatttgtatggtttctctccagtatgaatcctcttatgtctttcaaggtgtgatttgcgactgaaaactttgtcacattcttcacattcataaggtttctctccagtatgaagcgctttgtgaatgaagagggatgaattatgaccaaaggtcttgccacactcattacacttgtaaggtttctcaccagtgtgacatctacgatggcaggcaaggtatcgcttctgattaaagaccttgccacatacatcacatttacattgtttctcttctaagtgaattatctgatgtttttttaagagtgagctgcaattaaaggatttgaagctctgtatacattcaaaagatttttctctcatgtgtacttcccatttttgtgtgagtaatgaagaatggagggaattatttccatacttattagaaatatgggttttgggcctacaacaaattctttgggatgttgaaactgaggaagcattgttgatagacttctcaacttgattaccaattttcccttcagactgaaatatgtgcggttcaggcagatgcaaatgaaagcttgatccaagctgatctttaatacgcttgtttccagcatgcctttgatcatgttggcctgtactaccagccaactctttgatttctgtcatgggtgctgcatggccatttgtttcatcttctttccactgaaactcgaagccatgaatgtctttctcaatttcatggaaacaaaattctccaatgtgatgacttgcttgtctgtgcaatgtccctgtgtggatcacttctgtattgccttgccctgttgacgacaacgtcttcaacatgcatttggaagagatatctacaaaatttaaacaccaataggtttccaattaagtacagacggtatataatactgaaatgtgtaaatatcacagaaaaaaaacaatacttattttcaacttcccaaacgtgagcttcaaagtttaggaacacaaaaggagtaagattctttaataaataaagggcgattacatgtgcttcaaatcatttctatggaagcctatttccaatatcatgacaaaacactgacagggcacaaacacgtgtgagtctaaagaaaggagtgtttttccactgtgaccctaaagtgtgtcacactgtgcaaaatacatatcactgtcacatcagagaaaaatatatattctccatatttacagcgtatttagggtatacaaataaatgctaaagaaccacacaatatactatattggtaaataatccacaacaagctcttgtaagaataaccaaaattagtggaaattctctattgtcaaacaatcacagcactgacaagataacagaagattacaaaaattagccaggtgtggtggccagcacctgtactcccagctactccagaggctgcgtcacaagtattgcattaagctaaaaggcaaaggttgcagttagctaagattgcatcactccactccagccttggtgcaaaatgagactccatctcaaaaaaaaaaaaaaaaaaaaaaaaaaagacatggcatggtggcttgtgactctaatcccagtaactccggaggccgaggaaggtggatcacctcaggtcaggagttcaaccagcctggccaatgtggtgaaaccccgtcgctactaaagacacaaaaagtagctggtatggtcacaggcacctgtaatcccagctccttgggaggctgaggtatgataatcgcttgaactcgggaggcaaagattgtggtgagttgagattgtgtcactttgctccaccctggacaacagagtgagactctgtctcaaaaaaaaaaaaaaaaaaaaagaaaatgttaataccatatttttctgaataactgttacaaaattacctatatccatgtggaacagttatgttgtgactttttaaaaaattttttgtatttttgtttttttgagatagagtctcactctgtcacccaggctggaatgcgatggcacgatcttggctcactgcaacctccacctcctgggttcatgctagtctcttgccttaggtcctgagcacctgggattacaggcatgtgccaccatgcccagctaatttttgtatttttagtagaaatcaggtttcaccatgttggccaggctggtctcgaactcctgacctcaggtgatccacatgtcttggcctccaaaagtcctgggattacaggtgtgagccactgcaccctgtggcactttctgacattaatggggggagtgtgtccgttatattgcataccacataccgaacactcatatataaattcataaaaatcaattaatcaaatattgcaacccatgataaaacaagcaagaaaataataagtacatttatacagactgaagaattctaaacaattccctcttaagaaaaaagccaaaacttgtacttatcaccagcacacagtgtaagaactgaaatagatgttaagatcactaccttctgatatatgaggtcaagaaaatacacagctttaccaggaacaagaattgactagcggccgggtgcagtggcacatgcctgtaatcccagcattttggtaggctgaggtgggtgaatcatgaagtcaggagttgaagaccagcctggacaacatggcgacacaccatctctactaaaactacaaaaaaatcagccaggcatgaaggaagacgcctgtaatcccagctacttgggaatctgaggcaggaaacatttgaacccaggaggcggaggttgcagtgagacgagatcatgccactgcactccagcctcagtgacaggatgagactttgtctcaaagaaataaaataagataaataactacttctcaaataagctttggtagatgtggtattctctaagaggatgtccctgcagatgcagacattgagagaatttagtcatgggtgttgactactcgtgaataggactagtgcatttataaagggacattaaagaggtccttgcctgttcctctttccaccgtattaggacacagcaggaagatggctgggctaaaccatgaagaatgctctcaccaggaagcaatttggctggcaccttgctcttggatttcccacttcccaaattcattagaaataaatttctgtctcttaagcctgccagtttaagctacatccttttttgtttgtttttgagatggagtcacgctctatcacccaggatgcagtgtagtggcatgattctcctacctcaagtgattctccctcctcagcccagggtctcactctgttgccaagtctggagtgcagtggcatgatcttggctcactgcaacctccacctccagggttctagtgattctcctgcttcaacctcccaagtagctgggattacaggtgcacaccaccatgcacagctaatttttgcatttttagtagagatggggtttcaccatgttggctaggcttgtctctaactcctgacctcaagtgatcaacctgttgcagcctcccaaagtgctgggattagaggggtgagccaccgcggccagccagtctaagctatttctagcaggacagtgaaatgacagagacaggaacaggagcatctcatcatcaacatcaccaagggctgacaaatcttattaaacaaaggaagttaagagtctgtactgtaaaacttgcaatacttgaagccatctactagcactaacatgttttaaaaaccttgagacaggcaaagtgtggtggctcatgccagtaatcccagcattttgggaggctgaggcgggaggatcaccaggtcaggagattgagaccatcctggctaacaagctgaaactccgtctctactaaaaaaatacaaaaaattagcctggcatgttggcactcacctgtagtcccaggtacttggaaggctgaggcaggagaattgcttgaacctgggaagtggaggttgcagtgagcggagatgacaccactgtactttagccgggatgacagaccaaaactctgtctcagagaaaaaaaaaagaaatgaaagaaggctaaagagtaactccaaccaacaagcctatataaagttctccagacagggtgcggtggctcacgcctgtaaacccagcactttgggaggctgaggcgggcggatcaccaggtcaggagatcgagaccatcctggcaaaccaacatggtgaaaccccatctctactaaaaatacaaaaattagctgggtatagtggtgcaggcctgtagtcgcagctactggagaggctgaggaaggagaactgcttgaacccagaaggtggaggttacagtgagctgagatcacaccactgcactccagcccgggcaagagagtgagactccatctcaaaaaactaactaactaactaactaaataaataaagttctccagtaaaggtaaataaaaaaacagtctaggtgtggtcgttcattcctgtaatcccagcactttgggaggatgagtcaggcagataacctgaggttgggagttcgagatcagcctggccaacaaggaaaaaccctgtctctactaaaacacaaaattagatggctgtggtggcgcatgcctgtaatcccagctactcaggaggctgaggcaggagaatcagttgtacccgagacgcagagtttggagtgagctgagatcgcagcattgtacttcagcctgggtgacaagaacaaaactctatctcataaatacataaggtaattaattaataaaaggacagatacagaaactggcatatgtataccttttcttcataactaaacttttttcatattatttgaaataaaaggcatgaaaaacactgtacatatatgttaacggaaatgcaacatacacagaaataattctgacataaataaaaaaattctagtggagaagaagtagtttttgcaggttatggatttttatttttttctgtctcccaggctggagtgcgatggtgtgttatcagctcaccgcaacctctgcctcccggattcaagtgactatcctgcctcagcctcctgagaagctgggattacagccacccaccaccgcacctggctaacttttgtaattttagtagagttgcagttttcacatgttagccaggctggttttgaaatcctgacctcaggtgatctgctcaactcggcctccgaaagtgctaggattacaggtgtcagccactgcacacgttcaggttatggaaattttaagttttgttattatgctataactttaagatgtttaacatacctgcaacaataacctctgcccaaatatctgtacaacacacttcacttctacgtactgaaaggaatggacactaatgttgttatattcacactggaatcatgcttaaaccacttatatgtttacaaagaactaaaagaccaaactatttaaaatagtaacaatggttaggcatggcagcttacatctgtaatctcagcactttgggaatccgaggcaggtggatcacttgagatgaggagtttgagaccagcctgaccaacatggtgaaacccccctctactaaaaacacaaaaattagctgtgcatggtggtgtgcgcctgcagttccagctactcaggaatctggggaacaagaatcctttgagcccgggaggcggaggctgcagttagccaagatcatatcactgcactgtagcctgggtgacagagtgagactctgtcataaaaaaaagaaagaaagaaagtaagagcagagagataagtgggtgcaaagaaagtgtggggaaaagagagttcagattgttactgtgtctatgtagaaaaggaagacataagaaactccattttgatctatattaagaaaaattgtttcgctttgagatgctgttaacctgtaactttagccccaaccctgtgctcacagaaacatgtgctgtattgaatcaaggtttaatggatttagggctgtgcagggtgtgccttgttaacaatatgtttgcaggcagtatgcttggtaaaagtcatgccattctccattctcagttaaccagggacacaatgcactgcggaaagccgcagggacctctgccctagaaagcctgggtattgtccaagtttccccccactgagacagcctgagatatggcctcatgggaaaggaaagaccttacatccccccgcctgacacctgtaaagagcctgtgctgaggaggagtagtgaaagagggaggcctctttgcagttgagataaaaggaaggcttctgtctcctgttcatccctgggaatggaatgtctcggtgtaaagccgaccattcccattcattctcttctgagataggaggaaagcaccccatggctggaggcgagatatgctggcagcaatactgctctgttactctttcctacactgagatgtttgtgtgaagagaaacataaatctagcctacgtgcacatccagacacagtacctttccttgaacttattcatgatacaaattcctttgctcacatgtttccctgctgaccttctccccacctgttgccctgctacactccccttgctaagatagtaaaaataatgatcaataaatactgagggaactcaagagactggcaccgatgcaggttctcgcatgctgagtgtgctagccccatgggcccactgttctttctctaaactttgtctctgtgtcttatttcttttctgagtttctcatcccacctgacgagaaatacccacaggtatggaggggctggcgcccttcagaaagatgtccattcagagatgtgaaaaattaaactttccttttcccacagaattctcccacttgcagagtttcctcacacactatttgaaggtggaacttccactctgcccatctgagctcttacctgcatttacacctgtaatacattcccacccatctggattttttttgctattttcacttcactctccacagtccagggcttttcctttgctccaatatggagataacaggtcagaaagagactcctgcttataaaaagcaaggaccataaagtgctggagctttcgtagagtcccagccctaggtttcagtaggaaagaagacattaccaaaggatctaggaaaacagttcacaaattgctccacctactgcctccttctgaatgctgagggagcactgtaatatgtaatatgtggacatcaagctctcttccaagaatactgagtcaaaagcataggagaagcaaacaggaaactggatatctttaaagtctgccataaggttttgtttttgttttttgagacagagtcttgctctgtcacccaggctggagtgcagcagtgtgttctccactcactgcaaccttggcctcctgggtttaagtgattctctttactcagcctctctaggagctgggattacacgtacgtgccaccacacccagctaatttttgtatttttagtagagaaggggtttctccatgttgatcatgctggtctcgaactcctcacccatagtgatccacatgccttggcctcccaaggtactgggatgacaggtgtgagccaccacgaccaggctgccataaggttttatgcttactttacttctggaacccccactgagctatcatgaagaatgcagaacatctaaacaaaggggacagtgaaagtccagatgctacatcatgaagcttttcatttcaaaatcaatatggcttccattttagtcaaggaacaatggggttcctaagagacaataagagaaaatgcaaaaatacacaagggcacatccccaggagggaagttatcctcacccagggagacgaggttcctataattctccagcatcacgtccctgtataaagtcctctgagcagggtccaggcatttccactcctcctgagagaattctatggccacgtccctgaatgtcaatagaccctgaaatgaaaacacattttaaccaaatggttatgggaggagatcttatctttacaaaaaatgagaggaggagagaggggaaagcatggatttaactgtagagaatgttctgacaaatccaaataagggatttctcactacatgatgtctccccagatgtattttattacactttttgagtattatcaagacatactctcagtataaatttcttatgtttgtgaaaaataacagaaataaacaaataaaaaatcaatgtagggttcctgttataaaaatgtttgaaacttttatagacacaccaagtgacattcattatctagatgagacagagcacaactgatatcttaaaagatgacaacgtccacagtaaaagataggctgggcacagtgacacatgtctgtaatcccagctatgcaggaagctgaggcaggagaatcacttgatcctggaaggcacaggttgcagtgatcccagatcgcatcactgcactccagcctgggcaacagaaactccatctcaaaaaaaaaaaaaaaaaaattagccaggtgtgacggcaagcacctgtggtcccagctacttggaagggtaaagaggtaggatggcttgaccctgagggtggaggttgcagtgagctgcaatcccgccagggcactcaagcctgggcaacaaagcaagaccccgtctcaaaataaaataaaataaatgaaaacaaaattactcaaagtacaaaaatcaatcgtgtatatatatgttcacaaaataataaaacctacagagactcacaaaacactagatgtgaatacaaagggttgtcatttgtcccagattttcaaaatacaaaagattttcaaaatatatacatatgtgtatatatgtatttatatgtatatgtgtgtgcatgtgtgtggggatgtgtatgtacatatataaagtttttaaaaatataaaaagtagcaagttttgtttaatgaaagaggaatctcatcttgctggaaaaggatactttggcagttgtgggcagggggaatcttgtcagatctaagaatatggaaatgccccatcctagaagcagtaatcaccctttcaactgcctgacctggaggaatcttcagatatctgtagtaatgcgggtgtgcacagaggcagccactatggcactctttatacagggaaaaatcgcaaaggacccacgtgttgtcattcagccaatttccaatgcagatgtcaaaaagcaagctagccatgttcactaacatgacaacatgtaaattcacaattagcaaaatcaaatatcaaagtaaaatatttactgggacacaaagaagaaaacaacagacactgcagtctacttgagggtggagcggggaggaaggagaggagcacaaaaaataactattatgggccgggcgcggtggctcacgcctgtaatcccagcactttgggaggccgaggtgggcggatcacgaggtcaggagatcgagaccatcctggctaacacggtgaaaccccatctctactaaaaatacaaaaaattagccgggcgtggtggcgggcgcctgtagtcccagctactcgggaggctgaggcaggagaatggcgtgaacccgggaggtggagcttgcagtgagccgagatcgcgccactgcactccagcctgggcgacagagcgagactccgtcttgaaaataaaaataataataaatatatatatatatacacacacacatcatgtgatgataaatataacaatatatatttaataataattggtggggctgggtatggtgactcgtgtctgtaatcccagaattctgtgcgactgaagcagacagatcacctgaggtcgggagttcaagaccagcatggccaaaatggtgaaacactgtctcttctaaaaatacaaaaaaaattagccacgggtgatggcacgtgactataatcccagctacctgaaaggctaaaacaggagaatcactggaacttgggaggcagaggttgcagtgatctgagatcgtgccactgcactccagcctgggcaactgagaatttgtctcaaaaagaaacaaacaaacaaaaaagctgggtgaggtggctcacgcctgtactttcaacactttaggaggctgaggtgggcatatcacgaggttaggaaatggaaaccatcttggctaaaaaggtgaaaccctgtcgctactgaaaataccaaaaaattattcaggtgtggtggcactcgcctgtattcccagctactcaggagcctgaggcaggaaaactgcttgaactgggaaggcagaggttgcagtgagccgagaacaccactgaactccagcctgggctgcagagcaagatttcgctcaaaaaataaaaattaaaattaatcaggcatggtggcacccacctgtggtccctgctacctcagaggcagaggtcaggatggcttcttgagcctgagggtggaggttgcagtgcgctaagatcacgccactgcactccagcctgggcaacagagtgagaccttctctcaaaatgaaataaaatatatgaaaacagaattactcaaagtacaaaaatctgttttgtatatatatgcccaaaaaataataaaacctacacagactcacaagaaattagatgttaagaaaaagggttgtcattttccccagattttcaaaatatatgtgtttgtatatatgcatgtatatgtatagatgtgtgtgtatgtatgtatgtatatatttatttatatataaaggttttaaaaatacaaaagtagcaagatttgtttaactgaagaggaatctcgccttgggggaaaggatactttggcagtgggaggaaagagaggagcagaaaaaataactatcgggcccgggcacagtggctcacacttgtaatctcagcactttgggaggctgaggcaggtggatcacctgaggacaggaattcaacaccagcctggccaacatggtgaaactctgtctttactaaaaatacaaaaattagccaggcatggtggctggcacctgtaatcccagctacttgagagtctgaggcaggagactcacttgaacccaggaggcagaggtttcagtgagccgagatcatgccattatactccaacctgggcaacaagagcaaaactcagtctcaaaaaaataaatttttacaaaaataacagccaggcatggtggctcacgcctgtaatctcaacacttttggaggttgaggcaggtggatcacgaggtcaggcattcaataccaacctggccaaggtggtgaaacaccgtctctagtaaaaatacaaaaaaaattagctgggcatggtggcgggtgcctgcaatcccagctattcaggaggctgaggcagagaaatgcttgaacccaagaggcggatgttgcagtgagccgagatcacaccactgcactccagcctgggtgacagagtgagactccatctcaaaaaaaataaataaagcaaataaaacaaaaataactattgggtactggacttgataccggagtgatgaaataattggtacaacaaactccaatgacgtgagtttacctctgtaacaagccttcacacatagccccaaaagtaaagtaaaaaaatatataaaatttttttttaatttacaatggaatttttttttttaagatggagtcttcctctgttgcccaggctggagtgcagtggtgcaatctcagctcactgcaagctctgcctccgaggttcaagtcattctcctgcctcagcctcccaagtagctgggactacaggtgcccaccaccacacccggctaattttttgtattttttaatagagacagggtttcaccatgttagccaggatgatcttgatctcctgaccttgtgatccacccacctcagcctcccaaagtgctgggattacaggtgtgagccaccgcgcgtggcccagaattttttttaaagtctcataacgatgcagaaatacacgtgtacgagacttgctctgacagctaacacagaactgacaggagtggctccccagtgaggctggaaggagggtggaggatgtgacagggaaaggagatgtcttatggccaagggtctaagctgcagctttgcttggagttttaccacaaaacaaatatatatatcatgtgatggtgaaatataaccatttatatttaataataactggtggggctgggcatgatggcttgcgcttgtaatcccaacacactggggggccgaggcgggcagaccacctgaggttaggaggttgaggccagcctggccagcatgctgaaacgctgtttctactaaaaatacaaaaaaattagctgggcgtggtggtgcacacctataaccccagctactaggtgggctgaggcaggagaatcacttgaacccaggaggcggaggttgcggtgagttgagatcgcgccattgcactccagcctgggtaacagagcgaaactccatctcaaaaaataataataatgaaggaatgattcatgaattattcatgtctatgtatgaactttccattctaattagtaagatttttggagtcagaaacacagtaactcactccattacctaaaaatgtggtataaaatcagggagaaaagattttcccttattggtctccttttctagaacttaccacgtacttcgtgcatattaatacgtgactcccattggcagctgctccaatcctggtccacagtgagctgacagtgcatccagatgtggcccctgaacaatccctgctgcccaagagcactgacaccacaggaccctcaccccgtgtccatccatgtcggggtgtgagcccttcccaggacctgcccagtgcagcctcttcccaagttcatgacactgggtcacgagagacggaacctaagcgagatgagagggactgaaggaaggcataagtgagggtgagcaaacatgtcaggcaggtcattcagacccagacattcccaactccaaggcccagggtatctgaaaggaaggagacagaacaatccaccgaggatatcatctcacctgaggaagagccatccctgactcctttgctttcctcttcctcttctgggtttctttctcacgtaccaacagtctttagaagtcaatcctgaatgttaaaaatatgttgtttatcactcagaatcaacacaccccctcccttaacacaatgacacaaacataggagacctcaccctgggaaatacggtcccctctgctgcccactgcacaatgaacaaaaaattcctacaggaaaactcccactctcctcctggagaagcccacacacacgctgcagcagtggggagctgggctgggatgagctccccttcaggaaatctctaccaaaaatacaaaaacttagccaggtatggtggtacgcatctgtgtgtctgtggtcccagctacttaggaagctgatgtggaagcatcatttgagctcaaaagtttgagactagcctggccaacatggtgaaagcctgtctctactaaaaatacaaaaattgggccgggcacattggctcatgcctgtaatactagcactctgaaaggccaaggtgggtggattacttgaggtcaggagttcaagagcagcctggccaacatggtgacaccctgtctctactaaaaatacaaaaagtagccgagattggtgggtatctctaatcccagctactcgggaggctgaggtaggagaactgcttgaacctgcgcgacccgagatcgcgccactgcactcctgcctgggtgacagagtaagactcaaaaataaaataaaatacaaatacaaaattagcagggtgtggtggcacacacctgtaatcttagctacttgggaggctgaggcacaagaattgcttgaacccaggagatacaggttgcagtgagccaagatcacaagactgcactcacagcccggaggacagagtgagagtctgtttgaaaaaaaaaaaaaaagtgcatttctgatgggattgacacagagataagaagacttgagtaatgccatagacactgatgggtagagggaacttcagatgggggtgggagggcatgggagacagctctgagcctagacctgaaggagaaagggacagtgccatcttcatttagaaacattgaataagagcagggacaacaacctgagacaggaaggattttgatgtttgaaaaaagagaaaagcaaatgtgactggggcagagggagtcagatgagggtaagctcccaggaggaggctggacactggcagggaccctgaacacagggctgtggagccaaagtgaagagtcgggcttttgtcctggggaacacgggaagcaggtggagggttccctgccaggcactgacatgacctgctttagatgtagctgtgatattctaatacagacaaaggcctccaaagatcctctctgtttctgagtctaccgctctgtttcttccattcttctgcttttttttttttcatttttggggtactgcatcccactgaaaattctaattacaactgggcactctcctctaccagaaaaaaagccacacccagacaccgcctctattttgccaatcatttcaggggtcaggatcactcaggttgagcttttctggtctagcccttcgtcgcaaagatgcagggaggttcactggggctcagagctggaaacattttcacgaagttaccctgagaaggtctgagatgagtgagaaggtgtgcctgaattcttacatgggggcctggaagggctaatgggatgggttggtcttatcatcccattcttaaaattagagaagcatttttcacatgcctgggttaaagaaaattcttttgaaaggttctgatgaaattgactcccaacattgaattcttccttacaagaaaatcacactaacatttataaaatgcagcagtgtaaacacacagctcttgaccttgaaaacagggaaacagggtcagctgtagaaccaagacataagcaaattatttcaatcaagaaatacatgggtggacagctgaggtggttcacacctgtaattccagcactttgggaggtggaggtgggtggattacctgaggtcaggagtttgagaccaacctggccaacatggtgaaaccctatctctactagaaatacaaaaattagctgggctccatccttgcaacttatttaacctcctgttggtccttctccccaatctttagatcgtcctcaatctccatagatttctgcctcttctcccatctatgcgcctcctctgctctccctgttaaattctctcttctctgttataaccccctggacccaatctggcaccccagatccccaggtgtcctccccgctgtgcttctccctctgttctccttgccaccagcaccactctgctctgtctgacccggctccacatccctcctcctctccctcactctgatgagcctccacatttctgcccctctccctaccttgctgtccttcatctctctgtacatctagcttttctctacatttctccagttgcttttctcctcctgctttcttatcttttatcacttttgctgtctcttggcaaatccctcacccatcctctactttgccatctgttatgggtctttctcattcttcttttctctgtctcaggttttctactgctctctcagtccctctctctgtctcctgatccctttggcccacacgatcacaagagggtttggagtaagacgcctgcatctcggagaagcgcattttccaagtgctggagctgggcgggcaagaacaccccgcgtcacaggacaagccccaggcacctctccaacgagggctcaggggacgcggtgactgcggaggggagatctggggagcagcagggcccagcaagaggaggagggaggtggggagcgacgacgccttcggacaagggtgggatccgcaggatcccaggaccacagaacgcagccttcccgggactggggtcgccgcgctgtgctccaggaacccaggagagtaaggctgggaggcgcacagggtgggaatacacctctagggtgaggactttaaaaagagccgtgcggaaggagtcaaaaaacggttttgagcaggaaaactacgcgataggaaacgtatacattgccctatggcagaaagacccgggacgggaccagcctcagggcgactttaaacctaaaaagaaggggcttccggactcccagtagaacatctccatttgctctgagtgaaggaagaaaggcgagaacttccaggtctatggggaccccacatcccatgtacagaagtgccggggacctgggaagctcagacttaacaccacacagagcaaaactcaccgcccgccgcggcgtgaccgtcattccacgggatccacttcctggtctgcgcgaatctgcgcgcgcaggacagaaaccaggcctgggtggagccaacgaggaggcgagcggggcccgggtgaggtgtgggcggggcgcgaagcggcgagaccttgccctttagaacccgcagagggcggggccggagcgggacctgtgcatctctcagcctcctcccaacccgttctccgggttttggcggcgagagcccccaggaaggcagacggataattcaaaagccctggaatagtctggaaggaggatgcaaactagaatgtaaaatgcaaagccctttctgggcggaacgtaggatttcatgctgatggcccacaggacagtatagaaatcttctccctttctattctccattcactcaggagggagagtccacccagtgctcagcttcagagacatccctagggccacagcctgggatgccagacggagtgctcaggccagggaggagtgaggtcaccacctgctgcttaaacacagcagggatgcgggcgtgggagcctgaggtcccagctactcaggaagcagcggcgggaggatcgctcagcctgggggtccaggacagcctgcgcgacaatgtaacattccctcccgcagtctctctcttttttaaatttttaaaataaaatttttattaggccgggcacggtgactcacgcctgtaatcccagcactttgggaggctgaggcgggcggatcacgaggtcaggagatcgcgaccatcctggcttacacgatgaaaccccgtctccactaaaaatacaaaaattagccgggcgtggtggcgggcgcctgtagtcccagctactcaggaggctgaggcaggagaatgcggtgaacatgggaggtggagcttgcagtgggccgagaccgagccactgcactccagcctgggcgacagagccagactccctctctaaaaataaataaacaaactaaatttgcttgtgtgagataggaatacaacattactcttctccatatggatatccagttagttgtcccagcacatttgtaaaagagatctgttactttctcctttttatttacattttttctttttcttcttcttcttctttttttttttttttttgagactgagtatttctctgtcgcccaggctggagtacaatggtgacatctcggctcactgcagcctctgcctcctgggttgaagcgattcttctgcctcagcctccggagtagctggcattacaggcacacccaccatgcccggctaatttttgtattttgggtacagacggggtttcatcatgttggacaggctggtctcgaactcctgacttcaagtgatccgcctgcctcggcctcccgaagttctgggattacaggcgtgagccactgtgcctggcccaagaaatactctttacttcgctttttaaatgttgaaaaaatacaattgaaaactaaaaaatcttccccaaaatgagaaatcatcttcatgacaaaacaggaagaaataaaaaccattttattagtaaataagccttagaccagaatgtgttgggaaatacaggcaaagagctgagaggttgaaaagagagaaacttcactgctctatacaacccattaagtacatgttttcaagataaacactaatcagtcctcagggaagaggacttgacaagtctttggtcgcacatagttcatcctggctctacttggtaatggaggtgaccatctgtgtcagctaactagcttcatgcagaaggaggggaaatacattaacccacgtctttttgacaagtgtgagttttacgacatggcgacaggtgccctctctagtgaggctcctacaatctgacggaaactgacgtcagcagtaaataataaaattcagaatacacgattaattatagagtttattggaacacaaagtttgaggatagccatctggaaacatcaactccaaatgaagggggcccgtgttcccatgtagagatgttaaggtttcacacacagggaaagacagagaagctttagcagaatcaacacattttccattcaagaccagtgcataggctgcggcagcttgactggtgatggattgatacacttcaaggaaggttactttatcactccgtaagaagggacaatgatgccaaaaggtcttatctctggggctgggtagtcttcctacttacaggtaaactgtttttttttaaattgatattaggaaactaaattttattgcactacacgctaccagttacaaagtagggtgtcctcataaacaaaggaaatgcctcctctttaagtttttctttcttttttttttttttttgagacggtgtatcgctctgtcacccaggctggaatgcagtggcgcaatatccgctcactgcaagctccgcctcccgggttcacgccattctcctgcctcagcctccagagtagctgggactacaggcgcccgccaccacgcccggctaatttttggaatttttagtagagacggggtttcaccgtgttagccaggatggtctcgatctcctgaccttgtgatgctcccgcctcggcctcccaaagtgctgggattacaggcgtgagccactgcacctggcctgtttttcttacataggcgcctaggtaaaaactaagatatgtctacctgccggtctgctgacagtctaacaaaacttattattttgttgatttaaagctatccttaggcggtcccggtggctcactcctgcaatactagcaatttgaaaggctgtaccagggggatcacctgaggtaaggagttccagaccagtctggacaacatggtgaaagccagtctttactgaaaatgcaacaattagccaggcctgggggcacatgtctgtaatcctagctcctcaggatgctgaggaagtagaatcgcttgaacttgggaggcgggggttgcagtgagccaagattgtgccattgcactccagcctggatgacaagagtgaaacggcatcaaaaaaaaaaaaagaaaaagaaaaaaaagctattcttggtattttagtgtgcaagtacttgaaagcatgactgtaattattttagaagcatagattgtcatgggatattgagtcatctggacattgtttttctgtaggagtttgttcttgcaggtactattaagctgctttccttaactgtaaacatcttaagatcatgactcatgcgtgagcagtaaggactacgtcttgctagttttagtagactaaaactttgtcattctagctctcctaggatcctgtttaacagtttttccactcatgcaccacagcgttctaagcacaattatggagacaccactcttttgtaatgcactgacaccatgtcactgcactttagtctgggcgacagagtgagattccgtcaaaaacaaacaaacaaacaaacaaacaaaacaaaaacgaaaactcatccaaatcagaaagaaagaaataaaattgtatttgtttgtagatgacatgatcttctgtggaaaaaatccaaagagtcaaccaaaatactactggaactaataaacacattcagtggatttgcagaatacaatatcagcagcaaaaattagttgaatttccatacattaacaataaacaattttaaaagaaaattaagaaaaccgttccatttgctagagaaatttaagtaagaaatactaaggaataaatgtaaagaggtgagacgtttgtaccttgaaatccacaaacactgatcaaaatgattaaaaacatatataaatagagatagaacccatattgatggattggaaaaattaatattgctaaatgattatataacctaatgtgatttagattcaacacggtacccataaaaatccctatcagattgtgttaaagaaacaaaaaactggctgggaaaagtggcacacgtctgttggccaggctgatctcaaactcctgacctcaagggatctaactgccttggcctcccaaagtgctgggattacaggcatgagccaccgtgcctggcccaatcctcttaacataaacactttaacatcaattaatgcttgaactcaatgttaaatcaactcaaactcaagtcaatgctgaattgactctaatgacaattaatgcttgatggtttgctatactcattgcctgtgcatcaattatctcaaaaatgaattttctgatgttctgcaaggagtgacctcagactgaaaccttgtcacacttatgacatttgtaagatttctgtccagtagggattctctgatgcctaatgacttgtgaacgtgaagtaaagactttgccataattatcacacctgtgaggtttctctcctgtatgaattctcctatgttttgcctaggatgaagcttgactgaagaccttgcctcaatcatgacatttgtaaggtttctctccagtatgagttcgctgatgaactgcaagttatgaacgatgtctgaaaactttgccacatttattaacacttgtaagatctctcttcattacggattctccaatgatttgcaacagttctagcattaccaaaggcattgtgacaatcattgcattagtaaactttccctacaccatggattgcctgatggatggtgagtaagtggtgattgcccactaaaggctttgccacactcattacacttgtaaggtttctctccagggtgaattctagtatgtcctgcaaggtgtgaatcacacccaaaatccttatcacaaaccttacatttgtatggtttctctccagtatgaattcacctatgtctttcaagctgtgatttacgactgaaaactttgtcacaggtttttctccagtatgagttcactgatgaactgcaaggtatgaatgatgactgtaaaattggccacatttatcacacttgtaagatctctcttcattataggttctccaatgatttgcaagtgttgtagttttactggagactttgtggcagtcattacatctgtgagctttcactataccatggattgcttgatggtgaataggcgatgccctcaccctaaaggctttgccacactcattacacttgtaaggtttctctccagtgtgaatttcagtatgttctgcaaggagtgaattgagcccaaaaaccttttcacaaaccttacatttgtatggcttctccagtgtgaattctcctatgcattgcaaggtgtgatctgcaactgaaaacgttgtcacattctttacatttgtaaggtttctctccagtatgaattgccttgtgaacaaaattacaacaaattagctgggtatggtggattccgcctgtagtctcagctgttctggaccctgaggcaggggaattgcttgaacccaaggcagagattgcagtgagctgagatcgcactgctgaaaagacacaaacaagttgaaagccactgtgactcggctcattgcaaactgcctcctgggctcaagcgattctcctgcctcaacctttcgagtagctgggactgcaggtgcacaccaccatgcctggctaagttttgtatttttagtagagacagggttttgtgatgctggccagactggtctcgaactccttactgcaaaaaaatgaatatataatacatagaagtatatgtatttctatgaaatatataacacatagaaatgaataagttgaaagcctctgtgtcttaaacaaatgacagtagaactaaaatatgggaaggtcgggcatggtggttcacacctgtaatcccagcactttggaagtccaaggcaggtggatcacgaggtcaggagttcaagaccattgtggccaacatggtgaaaacctgtctctactaaaaatacaaaaattagctgggcatggtggcatgtgcctgcaatcccagctactcaggagactgaggcaggagaattgcttgaactgggacctgggaggcagaggttgcagtgagccgagatggtgccactgcactccagcctgggctacagagcaagactccatctcaaaaaaggaaaaaaaaaaaaaaagaactaaaatatgggaatctcattcaacctcacaagctccctcaataagaatgatgaaaagtgtaactgttacagggttgatcccacaacaaactgaacaaagcttttcttgttaaaaatgaacaatgccaggtgcggtggctcaagcctgtaatcccagcactttagaggccgaggcgggtgggtatggaggtcaggagttcgagacgagcctggccaacatggcaaaaccctatctccactaaagatacaaaataacatgctgggcatggtggcacgtgcctggaatcccagctgtgtacatcaaaagcacgtatggggcaaaatcacaaaagagaatacaaaaccaggaaaagccaagatacacaaggacagattcttcatgtctggaggaacattttcctcacccacagactccaggttcctgtagttctcccacatcacagccctgtataaagcgttctgtgcagggtccaggcgtttccactccagcaaagagaactctatagccacatctctgaaagtcaagtatccctaaaatgagaaacacgtttaaataaaacattatggaggcgttatcaccttcacacgaaatgagaaatgggaaattaagtatcgattgggccaaagaatatgttctgacaaacccgtattaaggtatttttgaacatcttttctctatcgttgcattttattgtacttttccatgagagatttcaagatcccctaagtaaaaaatttacaaataaaaactaaatatagtgttttctctataaatacgttagatattatgttcagcctaacacttgatattcattatctggatgagctaaaatacaagtgcagtctcagagatgacaaagtccagtggcctaaagaaaagaaagtcagggccagccatagtggctcaagcgtgtaatcccagcacgttgagaagtggagggaggcagatcacaaggtcaagagtttgagatcagcctgaacaacatggtgaaaactcctcttctcccaggaggcagaggatgcagtgagccaagataacatcagtgcactatagctggagcaacagagagacactccatctcaataaaataaaaataaaaattggccaggtgcggtggctcacgctttcaatctcagcactttgggaggccgaggcaggcagatcatgatgtcaggagatcgagaccatcctggctaacacagtgaaatcccgtctctactaaaagtacaaaaaattagccaggcgtggtggcaggcacctgtagtcccagctactcaggaggctgaggcagaagaatggtgtgaacctgggaggtagagcttgcagtgagccgagatcgggccactacacgccagcctgggtgatagagcgagactccttctcaaaaataaaaaataaaatttttaaaaaggtggggcacagtggctcatgcctgcaatcctggcactttgggaggcagaggtgggcagatcacctgaggtcaggagttggagaccagcctggtcaaagtgatgaaacaacgtcgctactaaaaatacaaaaatgagctgggtgtggtcgtgggcacctgtaatcccagctactggggagcctgaggcagaagaatcgcttgaacccagaaggcagaggttgcagcaagctgagatcgtgctactggactccagactgggtgagaagaacggtaccccatttcaaatatatatatatggtctggagggacattttcctcacccacagactccaggttcctgtagttctcccaaatcacggccctgtataaagcgttctgtgcagggtccaggctttatatatatatatatatgtaatacatatatatatattacatatatatataatacatatatattatacatatatatttatatattatacatatatatttatatatgattatacatatatatttatatgatcatacatatatatttatatgattatacatatatttatatatgagattatacatatatatttatatatgattatacatatatatttatatatgattatacatatatattatatgattatacatatatattatacatatatttatatatgattatacacatatttatatatatgattatacacatatatttatatatatgattatacacatatatttatatatatgattatacacatatatttatatatatgattatacacatatatttatatatgattatacacatatatttatatattatacatatatatttatatattatacatatatttatatatatgattatacacatatatttatatatgattatacacatatatttatatattatacatatatatttatatattatacatatatttatatatatgattatacatatatatttatatattatacatatttatatatatgattatacatatatatgattatacatatatttatatatatgattatacatatatttatatatgtatgattatacatatatttatatatgtatgattatacatatatttatatatgtatgattatacatatatttatatatatgattatacatatatttatatatatgattatacatatatttatatatatgattatacatatatatatatataaaatcataaggctggatgcagttactcatgcgctgggtgcagtgactcatgcctgtaatcccagcaatctgggaggccgaggtgggcagatcacctgaggtcagaactgtgaaacccctcctgcaggaaccctccacatacatgtagtgaagtcaacacactcagaggcagccagggtggcattcttggtaacggtgaaaaactgggaaggactcacacgtcttcattcagaaaatgctccaaggaggatgaaaaacagcaaactatcttgtttcctaccttgaaaatgtggaacattttaacacttgcaggataaaataccagaacaaaacatttatcatgtcgagctctttggctcacgcatgtaatcccagtactttgggaggccaaggagggaggatcacttgaggccaggagtttgagaccagcctggccaatatggagaaacgccatctctactaaaaatataaccattagccaagcatgatggcacatacctgtaatgcagctactcagttggccgaggctagaaaatcatttgaacccatgaagcagaggttgcaatgtgctagtaagttccagcctgttgacagggtgagacacctgtctcacaaaacatacaaaaaaaaaaaaaaaaaaaaagaaaagaaatgactaacagtgtcagacggctgaattatgatgtcacgactacagttaaataacagtcaggcaatacggcaattctatatacacatattgcccttagttatctagttcactatgcgtaagatataaaacatagaatgtgtactgggaaaattgataaactgggatcagagaaaacatagtataaaacaaatcgtataataaaaacataaaaaaagatgcaggctccctggtctggatgttcatattggccaaaagccatgtttggatttaattaattaattaattaattaatttatttatttatgtatttattttttgagatggagtctcactctgttgccaggctggagtgcagtggcatggtctcggctcactgccacctctgcctcctgggttcaagtgattctcctgcctcagcctcccaagtagctgggattaccggtacgtgccaccacccccagctaatatttgtatttttagtatagacggggtttcaccatgttggccaggctggtcttgaactcctgacctcatgatccacttgccttggcctcccaaagtgctgggattacaggcatgagccaccgtgcccagcccatatttggatttcttattctccaacaggatgttcctgcagatgtggcatttgagataatttggtcatgggtgttgactactcatgaataggaccagtgcttttatttttattttttttctttctttatttttgagaaagagtttcactcttgttgcccctgctagagtgcagtggcctgatcttggctcacagaaacatccgcctcctgggttcaagtgattctcctgtatcagcctcccgtgtagctgggatttcaggcatgtgccaccacacccagctaatttttgtatttgtagttgagatgaggttttaccatgttggccaggctggtctcgaagtcctgacctcaggtgatctgcccgtctcggccgcccaaagtactgggattacaggcttgagccaccgcacccggccattttttttgttcagtagattcaaggattcagcatgttggactgactggtctcaaactcctcacctcaagcaatctacccccatcagcctcccaaagtgctgggattagaggtgtgagccaccatggccagccagtctacgccgtttctgacaggacagtgaaatgacggagacaggaaaaggagcatgtcatcatcaacattgctgaaggctgacaactcttattacacaaaggcagtttacagcctgtcatataaaagctgcaatgtgtgaagccatctaatagcactaacttgtttaaaaacctggaggcatccaggcgcagtggctcacgcttgtaatcccaacactttggaagaccgcggtgggtggatcacctgaggtcgggagttcgagagcagtctgactgacatggaaaaaccctgtctctacttcaaatacaaaattagctgggtgtggtggtacatgcctgtaatcccagctacttgggagcctcaggcaggagaatcgctcgaacccccggggcggaggttgtggtgagctcggattgcgccactgtagtccagcctgggcaagaagagcgaaactctgtcaaaaaaaaaaaaaaatctggaggcaaattaacattatttctcaaataagttctcaaataagtacagcaggcccacagtgttcatgtacatgaccccaatttgcacatacagtaagtgagggacaaacttgattcttggcctgaaggatcccacgacatgtttctaagcaaaatagtccaccaagaaagtacagaaaacaaccagtcacaaaaaatgctgcaaggagaacagaatgaaatactacaagggggatacaagcaagggctgagctgggacacaagcgctgagctgcgctgctgacagtggttctgaagccatccctcatggatcatgtgctgagtcatgatgccctgcacacactgatttaggcagcctccaataattttgtccagtggatgaataaggtcttgacttactcagtgagagtagtgttggaggggaggggctcacggggaaattggggtgttcacttttacaaagtcaataggctggtatttgcatccagatcaatgtatcatgtgaggcaaggccaggaaaggaagggcaagggtggagagcaggaagtaatgggcatgtaggagtgaactttgtgcatgcacctctgtgggaatataattccactaggatagaccaaatcttgagcttggaagaaagtggaactaatttagcaaatggtaaaatattgacccaaggttaaatatgcaaattacaatatgggcaagggacaagaatgaaagagatccaaaaaagcagcagtatggtggcctaaggtgaaagcagttttacatctcttaaattaaatggcctctgatacctagtttcaagagtatacacaacaatataccaagtatagattccagaatttcatacacacagaaaaaaatgagtaaagtctatgaggagtgcagcagcgaaggagaccatggatgtgaagaattccctggctgagtaggtagagctgtgtttgtgaaaacagagacagactgagcgcagtggctcatgcctgtaataacaataataataataatgacaggttttttttctttttttgagatggagtgtcactcttttgcccaggctggagtgtagtggtgtgatctcggctcactgcaacccctgccacccaggttcaagcaattctcttgcctcagcctcctgagtagctgggataacaggtgcctgccaccgggcctggctaaattttctatttatttatttatgtatttatagagacagagtcttcctctctcacccaggctggaatgcaatggtgcgatctcggcacactgcaacttccgtctaatggtttcacgccattctcctgcctcagcctcctgagtagctgggactacaggcacccgccaccacatctggctaatgttttttgtatttcattagagatggggtttcaccgtgttagccaggatggtctcgatctcctgacctcgtgatccacccgcctcagcctcccaaagtgctgggattacaggtgtcagccacagcgcccatcctaaattttgtatttttagtagagacagggtttcaccattttgatcaggctggtcttgaactcctgagaacctgcctcagcctcccaaagtgctgggattacaggcatcagccaccatgcccaggcccttcttactattaactcattattgtgatagttgatgacaatgaaaaatacttaaaatagccaggtgcggtggctcacacctgtaaacccagcactttgtgaggccgaggtggatggatcacgaggtcaggagatcaagaccatcctggctaacacggtgaaacctcgtctctactaaaaatacaaaaattagctgggcatggtggcaggcacctgtagtcacagctactcaggaggctgaggcaggagaatggtgtgaacctggaggcggagcttgcagtgagccaagatcgggccactacactccagcctgggcaacagagccagactccgtctcaaaaaaaaaaaaaaaaaagaaaaatacttaagatcattacaattattataaaaaataaaacttatggcaaatgttgtgttttctacataaaccataggtttatccatccatgtatttatgcacacacatcacatcatgccattacacgtgtggtggtgcacacctctagtcccagctactcgaggtgctcaggcaaaagaatcactgtaatccaggaggcagaggctacagtgagcctaaatctcactactgtactccagcctgggcaacagagggagactcaactaaaaaaaataaaatacaatcaatgatgtgataaagcattctacaccactgatgtgtatcttcactttccattccattccaagtcattaaaaatgcagagtctagcctggcatggtggctcaggcctgtaatcccagcactttgggaggctgaggtgaaaaaacacaaggtcaggatttcccgaccagcctgaccaatatggtgaaatcccatctctactaagaatacaaaaaaattagccaggcatggtggcacatgcctgtaatcccagctactcgggaggctgaggcaggagaattgcttgaacccaggaagcagatgttgcagtcagctgacagcctgtcactgcactccagtttgggcaatagagcgagactccatctcaaaataaataaataaataaaacaattagccgcttgtggtgacacatgcctatcattcaagctctttgggaggctaaagtggggattgattgagcccaggagtttcaggctgctgtaaactctaaattgtgccattgtactccaaaactaagccacagagcgatattttctcccactctctctccaacatggtgaaaccccatctctaccaaaaatacaaaaaattagccaggcatcctggcacacatctatggtcctagctacttgggaggctgatgcaataagatcacttgagcctgggacacagaggttacagtgatccaagactttaccactgcattccaccctaagtgacagagtgacactccacttcggaaaaaaaaaattccaaaaccatcttgtatattcctgagcaaaagaaacttctttcgaggtctacggttctgatggcatcaatcccaaacatgtaattactcactcccagaaaatcacagaaatatgttcaaaatgtacacattgtgaacacatagctgcaggtgtttaaaacactgaaaaattgtgcacacatagctctaggtgcttaaaacactgaaaaagaggcagctgtagcaatgagatctgagcaaatgcttttctcatgaacacatgggctctgctaaaccaaggttccaagtcaatccagcccatccttcaacatctgcagagaatattatggaccagagggatttaaattaattatgttacaaagagaggaagcaacacgtcatcacttcatcatcacatccaatcaactcaccgctcatctgcacccagggtcccccttcgtcttcattactgtttccctccatcattctgtacatagctctcattctcaccttctctgaaattgggattagccaggtgtggtagcacctgcctgtcatcctggctccttgagaggctaatgtgggtatcacttgagcccacgaatttgaggctgctgtaaactagaattgttccattgcactccagaaagggccccaaagtgacaccctctttcttaaaaaagaaagtttggagtcagagacatattgactcactggtgtagcttcaaatccattacaaaagcagacacaaaatatctcccatagtttgtttccttttccagaatttaccagataccagtgtatattaatgtactgaagggggcctgcccctccacacctgtgggtattcctcagaaggtggagataagagactgagaaaagaaataagacacagggacaaagtatagagggagaaaagtgggtccgggggagcagcgctcagcaagtgaggacctgcaccggcatcgacctctgagttccctcagtatttattatttatttatttatttgagacagagttttgctctgtcacgcaggtggagtgcagtggcatggtttcggctcactgaaacctccgcctcccgggttcatgccattctcctgcctcagcctcccaagtagctggaactacaggtgcccaccaccgggcccggctaattttttctatttttagtagagacggggtttcaccgtgttaaccaggatggtctcaatctcctgacctcgtgatctgcctgcctcggcctcccaaattgctgggattacaggcgtgagccaccgcgcccagcctctctcagtatttattgatcactatctctactatcttggtgaggggaatgtagcaggactatagggtgatggtgaggagagggtcagcaggaaaacacgtgagcaaaggaccctgtgtcataaataagtttaaggaaatgtgctctgcctggatgtgcatgtaggccaggtttatgtttgactttacacaaacatctcagtgcagtaaagagcagtattgctgccagcatgtctcacctccagccatagggcggttttctcctatctcagtaaatagaatgtacaatcgggttttacaccgagacattccattcccagggaggagcaggagacagatgccttcctcttatctcaactgcaaagaggcctttctctttcgctaatcctcctcagcacaggcccttgtcgggctgagggacctgtaaggtctttcccttcccataaggccatatctcaggctgtctccattgggggaaacctggacaatacccaggctttcttgggcagaggtccctgcagctttctgcagtgcatttgtgtccctggttaatcaagaatggagaatggcgatgcctttcacaaagcatattgcctgcaagaactttttaaacaaagcacatcctgcacagcccgagatccattaaatcttgattcaacacagcacatgtttctgtgagcacagggttggggctaaggttacagattaacagcatctcaaagcagaacaatttttcttagtacagatcaaaatggggtttcttatatcttccttttctacatagacacagtaacaatctgatctctcttttattcccccacaacgtatgactttcatacacagtttctctgatctggtccacaaagagctaaacgtccatccagatgtggcccttgaacaaaccctgctgcccaacatcactgacaccatggggcccacaccccatttccatccatgcctggtgtgagcccttcccaggaccatgcccagtggagcctcttcccaagctcacatcactaggttataggagatggaatttaagtgaagatgacaaggactgagaaaaggcatgggtgagtgtgagcaaacgtgtgaggcaggacgcttcagactcacaggagactgactactacaatacctggcatttcagaaaggaaagagacagaagaatccaatgagaaatatcacttcacctgaggaagagccatccctggctccttttctttgccttcttggtgtcttcctcaagtaacataagtctctggaaatcaatcctgtatgtgaaaaaaatcagagatttaatgtttagaaatcactccctccttttctgtggcaaaacacacacacgggagatctcacctgggagaaagacagccctctgctgcccactacaccagagattatgcggagataagaaggtgccacaggaagacctacaagggtaattttgacccattttcagatctttctcccctcctggaaaagtccacacacacgctgcagcaggacacagaccttcaggacacagatctggccctaaccaaaccccatgcagagcacagccccctcagctccctgtggatcacaggctgatctcagctctcaacatggaggaaactgccttgattttcaatgctggagacagataaggatcaccagtgccatagtaaatattactgagggtgggtttaaatctatgataatagcaatctctgataaaacagcataaaagatgtatttgcaaaatgcctgagaaccctaatgtgaagtcagggttgagctccactcagtgggtgccagcctagcacagccccaccttctggctctgctctccacttggggactttttcccaccaggatccagtgaacagcgaaggagcaaaaagaatcacacagaacaggcaacatggatcagaggtgggggtgaaggtggggctgtcatgtcatatgggggctgtgggtgatcacaaaagtttccatagaaaaaagtgatgtcagaacaaagacttagggaagaaacgctgcttgtcacttgcagctgaggggccagagagtcctaggtagggggacagcccaggtgaaggccctgagataggagcaacctcagtcccagaaaaaggaaagaagcctgcgtggctggagcagagggagcgaggaggacacaggcaggagatgaagtcagaggggtcctgggagcccagatctgcagggatgaggccttgaaacatttttctcccacacctcaaaggaattttggaaacgatgtattttctcactcctttcatgtatacatgcaaatgtctctttacattataaatgacaacacttacaaataatgtaatttatctcccatacttaaaatacatgctgtcaagtttggctaagcttccagaaatacactgtcaccctcatctgagacatgtaggactgtaagggaatgtgtttgggggtttaggaagtcacttatggacacgtgaaggtggagatgcctgtttgatgtcccagcagagagctgaggagacaactgcacacaggattgtagagctcagtggagaggcctgcaggggacatgggtaggtgggttaaagctgtgagatgagataaggaaaagcagtgggtgtggacagagacaagaataggttcaagatgatttgagtctaatcccgtttttccattctggtatttgtgatttttacatttttggaggactggaatccatttaacattcaaattacatctgagcagtaccctctcctaaaggaaaagccacacactatttggcaaagtatttcagggctcagtgaaattccatctctaccaaaagtacaaaaaattagccaggcgtggtggtgtgcatctgtggtctcagccatttgaggggctgactgtggtggatctttgggcctgggaggcagaggttgcagtgagtcaagatggtgccactgcactcaagcatgggtgaccgagtgacactccatctcaaaaaaagaaaaaaaaaaaattccaggacaattttatacacctgagcaaatgaaatgtctctttcaatgtctaaggtcctgatggcatgaatcctaaacatgtaattattttcccagaaaaatcatagtaatatcttcaaaataaacacaattatgaatccctagctataggtgtttaaaacactgaaagagaggcagtggtacaaatgagatctgagcaaatgttttcttcatgaacacatgggctctgctggaacaaggttccaggccaatcctgtccatccttgaacatctgcaaagaatattatggaccagaggaacttgaggggaaagcttatttagcagctcacagctcaccatttaattagatgacataaagaaagaagatggaataataggctacttcaactaaattttaatgttagcataaagaaaaagttccttgatatctttatcaagtacacatcgaaacaacctaaaatcatttatcaggtactagaaaatgtttccaatgtatgatacagactagaaagcatgcagtcctcaatgtaaactaaacacaataaatttcagagaaaaacaattttaaaatggcttaaaaatatatctaatgaaatgtggggtcaaagaagaacattttgaacacataccgtagttgcaaaacaatgatgttacctcgtaagattataccaaagctttcatgagaagcagttttttatattactttaattttattttagagatggagtctcgctcttgcccagccagagtgcagttgcaggatctcagctcactgcaacctccgcctcccgaattcaagccattcttctgcctcaccctcctgaatagctgggattacaggcactcgccaccacaccaggctaatttctatattttggtcaaaacgaggattcgccatgttagccaggctgttctcaaatacttgatctcaggtgatctgcccaccttggcctcccaaagtgctgggattacaggcatgagccagagcacctggtctatttttttttttttaaattaagaaacacgttggtcatggtggctcatggctgtaatcccagcaccttgggaggccaatacggctggatcgcttgagccctggaattcaagaccagctcgggcaacatggtgaaagcccatctctactaggaacacaaaaatttgcccggtgcggtggcacctggctatggtcctagcaactttggaggctgaggtgggaggatcccttgaacccaggagattgaagcttcagtgagggctgatcctgtcaccgctctcatgcctggccaacagaatgagacccatctttaatagaaatgaagaaaaaggaaacacatgcgtcctgggtctggggacagggagagtctaaggccaattaacacgaacctcaggaggtcctgatgacgtgtgtccatggtgttgaggctgcagtttggtttcacacattttacagacacacgagacagcaatcagtacatatatacattggtccggtctggaaaggtggaataactggaattggggaccttctgggtcacaggtagataacaaataacattctttgaatctttgatcagcctttcactaaatacacaatttatatgtgagcagggaggagggataagtcacttatgccttaggctggctcagggaccctgtatttttacataaatagggcaagggaagcaatcagatagacatttgactcaggtgtgcagagggatgggctctttcccacatctgtgaagataagctctcagtttacatcgccagggtgaaattcaacagaactattttagggtggagatcttgaggttcccggtttgggaggggcatatgtagctttttaaaaaatctttgtaactatcttgtttaggaataaaatggaaggcaggtttgtctgacgcagttcccagattgacttttctctttggcttagtaatttttattttcctttcacaagcttgtgacagccataatgctttgacacactgatactgttttatatagatttttccacaacagtaaagtccaagggtctgtcatgaaccgggttagagaagatgagaaaattttcagaagactccatctcaaaaaaacaaaacaaacaaaacagaatttaaaatacagaattaagtcatttgactttttttaaatgaaaagtctcacatatttattactgaaccaagccaacaaaggtgttcataacagatccagagaaaaaaaatacattctcaataaaacatgtccaactctccagatagtggtgacattttcagcttgatatggtaacgtgactgaatcttcagacagcatgaatatgtgtgccatctcatatgcaattccttatagatccagcttggctcttctccagtgtcgtctttgacagttgtacctataaaacttatgtggatggtctgcctgccactctgtgcatcactttcttttttttttttttttttttttttttgagatggagtctcgctctgtcacccaggctggagtgcagtagcatgatctctgctcatggcaagctccacctcctcggttcatgccattctcctgcctcagcctcctgagtagctgggactacaggcgcccacaaccacgcctggctaattttttgtatttttagtagagatggggtttcaccgtgttagccaggattttctcgatctcctgacctcgtgatgctcttgcctcggcctcccaaagtgctgggattacaggtgtgagccaccacacctgtcctgtgcatcactttcaacatcatcttgtcccaacttaaaataagttttccatttacaaactggtgatttattttgggaatcgtccccataaccttttcataaagcatcaatgatttcattgtccctctacccaaactttaccagattcatttttcgatacactatctgtctctgtcacccatgctggagtacaatggcatgatcatggctccctgcagcctcgaactcctaggctcaagccatcctcccactgcagactccacagaagctgaaccagcagacatgtgccacaatgcccagctaatttatgtattttttgtagagaaggtggtttcaccattctgcccaggctggtcttgagtaccggggcccacgtgacccaactgtctcagcctctgaaaattatgggattacaggcctgagccacagcatctggtctcatcgcaaatttgatgtttcttcttgtttcagttttagcagaatttacattgccttgattgagtctcttttcaaactcatgtcttacccatctgagtgcctcaaaccaaaccctgttcagacatgttataacggatttgtatcagtttatcttggtgcaaaaaatgtgatatcatgcacaattttctcataatatgtatttttccatgaacttcctgaagaccccttgtactagcgaactgtattcaagaggttataaaaaggattgttgatatgcaagtgccacttatttctgggatgcaaaatggttcaacatagtcaagcaaatcaatgtgatataccacttgaacataatgaaagatgaaaaccacatcatctcaatacatggagaaaaagcatttcacaaaattcaacatccagtcatcatggaaatcctaaacaaaatagaaagagaaggaaatttacctcaacaatacaaagaccatccatgaaatgaccacagcagaaataaccagtcagggaaaatggaatgcttttcctgtaggatctcacatgatgcaagaatgctctcaccccttctattcaatcaatactggctgtcctagctagagcaatgaaatagcaaaagaaatcaaactcatccaaatcagaaagaaagaagtaaaactatttctttgtagatgacatgatcttctgtgtagaaaatcacaaagagtcaaccaaaatgcaactggaactaaaaaacatatgcagtggatttgaagaatagaataacagcaccaaaaattagttgaatttccatacattaacaataaacaatttaaaaagaaaattaaaaaaacactttcatttgctaaagaacttaaagtaagaaatacttaggaataaatgaaaaaagttgagaagtttctaccttcaaatctacaaacattgatcaaagtgataaaaacatgtgcaaataagagatacaagccatattgaatggaataatattgctaaatgattataactgaatgtgatgtagattcaacacaatacccagagaaatttctataactttttgttaaagaaacaaaaaacaggccaggtgtggtggctcacgcctgtaatctcagcactttggcaggtggaggcaggtggattttaaggacagaagatcgagaccatcctagctaacacggtgaaacccagtctctactaaaaatacaaaaaattacccgggcatggtggcacgcacctgtagtcccagctactcaggagactgaggcaggagaattgcatgaacctgggaggtgaatgttgcagtgaaccgagatcacatcactgcactccaacgtgggcgacagagcaagattccatcttaaaaataaataaataaataaaagaacatacaggctgggaaaagtggctcccgtctgttggccaggctggtctcaaattcatgacctcaagtgacctacctgtcttggcctctcaaagtgctgggattacaggtgtgagacaccacgcctggcccaatcctcttaacataaacagtttaatgtcgattaatgcttgaaatcaatgttaagtcaactcaaactcaggtcaatgctgatttgactctgatgtcaattaatgcttgatggtttgctatactcattgcacttgaaacaattgtctccaaaaggaattttctgatgttctgcaaggagtgacctcagactaaagaccttgccacactgatgacatttgtaagatttctgtccagtatggattctctgatgcctaataaggtgtgaaggtgaattaaaggctttaccacaatcaccacacttgtgaggtttctctcctgtatgaatcctcctatgtctttcaaggtgtgatttgcgaatgtaaactttgtcacattcttcacattcgtaaagtttctctccagtatgaagtttttgatgacatgcgaggtacgcttttgtactaaaaaccttgccacattcattacatgtgtaaggtctctctccagtatgaactctctgatgttctgcaagacgtgaatcactccggaaagccttgtcacaaaccttacatttgtatggtttctctccagtatgaatcctcctatgtctttcaagatgtgatttgcgactgaaaactttgtcgcattcttcacatctgtaaggtttctctccagtgtgaactctacgatgtcctgcaagagttgctcgttgcttaaaaaccttgccacattcattacacttatagggtttctctgcagtatgaactgccttatgaattacgaggactgaatttcgagcgaaggtcttgccacactcattacatttgtaaggtttctctccagtatgcagtctatgatggtacacaaggtgtgatgtctgactaaaggtcttgccacactcattacacttataaggtttctctccagtatgacttctatgatgacatgcaagggttgctttttgatcaaaaaccttgccacattcattacatgtgtaatgtttgtctcccctgtgaattctagtatgttttgccaggtgtgaatcatgcttaaaagccttgtcgcaaaccttacatttgtatggtttctctccagtatgaattatcctatgtatttcaagatgtgatttgcaactgaaaactttctcacattcttcacatttgtaaggtttctctccagtatgaattctcctatgtcttcgcaaatgcaaatgaaatcttgattcaagctgacctttaataggcttgtttccagcatgcctttgatcatatcggtctgtactactagtcaacttttttatttctgtcatgggtgcttcatggtcatttgtttcatcttcttgccactgaaacacaaagtcatgaatgtctttctcaatttcctgggagcaaaatgctccaatgtgataacttgcttgtctctgcaatgtccctgtgtggatcacttctgtattgccttgccctgttgatgacaatgtattcatcatgcatttggaagagatatctacaaaatataaacaccaataggtttccaattaagtacagatggtataaaacactgaaatgtataaatatcacacacacacaaaaatacttattttaaacttcccaaacatgagcttcaaagtttaggaacacaaaacaagtaagattctttaataaataaaggccaattacatgtacttcaaatcatttttacagaagcctatttccaatatcatgacaaaacactgacagggcacaaacacacataagcctaaagtaaggagtatttttccactttaatcctaaggggtatcacacagtgcaaaaaatatatcactgtcacatcaaagaagagaaaaatatgtattcttcatatatacagtatatttagtatacagaaataaatgttaaaaaaccagacaatgtactatattggtaaataatccacaacaagctcttgtaaggataatcaaaatcaatggaaattctgtattatcaaacaatcatagcactgagaagataagattacaaaaattagccaggtgtggtagcccaccctgtcgtcccagctactcaggaggcttaggcacaagaattgatttaagccaagatgcaaagtttgcagtgagcccacatcgcaccactgcactccagcctgggtgacaaagtgagactctgtctcagaaaacaaaaaaaggcagggggtggtggctcgcgcctgtgatcccagtactttggaaggcggaggcaggcacatcgcctcaggttaggagtttgaccaacctggccaacatggcgaagccctgtctctgctaaaaatagaaaatgtagccgggcatggtcatgggcagctgtaatcccagctagctgaaaggatgaggcaggaaaatcacttgaactcgggaggcaaagattgtggtgagctgagatcacaccattgcactccaccttgggtgacagagtgagactccgtctcaaaaaaaaaagaaaatgttaatagcatatttttctgaataactgttacaaaattacctatatccatgtggaacaggcatgttgtaacttaaaaaaaaaattttgtatttttatttttttgagatggagtctcactctgtcacccaggctggagtgcaatggcataatcttggttcactgcaacctccgcctcctgggttcaagcgagtctcttgcctcagcttcccgagcacctgggattacaggcgcacaccactatgcccagctaatttttatacttttaatagagatgggctttcaccatgttggccaggctagtctcgaactcctgtgaactcctgtgatctcgaactctggtgatccacacttctcggcctcccaaagtcctgggattacaggcatgagccactgtgcccagcggcagtttgtgacattaacgaagggagtgtgtcagttatattgaataccacataccaaaaactcataaaaggaagaaaataataagtcaatttatactgcctgcagaattctaaacaattccctcttaagaaaaaggccataacttgtagttaccacccgtacacaacataagaactgaaatacatgttaaaatcactaccttctgaagtatgaggtgaagaaaatacacagaattataaggaataagaattgactaatggccggccacggtggcacatacctgtaatcccagcattttggtaggctgagtcgggtggatcatgaggtcaggagtttgagaccagcctggaacaaatggtaaaaccccatctctattaaaaatacaaaaaaaattagctggacgtggtggcaggtgcatgtaatcccagctacttgggaatctgaggcaggaatcatttgaacccaggaggcggaggttgcagtgagccaagatagtgccactgcactctagcctgggcaacaagatgagattccatctcaaaaaaaataaaataagataaataactacttctcatataagctttggtagatgtggtattctctaataggatgttcctgcagatgcagactttgagagaatttagtcatgggtgttgactcctcatgaataggactagtgcatttatagagacattaaagagctcattgcctgttcctctttctaccatattgggacatggcaggaagatggctgggctaaaccgtgaagaagcctctcaccaggaatcaatttggctggcaccttgctcttggatttcccactttccaaattcatgagaaataaatttctgtgtcttaagcttcccagtttaagctacttcctttttcgtttattcttcagatcgagtcacgctcttatcacccaggctagagtgtactggcaggattctcctacctcaactgattctccctcctcagcccagagtctcactctgttgcccgggctggagtgcagtggcgtgatctcagctccctgcaacctccacctcatgggttcaagtgattctcctgcctcagcctcccaagtagctgggattataggcgcaagtcaccatgcacagctggtttttgtggttttagtagagatggggttttaccatattggccaggcttgtcttgaactcctgacctcaagtgatcaacctgtctcagcctcccaaagtgctgggattttaggtgtgagccactgcgcctggcccatttttggcatttagtacattccaggtttcaccatgttggccagactgttttcaaactcctgacctcaagcaatctacccaccttggtctttgaaagtgctaggattagaggcatgagccaccgtggccagtcagtctaagctatttctaacagtgaaatgacagagaaaggaacaggagcatctcatcatcaacatcaccacaggctgacaaatcttattaaacaaaggatgtttagggtctctactataaatcttgcaatacttgaagccatctaatagcactaacatgttttaaaaaccttgagacatgtagggcatggtaatcccagcattttgggaggatgaggtgggagattcctgaggtcaggagatcaagaccatcccagctaacaaggtaaaaccccatctctgctaaaaaaaaatacaaaaaaattagcctggcatgttggcactcgcctgtagtcccagctacttgagaggctgaggcaggagaatcactggaatttgggaagtggaggttgcagtgacccaagatcacaccactgcactttagcctgggtgagagactgagactgtgtctcaaagaaaaaataaataaatgacagaaggctaaagaataactccaacccacaaacatatataaagttctccagtaaaggtaaataaaaaaaacgggtaggctgggcatggtggttcatgcctataatcccagcactttgggagggcaagccaggcggatcacctggggtcaagggttcgagaccagcctggacaacaaggagtaaaccctgtctctaccaaaaatacaaaattaggccaggcgtggtggctcatgcctgtaatcccagcactttgggaggctgaggtgggtggatcacaaggtcaggagatcgagaccatcctggctaacacagtgaaaccccgtctgaactaaaaataccaaaaattagccaggcatagtggccagcacctgtagtcccagctactcaggaggctgaggcaggagaactgcttgaacctgggaggtggaggttgcagtgagctgagattgcaccattgcactccagcctgggaaacaggagtgaaactctgtctcaaaaaaataaataaataaataaaacaataaaaatacaaaattagctgggtgtggtggcgcatgcctgtaatcccagctactcgacaggctgaggcaggagaattggttgaaccggggaggtggaggttgtggtgtcaagattgcagcactgcacttcagcctgggtgacaagagcaaaactctgtctcataaatacataaattaattaattaataaaaggacagatacagaaactcgcatacgtataccttttcttcataactaaactttttttcatattattaaaaatgaaaatgtatgaaaaaacactgtacatatatgttaacagaaatgcaacatacacaaaaataactctgacaaaaataaaaaagttctactggagaagaagtagtttttgtaggttatggaatttttttatttttatttttatttttttgacatggagtctcactctgtctcccaggctggagtgcaatggtgcgatcttggctcactgcaacctccacctcccaggttcaagtgactctcctgcctgagcctcctgagtagctgggattacagctgcccaccactgtgcctggctaatttttgtaaatttagtacagatgaagtttcatcatgctacccaggctggttctgaactcctgacctcaggcgatctgcccacctcggcatcccagtgctggaataacaggtgtcagccactgcacctggccaggttatggaaattttaagcttcattattgtgctataagtttaagatgtttaacatacctgcaacaataacctctccccatatatcaatacaacgcacttcacttctgcgtactgaacggaatggacactaatgtggttgttatattcacactggaatcatgtttaaaccacttatgtttactaagaactaaaagacaaaactatttaaaagaataaccatggttgggcatggcagctcgcgcctgtaatcccagcattttgggaagccgaagcaggtgaatcacttgagataaggagtttgagaccagcctgaacaacatggtgaaaccccatctctactaaaaacacaaagtgagctgggcatggtggtgagcgcctgcagtcccagcctccaagaaaggtggggcacaagaatcctttgagcctgaaaggcagaggctgcagttagccaagatcgttccactgcactgtagcctggatgaaagagtgaaactatcaaaagaaaaagaaagaaaagaagaaagaaagaaagaaaagaaagaaagaaggaaggaaggaaggaaggaaggaaggaaaagaaaaaacaaaacaaaagaaaagaaaagaagtaaataaggaaagagcagagggataagtgagggcaaagaaagatgtcccttcagagatctcaggattgaaacttttcttttgccacagaattctcccacttgcagagagtttccccacacactatttgaaggtggagcttccactctgcccatctgagctcttacctgcgtttacacctgtaatacattcccacccatctggagttttttgttattttcacttaactctccacagtccagggctctttcccttgctccaacatggagataacaggtcagaaagagactcgtgcttataaaaagaaaggaccatgatgtgctggagcttttctagagtcccagccctatatttctgtaggaaagaagacattacaggtggatctaggaaaatatttcacaaattcctccactgactgcctcattctgaatgctgttggagcactgtaatatgtaatatgtggacatcgggctatcttccaagaactaatgagttgaaagcacaggagaagcaaacagggaactggatatgtttaaagtctaccataaggttttgtttttgttttttgagacagtcttgctctgtcgtctgggctggagtgcagcggtgtgttctcggctcactgcaaccttggcctcctgggttcaagcaattctctctcctcagcctttctaggagctgggattgcaggtgtgcaccatgacgtccggctaatttttgtatttttagtagagacagggtttcaccatgttggccaggctggtctcaaactcctgacctgaagtgatccacacacctcagtctcccaaggttctgggatgacaggcatgaaccaccatgcccagcttgccataaggttttatgcctactttagttctggaacccacattgaggtatcatgaagaacgcagaacatctaaacaaaggggacagtgaaagtccagatgctacatcatgaagcttttcatttcaaaatcaatacagcttccattttagtcaagcaaggatgcaactcccaagagaaacaagagaaaatacaaagatccacaagggcacatccccacttctggagggaagttatcctcacccagggagaccaggttcctataattctccagcatcacgtctctgtatagagtcctctgagcagggtccaggcatttccactcctcctgagagaattctatggccacatccctgaatgtcagtagaccctgaaaggaaaacacattttaagcaaatggttatgggaggagatcttatctttacagaaaatgagaagaggagaggggaaagcatggatttaattgcagagaatgttccgacaaatccaagtaagggattcttcaccacatgatgtcttcccagtggtgtttgattatactttctgaagagctcaggataccctctcagtatgaattgcttacgttagaaataaataattagccgggtatggtggcaggcatctgttgtcccaactacttggaaggctgaggtgggaggacggcttgaccttgatggtggaggtttcagtgagctgcgattgcaccaaggcattctagcctgggcaacaaagcaagactctctctcaaaataaaataaaatacatgaaagtaaaattacacaaagcacaaaaatccattttgtaaatgttcacaaaataataaaacctacacagactgaaaaaaaactagatgttaatacaaagggttgtcatttgtcccagattttcaaaatataaaagattttcaaaatatatacgtgtgtgtacatatgtatgtatgtataaatgtgtgtgtatgtgtgtggggatgtgtatgcatatacatatataggttttacaaatataaaaagtagcaagttttgcagggcgcagtggctcacgtctgtaatcccaacactttgggaggctgaggcgggtggatcatgaggtcagcagtttgagactagcctggccaacatggtgaaaccacatcttaactaaaaatacaaaaattagctgggcgtggtggcacgcacatggagtcccagctactggggaagctgaggcaggagaattacttgaacctgggcggcggagtttgcagtgagccgagaaatcgccattgcactccagcctggtgacagagtgacactccgtctcaaaaaaaaaagaaaaaaaaagtagcaagttttgtttaactgaagaggaatctcatcttgctggaaaaggatactttggcagctgctggtgggtggaatctcatcagatctagggaaacaggaaatgccccatcctagatgaatcaattacccttttaactgcctggcctggaggacagagaatggcttgaattcgggaggcagagggtgcagtaagccaagatcatgccactgtactccagcgtgggtgacagagcaagactccatttcagaaaaaataataataatagttataggtggaataagaatatggctttatcctctaggataaaaaagaagtaccgctgccatatttgagaaaaattgtaaccagttttaccacaaacacctgtttcacaagcctctccacaggaaccccacagtctccatgagcgtaatgtgctaagaatggtctaacgaatctcctgctattatttaggttgatttcctattcttaaaataatgataggatcattcttgtatcattcatatctatgtatgaagtttccattctaattagtaagattttttgagtcagaaacacagtaagtcactcaattacctaaaaatgtactataatgtcaggcagaaaagatttcctattattggtctctctttctagaatttaccatgcactttgtgcacattaatatgtgacttccattggcagctgctctaatcctggtccacggagagctgacagagcatccagatgtggcccctgaacaatccctgctacccaacagcactgacaccatgggaccctcaccccgtctccatccatgtctgggtgtgagtccttcccaggaccatgcccagtgcagcctcttcccaacttcatgtcacttggtcacaggagataaaatctaagtgagataagagggactgagggaaggcatgggtgattgtgagcaaacctgtcaggcaggatgcttcagactaagagaagattcccaactccaggcgccagcatttctgaaaggaaggagacagaacaatccaccgagaatatcatctcacctgagaaagagccatccccgactcctttgctttcctcttcctcttctgggtttcttcctcaggtaccaagagtctttagaagtcaatcctaaatgttagaaatatgttgtttatcactgagaatcaacacaccccctccccataacacaatgacacatacaaaggaggcctcaccctgggaaatatggtcccctctgctgcccactgccccagggatgataaactcctacaggaaaactcccactaccctactggaggagtccacacacacgctgcagcagtggggagctgggctgggatgagctccccttcagggcacagactcagacctaaccaaaccccacacagaggctgggtgtggtggctcatgcctgtcaccccagcactctaggaggccgaggtgggtagatcgcttgagctcaggagtttgtgactagcctaggcaacatggtgaaaccccatctctacaaaaatacaaaaagttaggaaggtatggtggtgcacttctgtgtgtctgtggtcccagctacttagggagctgagatgagaggatcacttgtgctcaagagttcgagaccagcctggccaacatggtgaaaccctgtccctactaaaaatacaaaaattgggccgggcgcggtggctcatgcctgtaatactagcactctggaaggccgaggtgggtggattacttgaggtcaggagttctagaccagcctggccaacatggtgaaaccctgtctcttactaaaaatacaaaaagtagctgggcttggtgggcatctgtaatcccagctactcgggaagctgaggttggaggatcacttgaacctgggaagtggaggttgcaatgggccgagatcgtgcaactacactccagcctgggtgacagagtaagacttaaaaataaaacaaaacaaaataaaataaaataaaacaaaactacaaatacaaaaattagccaggtatggtggcgggtggcacgcacctgtatctcagctacttggtaggctgaggcacaagaatcacttgaacccaggagacagaggttgcagtgagccaagatcaggagactgcactcacagcctgaaggacagagtgagactctgtttgaggaagagaaaaaaaaaagcgtttctgatgtgatagagataataaaacctgagtaacatgatagagattgatgggcagagggaatttcagatgggggtgggagggcatgggagacagctctgagcctagacctgaaggagcagaaagggagatggctgtgatcatttagggacatagggtaagaacggggaaaatgacctgagacaggaagggttttgatgtttggggaaagagataagcaaatgtgactggggcggagggagtcattagattagggcaagctcccaggaggaggctggacactggcaggggccctggacacagggctgtggagccacactgatgagttgggcttttgtcctggggaacacgggaagctggtggagggttccctgccagggactgatgtgacctgctttacatttagctgtgatatcctcagagtggggacatattcaccgagttaccctgagaaggtctgagatgagtgagaaggtgtgtctgaattcttacatgggggcccagaagggctaatggaaagggttggtcttatcacctctctttgaaaattagagaagcatctttcacatacctgggctaaagaaacttcttttgcaacgttctgatgctattgactttcaacatttaattcttcttacaagaaaattatagtaacatatataaaatgcagaagtgaaaacacacagctactgaccttgaaaacagggaggccaggcagggtggctgaggcctgtaatcacagcactttgggaggccaaggcaggcagatcacctgaggtcaggagttcgagaccagcctgagcaatatggagaaacccccgtctctactaaaaatacaaaaattatctaggcatggtggctcatggttgtaatcccagctactcaggaaggttgaggcaggagaatcacttgaacccggaggcggaggttgcggtgagctgagattgcaccattgcactccagcctgggcaacaagagtgaaactgtgtctcaaaaaaacaaacaaacgaacaaacaaaaaaagaaaatagggaaagagggtcagctgtagaactactatataagcaaatgttttcaatcaagaaaacatgggtggccagatacagtggctcatgcctgtaatcccagcactttgggaggtcaaggcaggtggatcacctgaggtcaggagttcgagaccaacctggcaaacacagtgaaaccctgtctctactaaaaatacaaaaattagccaggctccatctccacaactcatttaatctcttgctgctccttctccccaatctttagatcatcctcaatctctatagatttccacctcttctcccatctctgtgcatcctctgctctccctgttaaattgtctcttccttgttatacctccctggccccactctctggcaccccagatccccaggtgtcctccctgctgtgcttctccctctgttctccttgccaccagcaccactctgctctgtctgccctggctccaaatccctcctcctctccctcactctgatgagactccctctttgctgtccctctccctaccttgctgtccttcatctctctgtacatctagcttttctctacatttctccagttgcttttctcctcctgctttcttattttttttttcacttttgctgtctcttggcaaatccctcacccatcttctactttgccatctgttatgggcctttctcattcttcttttctctgtctcaggttttttactgctctctctctgtctcctgatccctttggcccacacaatcacaggagggtttggacaccttcatgtcagaggagcccattttccaggggctggcactgggcagggaagaacaccttgtgtcaccatataggccccaggcacctccccaatgcgggcctgggcaacagagcaagactttctcaaaataataataataacaataataattatgtatatatattgcaaatgctgtgttttctacgtaaaccatgggcttggccacacgcattacctcatgcctgtaatcccagcactttgggagggtgaggcggtggatcatgagatcaagaggttgagacaattttggccagcgtggtgaaacccgctctctactacaagtacaaaattagctgggcttctcggcacgcccctgttgtcccagctacttgggagactgaggcaaaagaatcacttgaactcgggagtcagaagttgcagtgagctgagatggcaccagtgcactccagcctgtcgacaaagtgagactctgtctcaaaaaaaaatcatgggcttatccattaatgcacttctgcacatacttcaaattacatccacacacacttaaattaacttgcgttcagaaggtataagcaaaaacctggagaggacacaaccaaagctactcaccaggctgaggtgggagaattgcttgagcccggagagcagaggttgaagtgaatcaagatcgcacaactgccctccagcctgggggacacagcgaaactccatcacctccaccccccaaaaagttggaagctcactgaattaagatacaacttcaagaaatcataaaagcaatgcatgaagaacatgagaaggacaaccaacatacagaaattatgacgaactacacagaaactctcgggataaaaatacagtaactaaatggaaaaactcaatacatgggttcaaaatcagaattcattatgtaaattaaaaactagtgaagaggggtcaggcaaggtggctcacacctgtaatcccaggactctgggaggccgaggtgggtggatcacttgaggtcgagttcagagaacagtctggccaatatggtgaaaccttgtctctactaaaaatacaaagattagctgggtgtggtggctggctcctgtagtcccaggtactctggaggctgagtcaagagaagcacttgaacatggaaggcagaggttgcagtgagccggattgccccactgtactccagcctgggtgacagagcaagactgtctcaaaaaaaaaaaaaaaaccaaaaaacaaagaaagaaaattccaggactatcttttatacacctgagcaaaaggaatgtctctctccatgtctaaggttctgatggcatgaatcctaaacatgtaattattttcccagaaatatgacagtaatacgttcaaaataaacacaagtgtgaacacatagctataggtgtttaaaacactgaaagaggccaggcgcggtggctcacgcctgtaatcctagcactttgggaggccgaggcaggtggatcacgagctcaggagattgagaccatcctggtccacatggtaaaacccggtttctactaaaaatacaaaaattagcctggcatggtggtgtgtgcctgtaatcccagctactcgggaggctgagacaggaaaatcattggaacccgggaggcagaggttgcagtgagccaagatcacaccactgcactccagcctgggtgacagagtgagactccttctcaaacaaaacaaaacaaaacaaaaaccaaaacaacaacaacaacaaaaaacactgaaagagaggcaatggtagtcataagctgtaagcaaatgttttcttcatgaacacatgggctctgctggaacaaggttccaaaacaatccagcccatcgttcaacatctgcaaggaatattatgaaccagaggaacttgagggagacatttacttagaagctcacagctcaccattttatcagatgacataaggaaagaaaatagaataggctacttgaaccaaattttgatgttagcgtaaagaagaaaggtcctggggccgggcgtggtggctcacaccttaaatcccagcactttgggaggccgaggtgggtggatcacctgaggttgggagtttgagaccagcctgacaaacatggagaaaccccatctccactagaaatacaaaattagcttggcgcagtggcacatgcctgtaatcccggctactggggaggctgaggcaggagatcacttgaacccaggaggcggaggttgtggtgagccaagatcgcgccattgcactccagcctgggcaataagagcaaaactccatctcaaaacaaacaaacaaaataggtccttgatatctttataaagtacacattgaaacaacctaaaattggccaggcacggtggctcacacctgtaatcccagcactttctgaggctgaggtgggcggatcacctgaggtcaggagttcaagaccagcctggccaacatggtgaaaccccgtctccattagaaatacaaaaattagccaggcgtggtggcaggcgcctgtaatcccagctacttgggggctgaggcaggagaagagcttgaacccaaaagacggaggttgcagtgagccgagatcgtgccatcacactccagcctgggggtagaagggagactttgtctcaaaaaaaagtaagaaagaaaaaaagaaacaacctaaaatcatttatcaggtactagtaaatgcttccaatatatgatacagactagaaagcatgcagtcttctatgtaaactgaacacaacaaatttcatagagaaacttttaaaatggttaaaaatatatacatctaaaaatgtatatatctaataaaatgtagggtcaaagaagaaaattttgaactcatatcatagttggaaaacaatgatgtgagctcataagattctaccaaagcttatttgaaaagtagttatcttacttttttcagacggagtctcgctctgtcaccccaggctggagtgcagtggcatgatctcagctcactgcaacctccccctccctgtccaagggattctgctgcctcagcctcctgagtagctgggattacaggcgcccgacatcacacctggctaatttctgtattttattcgacacgagatttcgccatgttgactaggctggtctcgaactcctgacctcaggtgatctgcccgccttggcctcccaaagtgctgggattacaggcatgagccattgcacacggcctttatttttatttatttattttttaattaagaaacaaggcgggcatggtggctcatgcctgtaattccagcattttgggagggcgatacagctggatcgcttgagccctggagttggagaccagcctgagcaacaaggcaaaagcccgtctctaccaagtacacaaaaattagcgcggtgtggtggcgcgcggctgtggtcccagctactctgcaggctgaggtgacaggatcgcttgagcataggatgttgatgatgcagtgagctgtgatcctgtcaccgctctcccgcctgggcaacagagtgagaccccatctccaataaaaaagaataaaaaagaaatacctgggtcctgggtctgggggcagcgaatctaaggccaattaaggcaaactttctaaaactagacaaaaaggaaaaaccccatctccccatccggagtaacaaaggatcaaaggccgctgtccctaccgccctcctccttccaccacgtctcagaaagggaaagagcccaggagtggccatggccaagcaccggccacaccttcatctgcatagggcacccatctgctccggcctcgggccaattcacctcagcatttcgttggccaagggccaaaaatccttcatccagataaggggtagcccatagggacctcaaaataaatactttaaccccctaaaactttctaaacgggtccccggagacgctggctcgggcccactcccctctgtggagtgctttcttgattgcatatattcgttttccaggagttggaactaggtagcaacaccgcacaaggagggaggtggggagcgacggagccttcggacaggggtggcgtctgcaggatcttaggaccaggcagaggacgcggcctcccgggaaccggggttgaggcgcggcgctcctgaagccgccgagagcgacggtgggaggcgcctagggctggaatccagctcgcgggtgaggacttgaaacagcgcgaggcgggaggacaggtcaggaagggttttgagaaggaaaattccgcgataggaggtgtctgcacgaccccactgcagaaagaccgaggacgggacctgcctcagggccactttaaactcgaagggactcacggactctcacccggacgtctcaatttgctctgggttgagaaagaggggccgcaatttccaggtctgtggggactcaacgtccccggtatagcagcaccacaggactgggaagcacacataaaacagagcgaaactcacgcgctgtggtgtgaccttcagtccctgccatccgcttccgggtctatgccaatcagcgcaggacagaggccaggcctgggcgggacccccgagaaggtaggcggggcctggactaggccgggatgagacgcgaagaggtgggcggggcctgaacaaggccggggcggggttgagaaacaaggggcctggctgggagaagagtcctgggctatgaggggtcggcgggggcgagaagcgggtgggtcctgagctttcctccatctcgctctctgcgccttttttccaggttttggaggcgaaagccgccagtgaggctggagcagctcagcagtcattgaaatagtacctccctgagaagtcaacgtgaggcggtcattggacccaggaaagttccttgctattgaaattaattttagcaatttatgtccaaaatctggaagttgtcaagggaaggaatgcaaactagaatgcgaaatacaaagctctgcctcagcgaaacctccaatttcctgctgacggcccacagaacagaatagcaaatcctctccctttctattttccattcactggggtgggagaatccaccctgtgctcagctccagagacttcctcagggccaccgcctggggtgcggagcggaggcctcaggccagggaggagtgaggtcaccacctcctgcttaaacacagcagggatgtgggcgaggtggcgagtctggggtcccggctactcaggaagcaggagccgcaagaccgctgagcccggaggtccaggccagcgtgggcgacaaagtaagaccctctaccccagagctccttcctccgcctcaataagaaaaaaagggatttttaaaaaaagcattgacattgtaacagtgtgtagcagggctagcggcagacaaaacttctcagacactgagttgtagaaggaagggctttattcagctgggagcgtcagcaatctactgccttgaaatccgagctccctgaatgcacaatttctgtcctttttaagggttcacaacactaaagatttcacatgaaagggtcgtgattgatttgagcgagcaggcggtacgtgacaggggatgcatgcaccggtggtcagagagaaacagaacagagcggggagttttacaatgttcttctatacaatgtctggaatctatgaataacattgggttctaagccataagttgatttttaactactgggtttaggccaggcaggcccaggcctggtttcgggcctggccccggggctgcctgtctttggttttactttcttgttgttttttcttaaaacaggtactgagtataaaacaatatgagagggtctctgtcttcctttatttcttctttttgagagtctcactttttattagtgggagttcttactcttgtttttgctacttatgtctttttgtgtaatagattgatagtgattcatatagtacacttgtgctgaatcattttggtgaactaaggtagcgatgaagctttttatcatttgaagaggtacaggtagcaaacaagagagcagtaagcagctttttattactattataactcttattataagagttttaaatcctcctattgctgggaactaatttttaaacatggctcctggattgagtccgtgccacacctgtacgggtacatgtgtcagttttgttatatttttaactatgtcttcaactactttcctctgatgatctatgtgtagacaacaattagtaaggttaaattttctacaaacttttccttcagctgctagcaagtagtcgagagctagtctattttgatagatagcatttctttttctttttttggtgatggagtctcgctctgtcacccaggctggagtgcagtggtgcagtctcagctcactgcaagctccacctcccgggttcacgccattctcctgcctcagcctccctagtagctgggactacaggtgctgccaccgcacccggctaattttttgtatttttagtagagacggggtttcactgtgttagccaggatggtcttgatctcctgactttgtgatctgcccgcctcagtctcccaaagtgctgggattacaggcgtgagccaccgcgcccggtgatagatagcatttcttatcagagtctcttgccgggcaagaacagtcaaggcttgaccggttttattagtaataatttttaaaacagcttgcaactgtatgattcggttgagcatgtagatgggggttcgataacctcatgagctgtcttgtgtctaagtggcaggcttacagtattatataattctttaggaggtcatttatcatctttctaattacctatggctatgcttcgtttttcacaggaagcatagactgggaagcctagaagttcacctgtatttatgggcagtaagaggaaagatggcttactggtgccaattacacagctacctgtccactgatcaggcagcttagcatgagctctgtctatgtatctggtataacctggtgggggccgtctagtcctggtggaattccgggtgggcctcaacagtctgcaactttggaaatttactgaatggatttctttttgtgtaactggaactttagtatgtaactgtttttgtggtactattatacaacttttgcctaagacaactaagccgccttacaggatgatgagtgaatttttttctttctctagctatgcaataccgtctaataattgagacttttagaacttaaaaattgtcagggtggttcttttgggctgggaattcatcaggaactgggtttgtaggaactaattctcgggcttcctatggccattgatctcttgttacagttcttctacaaacataacatgaggtgacttgtagagactgggcctcatgttaggctaattgcaaaaacaaatttttagtttttcctggaatcttaggtactggcacatttatttcatcatagaaagcctgaaatactggttctggagagcatttttcaacttctttttttattaggatgtttacgctaggatctagttttttttcatcaatgcttaatttacattttttttttaattgtactttgggtctgatgggtttgtgattatcaattttaaaaggctgcagcccccactcatgcaagaggggctgacttttcttttttggagctaaacaggattatttttatcttctttttaagtagcccaaatgacataagactagtattgacacatctcacataaatatgattcttgacagatatacttatttttttttttaactgtgtaactttttttctaatttagagaactgcatcttattctatgctgcttactatcaatagtggcacaagcatcaaattttaaggttatatttttggggacccctcttctgttctagctattattttacttgtgtcacttagaaaaagactagtctttaattttattttaaaaactgtaatcatgggaggcttaaaatgggttataacacacatcaggttggttattccttgggctacatactttggatagaatagcattatacaaacaaatttcttttagaatcctggtacacttataataactataaaataataggactgtagcaatcttttgtctaacttcagtgacttgatgtagatactggaaacagttctttgtctgaggaaggtcagttgaagtccttactgtacaagtctaaattttaaggaaaatgagtcctgcgatgagtttcttcctgcttcagtcgtgcgtggaccagtcagcttccgggtgtgactgcagcagggcttgtcatcttcttcagagtcactttgcaggggttggcgaagctgctcttatctacgtacagctcctagtctactgatgtttaagggtggtctcagaggttgggcccactagaataaactgagtccagcacctctaaacagttatgtttaactgggctctttgatactaggagtaaggtggcggggttagggtgttgcaaacttcaatggttatgtggggattttcacagagcaagctttggtatctagttagtctagcgtttattagctaatgatgtcttttgttatttattaaagggactttatgtttatgttttgcctaagagttagcttatctgcttcttgtgctaacagggccattgctgccagggcccttggacatgggggccagccttgggaaacctcgtctagttgttttgagagtcaggctactggccttggccagggccttacagtctgggttaaaacttcaactgccatttttttttttctttctgacacatagagtgcaaagagttttgtcaggtcaggtagcctcagggctggggctgacatgagtttttcttttttttttttctggttgatgaaataccagggtgaaatggactaaaccataagtgccactctagttattcggcagagtgcctactaaaggtctactacaataccaccacacatctgctcagagatgaacaagggctgaccgattgataagctcttgaaaattcttaagctcactgcatcctttcaggtctccaaggaatgctaaatctcctctctgccgtgagatacaagaagtgaacttagtattgggagacggaagctggaaggccctcgggggctgatccgcagggacttcgggatatagcagagagagctatatgttactccaggctgtagaatcctggaaaagagctaccatgcagcccacacctggtcaactacaggaccaccttagtggaagggggacaatcagggcctctggcctgccatgtgcacaagcataacaattgcttttgtttaatgtgcagatggaatatttgatctatttcaaccaggcatttgcatcttggtatgctgtctcaattgccaaagtttgttttaagtctttaacttctatcatcctctagtaaaatgaatgcttcctttagcaccgatttttattagtttttagaccaaagaaagctgaacaccattttatatttaataatgcttcttgtatgatttttataccagataagctaaattttacttttatattagtgtgttactaatgttaaatttaattttaatgaaactttgtagacatatttatctaatttttcatgtttgaccataaggttagattttgtagactctttttaactttttgtaatttttgttaaagagcaggttgatgctttaagaaaaaacctgttgcatttttactttgatgtccgtttcacagaaaaactggatgatacctttttaactttagctaatatgtttacacacagaattttctttacaattaatgttttaaaacttgcttaaactttcaaacaataatttttttaactttttaatataggtaaaaatccacattcttatgcctccttataatctttttactataggtatattttacttttcttatacaccttgtacataaactgtttcttcaataataggaggccttattacttttaaattatacattttttgcataaaaaaattttttaaagcaaactttatgtctttggactagactgtctaaggctaccagattagaagttactataatacatgctacgctgttaacttttagcaaacttcacttttgttgaaaaccttgtaagtttgggacttcaattatcctttgctattaataagaccttgtttagtctaaattaacttagaattggtatagatggcctctttttctctctgctggtcttttcttgcctctgccagccacttatgctgctgttcttttaactactgtggggggcggggggaggaggtctaaaaccaggtgtaactgtctgtgtactgaaactggtctgggtgccttggcttacaggttaccttgtgccatatctttgaaactagggacccatccaggcttccttctgatggctaacctacctcaaatgctggccagtctatttcacacaaagttctaagttttcctggggtcacagttacaccataatctcctttaaattctttcttgaaattctttaacatatttcttagtggggtgggcttactttgtgcctgaactatgttttttttttcttctgagacaaaatgccatgctcacaccacacatactcaccacaagaatgggtaaagagggcacacacacgcacttttaccgtttataccaaaccaaaatcatgaaattcaaaatctgagtactaaaaaattcaagccaagtcaaaaccaaaactaaagtatctaacaattcaaatcaagtcaaaaccagaacaaaagtgccaatgcaggcatgctgtgggtgatcaggccacgcttccactcagatggagtggggcaagttccaaagactagtcttactaagtaaagccaagtcaaaaccaggacaaaagtgccaatacaggcatgctgtgggtgatcaggccacgcttccactcaggtggagtggggcaagttccaaagattagtcttaccaagtttcagatgtctggactccaagtgccagttccttcctggtgttcagccactgcgttaatcctccgtgggggcctgctatgcaccgctctggcgaggcattccattggggcaatttcctacccaggagcgctctttggatcgtgtcactcaggctggccagagtcccccgcggggatgctccacagggcaggcctaagccacctaaagggctgcctcggccatccatcagttacctcattttcaggtcagggaaccaagaaaagtagcaggatgagcctcagacaaaacctctcagacactgagttgcagaaggaagggctttattcagctgggagcatcggcaagctactgccttaaaatctgagctcccctaatgcacaatttctgtcctttttaagggctcacaacactaaggatttcacatgaaacggtcgtgattgatttgagcaagcagtgggtatgtgacaggggctgcatgcaccggtgttcagagtggaaaagaacagagcagggagtttcacaatgttcttctatacaatgtctggaatctatgaataacatcagtttctaagttatgagttgatttttaactactgggtttaggccaggcaggcccaggcctggtttcaggcctggcgccgggctgcctgtctttgatttcacttccttgtttttttcctaaaacaggtactgagtataaaacaatataaaacaatatgagagggtctctctcttccctcaaaactactaaataaattcagtggatttgcacaatacaatatcggcaccaaaaattacttgaatttccacacattaacaataaacaattttaaaagaaaatttaaaaacacttccatttgctagagaacttaaagtaagaaatacttaggaataaacgtacaaagctgagaagtttgtaccttgaaatctataaatgttgatcaaaatgattaaaaacatacatagagatacaacccatattgatagtttggaaaaattaatattgttaagtaattatataacccaatgtgatttagattcaacacggtacccataaaaatgcctatcagttgacattccaccacaaaagaagtgaaattggctggtccctgccttaactgatgacattaccttgtgaaattccttctcctggctcatcctggctcaaaaactcccccactgagcaccttgtgacccccacctctgccagccagagaacaaccccctttgattgtaactttccactacctacccaaatcctataaaacggccccaccccatctcccttccctgactctcttttcggactcagcttgcctgcacccaggtgattaaaaaaaaaaaaaatctgtatctgtttttgttaaagaaacaaaaaacaggctgggaaaagtggctcacgcctgttggccacactagtctcaaactcctgacctcaagagatccacccaccttggcctcccacagtgctagcattacaggtgtgagccaccgcactcagcctaatcctcttaacataaacactttaatgtcaattaatgcttgaactcaacgttaagtcaactcaaactcaagtcaatgctgaactgactctagtgtcaattaatgcttgatggtttgctatactcattgcattcggaactattatctcaaaaataaattttctgatattctgcaaggagtgatctcagactgaagaccttgccacactgatgacatttgtaagatttctgtccagtatggattctttgatgtctaatgaggtgtgaacgtgaagtaaaggctttgctcacaatcatcacacttgtgaggtttctctcctgtatgaattctcctgttttgcataggatgaagcttgactgaagaccttgcctcaatcatgacatttgtaaggtttctctccagtatgagttcacccatgaactacagcgtatgaacgatgtctgaaaaatttgccacatttactacacttgtaagatctctattcattatggattcttcaatgatttgcaatggttgtagcgttactgaagacttggtgacaatcattacattagtcaagtttccctacaccatggattgcctgatggtgaataagtgttgactgtgcacgaaaggctttgccacactcactacacttgaaaggtttctctccagtatgaattctagtatgttgtgccaggtgtgagtaacacttgaaagccttgtcacaaaccttacatttgtatggtttctctccagtgtgaactctctgatgttgtgcaaggtatgaatcacgcccaaaagccttgtcgcaaaccctacatttgtatggtttctctccagtatgaactctcctatgtatttcaaggtgtgatttgatattgaaaactttgtcacattcttcacatttgtaaggtttctctccagtatgaagtctatgatgacatgcaagttgtgactgtgtcctaaaaaccttgccacattcattacacttgtaaggtttctctccagtatgaagtctatgatgatatgcaaggcttgatttgtgattaaaacttttgccacattcattacacttgtaacgtttctctccagtatgaatgaccttatgcattacaagagatgaattttgaacgaaggtcttgccacactcattacacttgtaaggtttctctccagtgtgaattacagtatgttgtgccaggtgtgaatcacgtctgaaagccttgtcacaaaccttacatttgtatggtttctcaccagtgtgaattctcctatgtctttcaaggtgtgatttgcgactgaaaactttgtcacattctttacatttgtaaggtttctctccagtatgaagtctatgatgacgtgcaaggtttgattgttgattgaaaaccttgccacattcattacacttgtaaggtttctctccagtatgaattgtcttgtgaactaagagggctgaattttcaccaaacgttttgccacactcattacacttgtaaggtttctctctagtgtgaattacaatatgctgtgccaggtgtgaatcatgtctgaaagccttgtcacaaaccttacatttgtatggtttctcaccagtgtgaattctcctatgtctttcaaggtatgatttgcgactgaaaactttgtcacattctttacattggtaaggtttctctccagtatgaactctatgatgacgtgcaaggtttgattgttgattaaaaaccttgccacattcattacacttgtaaggtttctctccagtatgaattgtcttgtgaactaagagggctgacttgtcactgaacgtcttgccacactcattacacttgtaaggtttttctccagtatgacgtctataatgacgtgcaaggtatgcttttttattaaaaaccttgccacatttattacacatgtaaggtttctcaccagtgtgacatctacgatggtgtgcaaggtatcgcttctgattaaagtctttgccacatacatcacatttatattgtttctctcctagatgaattatctgatgttttttaaagagtgagctacaattaaaggatttgccactctcattaaattggaaagatttttctttcctgtgtacatcctgtttctgtgtgagtaatgaagaatggaagaaattattcccatagttattagaaatatgggttttgggcctacaagaaattctttgggatgttgaaactgaggaagcattgttgatagacttctcaagttgattaccaattttcccttcgggctgaaatatgtgcagttcaggcagatgtgaatgaaagcttgatccaagctgatatttaataggcttgtttccagcatgcctttgatcatattggtctgtactacccgtcaactctttgatttctgtcatgggtgcttcatggccatttgtttcatcttcttgccactgaaacacaaagtcatgaatgtctttctcaatttcctggaagcaacattctccaatgtgatgacttgccagtctttgcaatgtccctgtgtggatcacttctgtattgcctttccctattgatgagaactccatcatgcatttggaagagatatctacaaaatataaacgccaatagttttccaattcagtacagataatatataatactgaaacgtgtaaatatgacaccaaaaacaatacttattttaaacatctcaaacatgagcttcaaagttcaggaacacaaaaggaggaagatcctttaataaatgaagggcgattacatgtacttcagatcatttctatggaagcctatttctaatatcatgacaaaacactgacagggcacaaacatgtgtaagcctaaagtaaggagtatttttccattgtgaccttaaagtgtgtcacagtttgcaaaaaatttatcactgtaacaacaaaaagaagaaaatatatattcttcatatttacagcatatttactgtatagaaataaatgctaaaggaccggacaatgtactatattggtaaataatcaacaacaagctcttgtaaggataaccaaaatcaatggaaatcctgtactgtcaaaccatcacagcacagagaagataataaaagattacaaaaattagccaggtgttgtggcccgtgcctgtaatcccaggtactcgggaggctgaggcacaagaatcactttaagccaagaggcaaaggttgcagtgagccaacatcgcaccactgcaccacagcctgggtgacaaagtgagactcgagtcaaaaaaaaaaaaaaaaaaaaggcagggcttggtggcccacaccagtaatcccactactttgggaggccgaggcaggtggatctcctcagatcaggagtatgaccagcctggccatcgtggcaaaaccccgtctctactaaaaatacaaaaagtagccgggcgtggtcgcgggagcctgtaatcccagctacttgggaggctgaggcaggagaattgcttgaacccgggaggcgaagatagtggtaaactgagatcgcaccactgcactccagcctgagcaaaaaagtgagactccatctcaaaaaaaaaagaaaatgttaataccatatttttctgaataactgttacaaaattacctatatccatgtggaacaggcgctttgtaactttttaaaaaaaatttttgtatttttttttttttgagatggagtctcgctctgtcacccaggctggagtgcagtggcacaatctgggctcactgtaacctcaacctcctgggttcaagcgagtgtcttgcctcagcctcttgagtacctgggattacaggcacacaccaccatgcccagctaatttttaaatttttagtagagatggggtttcaccacgttggcaaggctcgtctcgaactcctgacctcaggtgacccacatgtctcagcctcctaaatcctgggattacaggcatgagccactgcgcccgggggcacttttgacattaatgagtggaatctctcagttatattgcataccacgtaccaaaaactcacatgtaaaatcataaaatcaattaataaaatatattattaattcattaatcaaataataaaatactgtaacccatgataaaacaagcaagaaaataagtagatttatactgcctgcagaattctaaacaattccctcttaagaaaaaaaccacaacttgttcttaccaccagtacacaacataagaacagaaatacatgttaagatcactaccttctaatatatgaggtcaagaaaatacacagcattataaggaataagaattgactatggccaggcatggtggctcatgcctgtaatcccaggactttgggaggccaaggcgggtggatcacccaaggtcaggagttctagaacagcctggccaacatggtgaaaccccgtctcaactaaaaatacaaaaattagccgggcgtgtaatccccactacttgggggacccgaggcaggagaatcactcgaccctggaaagcggaggttgcagtgagcatagactgcaccatcgcactccaaccttggggactagagcgagacttcgtctcaaaaaaaaaaaaaaaaaaaaaaaaaaaagaactgaataacaccagggcgcggtggtgcatgcctgtaatcccagcacttttggaggctgaggcaggtggatcatgaggtcataagttcaagaccagcctggacaacatggtgaaaccccatctctactaaaaatacaaaaaaaattagctatgcatggtggcgggtgcctttaatcccagctacttgggaggctgaagcaggaatcatttgaacctgggaggcggaggatgcagtgagccgagaccatgctactgcactccagcctgggtgagagaatgcgactacatctcaaaaaaataagataaataactacttctcaaataagctttggtagatgtggtattctctaataggatgttgctgcagatgcagacttggagagaatttagccatgggtgttgactacctgtgaatactaaaagtgcatttataaagagacattaaagagctcattgcctgttcctctttccaccatgttaggacatggcaggaagatggctgggctaaaccatgaagaagcctctcaccaggaacttatttggctggcaccttgctcttggatttctcccttcccaaattcatgaaaaataaatttctgtctcttaagcctcccagtgtaagctatttcctcttttgtctttgagattgagtcatgctctatcacccaggctcaagtgtagtggcatgattctcctacctcaagtgattctccctcctcagcccagagtctcactctgtcacccgggctggagtgcagtggggtgatcttagctcactgcaacctccacctcctgggttcaagtgattctcctgcttcaacctcccaagtctgggattacaggtgcacagcaccatgaacagctaatttttgtacttttagtagacacgggatttcaccatgttggccaggcttgtctcgaactcctgacctcaagtgattggcccgtctcagcctcccaaagtgctggaattacaggtgtgagcaattgcacctggcccatttttggcatttagtatatttgaggtttcaccatgttgtacagactggtctcaaactcctgacctcaagcaatctgcccaccttggtctccgaaagtgctgggattagaggagtgagccaccacagccagcagtctaagctatttctttttgttttcttttcttttttttttttttgagacggagtcttgctctgtcgcccaggctggagtgcagtggcatgatctcagctcactgcaacctccatctcccgggttcacgccattctcctgcctcagcctcctgagtagctgggaccacaggcgcccgccactatgcccagctaattttttgtatttttagtagagacggggtttcaccatgtcagccaggatggtctcgatctcctgacctcgtgatcctcccaccttggcctcccaaagtgctgggattacaggcgtgagccaccgtgcccagcatcagtctaagctatttctaacaggacagtgaaatgacagaaacaggaaaaagagcatcttatcatcaacatcaccgaaggctgacaaatcttattaaacaaaggaagttaagagcctgtgctgtaagacttgcaataaatgaagtcatctaatagcagtaacatattttattttattttatttatttttatttttttaagatggagtctcactctgtcgcccaggctggagtacagtggtgcaatctcagctcactgcaagctctgcctcttgggttcaggccattctcctgcctcagcctcccaggttgctgggactacaggcacccgccaccacaccctaattttttgtatttttagtagagaaggggtttcaccgtgttagtcaggatggtcgcgatctcctgacctcgtgatccacccgcctcggcctcccaaagtgctgggctcacaggagtgagccactgtgcccggcctttatttttatttttttttgagacggaatcttgctctgtcacccaggctggagtgtcgtggcaagatctcggctcactgcaagctccgcctcccgggttagcgccattctcctgcctcagcctcccgagtagctgggactacaggcacctgccaccgcgcccggctaattttttgtatttttagtagagatggggtttcaccatgttagccaggatggcctctatctcctgacctcgtgatccgcccccctcggcctcccaaagtgctgggattacaggcatgagccaccgtgcctggccagcaataacatattttaaatacattgagacaggccgggcacggtgtctcatgccagtaatcccagtattttgggaggctgaggtgggaggatcacgtggtcaggagattgagacagtcctggctaacaagctgaaaccccatctctactaaaaaaaaaaaaaaaaaaattagcccagcatgttggcagtcacctgcagtcccagctacttgagaggctgagacaggagaatcgcttgaacctgggaggtggaggttgcagtgggccgagatcacaccactgcactttagcctgggtgacagactgagactctgtctcaaagaaaataaaaataaatgaaagaaggctaaagagtaactccaacccagaagcatatacaaagttctccagtaaaggtaaattaaaaaacagataggccggacatggtgactcatgcctgtaatcccagcactttgggaggatgagccaggcagatcaactgaggtcgggagtttgagaccaccctaacctacaaggagaaaccctgtctctactaaaaatacaaaattagccgggtgtggcgatgcatgcctgtaatcccagctactccggaggctgaggcaggagaattgcttgaacccgggagatggaggttgtagtgagccaagatcgcaacattacatttcagcctaagtgatgagagcaaaattatgtctcataaacacataaattaattaataaaaggacagatacagaaactggcatatgtgtaccttttcttcataactaaacttttttcatattatttaaaagtcatgaaaaaacactgtaaatatatgttaatgaaaatgcaacatatacagaaataattctggcataaatttaaaaagttctactggagaagaagtagtttttgcaggttatggattcttttttttttttttttttttttgagatggagtctcactctgtcacccagcctggagtgcaatggtgcgatcctggctcactgcaacatccacctcccaggttcaagtgactctcctggatcagcctcctgagtagctgggattacagctgcccaccacagtgcctggctaagttttgtaattatactacagatgaagtttcagcatgttagctagccgggttctgaactgacctcaggtgatccgcccccggctcagcctcccaaagtcctgggattataggcgtgagccactgtacccggccaggttacagaaattttaagtttcattattatactataagtttaagatgtttaacatacctgcaacaataacctctgcccatatatctatacgacacacttcacttctgcgtactgaaaggaatggacactaacgtggttgttatattcacactggaatcatgcttaaaccacttatatgtttactaagaactaaaagacaaaactatttaaaataataacggttgggcatggtggctcacgcctgtaatcccagccctttgggaagctgaggcaggtgaatcacttgagataaggagtttgagaccagcctggccaacatggtgaaaccccatctctactaaaaacacaaagttagttgggcatggtggtgagagcctgcagtcccagctacccagaaagctggggcacaagaatcctttgagcccaaaaggcggaggctgcaattagccaaaattgcaccactgcactgtagccttggcgacagagtgagactctgtcataagaaaagaaagagcagagagataagtgagggcaaagaaagatgtcctttcaaagatctcaggattgaaactttcctttacccacagaattctcccacttgcagagagtttccccacacactatttgaaggtggagcttccactctgcccatctgagctcttacctgcgtttacacctgtaatatattcccacccatctggacttttttgctattttcacttcactctccacagtccagggctctttcccttgctccaacatggagataacaggtcagagactcctacttataaaaagaaaggaccatgaagtgctggagcttttctagagtcccagccctatgtttcagtaggaaagaagacattgcagatagatctaggaaaatatttctcaaattcctccactgactgcctcattctgaatgcttggggagcactgtaatatgtagtatgtggacatcgagctctcttccaagaactacagaatcgaaagcacaggagaagcaaacagggaactggatatctttaaactctgcagtaaggttttgtttttgttttttgagacagagtcttgctctgccatctgggctggagtgcagtggtgtgttctcggctcactagaaccttcacctcccgggtttgagtgattctctttcctcagcctttctaggagctaggattacaggtgtgtgccaccatccctggctaatttttgtatttttagtagagactgagtttctccatgttggccaggctggtctccaactcctgatctaaagtgatccacatacctcccaaggtgctgggatgacaggcgtgagccaccatgcccagcctgccataaagttttatgcctactttagtcctggaacccacattgaggtatcatgaagaatgcagaacatctaaacaaaggggacagtgaaagtccagatgctacatcatgaagcttttcatttcaaaatcaatacagcttccattttagtcaagcaaggatgcaactcccaagagaaacaagagaaaatgcaaagatccacaagggaacatccccaggaaggaagttatcctcacccagggagaccaggttcctataattctccagcatcacgtctctgtatagagtcctctgagcagggtccaggcatttccactcctcctgagagaattctatggccacatccctgaatgtcaatagaccctgaaatgaaaacacattttaaccaaatggttatgagaggagatcttatctttacagaaaatgagaagaagagaggggaaagcatggatttaattgtagtgaatgttctgacaaatccgagtaagggattcttcaccacatgatgtattttttttcttctttttctgtttgagatggagtgtcgccctgtcgcccaggctggagtgcagtggcatgatctcggctcactgcaagctctacctcacaggttcatgccattctcctccctcagcctcccaagtagatagtactacaggcatctgccaccatgcctggctaatttttttgtatttttagtagagatggggtttcaccatgttggccaggatggtctcgatctcctgacctcgtgatctgcccacctcggcctcccaaagttctgggattacaggcatgagccaccatacccggcctcacatgacgtctttattatactttttgaagaggtcaagacaccctgtcagtatgaatttcttatgtttgtaaaaaatataagaaataaataaaaaatcagtgcagggttcctgctatagaaatgtttgaaacttttatggacacaccaagtgacattcagtatctcgaagagacagagcatgagtgatgtcttcacagatgacaacgtccacagtaaaagatcagccaggtgcagtgacacatgcctgtagtcccagctatgtgggaggctgaggcaggagaatggcttgatcccaggaggcagaggttgcagtgatcccagatcacgtcactgcactccagcctgggcaacggaaactaggtctcaaaattaaaaataaaaaatcagccgggcatggtggcaggcacctgtggttccaattactttgaaggctgaggtgggaggatggcttgaccctgagggtagaggttgcagtgagctacgatcatgccagggtgctccagcctgggcaacaaagtgagaccccgtctcaaaataaaataaaatacatgaaaacaaacttactcaaagtacaaaatccattttttaaatgttcacaaaataataaaacctacacagactcacaaaaaactagatgttaatacaaagggttgtcatttgtcccagattttcaaaatataaaagattttcaaaatatatatgtgtgtgtacatatatatgtgtatgtacatgtgtgtgtgtacctatatatgtgtgtgtatatgtgtggggatgtgtgtatatatattatatacatacatacacatatatatgtattatatacatacatatacatatacatatatatatatatatatatatatataggttttaaatatataaaaagtagcaagttttgtttaagtgaagaggaatctcaccttggcggaaaaggacacattgacaactgggggctggggggaatcttgtcagatctaagaaaacaggaaatgccccatcctagaggaagcaatcaccctttcaactgcctggcctggaggatgaagaatcacttgaacccgggaggcaaagtttgcagtaagccaagatcatgccactgcactccagcctgggtgacagagcaagactccgtttcagaaacaaacaacagaaataataataataggtggaatgagaatatagctttatcctctagaataaaaaaaaagtactgctcccatatttgagaaaaattgtaatcatttttaccaaaagcctgtttcacgagcctctccatagtaacaccactgtctccatgagcgtaatatgctaagaatggttgaatgaatctcctgctattatttatgttgattccatattcttaacataatgatggaatcattcatgtatcattcatttccattatatttatttatttatttaagacagagttttgctcttgttacctgggctggagtgcaatggtgcaatctcaggtcactgcaacctccgcctcccgatttcaagtcattcttctgcctcagtctcctgagtagcagggattgcaggcacacaccaccatgcccagctaattttgtatttttgctagagacagggtttctccatgttggtcagactcactcaattacctaaaaatgtagtttaatatcaggcagaaaacatttcctcttatcggtcttttctagaatttaccatgttctttgtgcacattaatatgtgacttccattggcagctactctaatcttggtccacagaaaactgacagtgcatccagatgcggccctgaacaatccctgccgcccaacaccactgacaccataggaccctcaccccgtctccatccatgtctgtgtgtgagcccttcccaggaccatgcctactgcaacctcttctcatgttcatgtcattgggtcacgagagatggaatctaggtgagatgagagggactgagggaaggcatgggtgagtgtgagcaaacctgtcacgcaggatgcttcagactcagagaagtttcccaactccaaggcccagcatttctgaaaggaaggagacagaacaatccacagagaatatcatctcacctgaggaagagccatccctgactcctttgctttcctcttcctcttctgagtttcttcttcacatacccagagtctttagaagtcaatcatgaatgttagaaatatgttgtttattgctcagagtcaacataccccctccctgtaaaacaacgacacatacaaaggagacctcaccctgggaaatatggtccactctgctgcccaccataccagggacaataaactcctataggaaaactcccactccccttctggagaagcccacacacacgctgcagcagtagggatctgggctggaatgagctccccttcaaggcacagacccagacctgaccaaaccacttgcagaggctgggtgcggtggctcatgcctatcatcccagcactctcggagaccaaggtaggtacattgcttgagctcagaagtttgagaccagcctgggcaacatggtgaaactccttctctatcaaaaatacaaatacttagccaggtatggtggtgcacatctgtgtttctgtcaccccagctacttaggaagctgaggtggaaggatcacttgaggtcaggagtttgagaccagcctggcaaacatggtgaaaccctgtctgtaccaaaaatataaaaattgggtcaggtgcaatggctgaagcctgtaatactagcactctggaaggccaaggtgggtggattacttgaggtcagcgttcaagaccatcctggccaacgtggtgaaacctcatctctactaaaaatacaaaaagtagccaggctttgtgggcatctgtaatcccagctacccaggaggctgaggttggaggatcacttgaacctgggatgtgaaggttgcagtgagccaagatcacaccattgcactccagcgtgagtgacagaataagactctaaaataaaataaaatacaaatacaaatacaaaaattagccatgtgtcgtggcacacacctgtaatctcagctacttgggaggttgaggcacaagaatcacttgaacccaggagacagaggttgcagtgagccaagatcatgacagtgcactcacagcctggaggacagagtgagactctgtttgaaaaaaaaaaaaaatctccctctccctccccctccctctccctctccctctccctctccctctccctctccctctccctctccctctccctctccctctccctctccctctccctctccctctccctctccctctccctctccctctccctctccctctccctctccctctccctctccctctccctctccctctccctctccctctccctctccctctccctcctctcgctctccctctccctctccctccacggtctccctctgatgccgagccaaggctggactatactgctgccatctcggctcactgcaacctccctgcctgattctcctgcctcagcctgccgagcgcctgcgattgcgggcgcgcgccgccacgcctgactggttttcatgttttttttggtggagacggggtttcgctgtgttggccgggctggtctccagctcctaaccgccagcctcggcctcccgaggtgccgggattgcagacggagtctcgttcactcagtgctcaatggtgcccaggctggagtgcagtggcgtgatctccgctcgctacaacctccacctcccagccgcctgccttggccccccaaagtgccgagattgcaggctctgcccagccgccaccccatctgggaagtgaggagcgtctctgcctggctgcccagtctggaaagtgaggagcgtctctgcccggccgccatcccatctaggaagcgaggagcgcctcttccccgccgccatcccatctaggaagtgaggagtgtctctgcccggccacccatcgtctgagatgtggggagcacctctgccccgccgccctgtctgggatgtgaggagcgcctctgctgggccgcaaccctgtctgggaggtgaggagcgtctctgcccggccgccccgtctgagaagtgaggaaaccctctgcctggcaaccgccccgtctgagaagtgaggagcccctccgtccggcagccaccccgtctgggaagtgaggagcccctctgcccggccagccgccccgtccgggaggtgaggggcgcctctgcccggccgcccctactgggaagtgaggacccctctgcccggccagccgccccgtccgggagggaggttggggggtcagccccccgcccggccagccgccctatccaggaggtgaggggcgcctctgcccggccgcccctactgggaagtgaggagcccctctgcccggccacgaccccgtctgggacgtgtgcccagcggctcattggggatgggccatgatgacaatggaggttttgtggaatagaaaggcgggaaaggtggggaaaaaattgagaggccgggtggttgccgggtctgtgtggatggaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcaaaaaaaaaaaaaaaaaaaaaaaaaaagaaaaaaaaagaaaaggaaaaaaaaaaaaaaaaggaattatttgtcacttactgtctctctaagggcagccattgtaagacctcaaagaaactttagcctccacaatcttttctcttaacctgaacatttcctttctatggatcccaggtttttagacaaactcaaccaattgtcaaccagaaaatgtttaaatttacctatagcctggaggcctgcccaccacccctttgagttgtctcgcccttctggaccaaacaatgtctttctttaatgtatttgattgatgtctcctgtctccctaaaatgtataaaaccaagctgcgccccgaccaccttgggcatgtgttcctgggaccccctgaggctgtgtcacaggtcagggtcactcatgtttggctcagaataaatctcttcaaatattaaaaaaaaaaaaaaaaaaaaaaaaaaaaaatcttcatttctgatgtggttgatgcagagataataaacctgagtaacgtgatagagactgatgggcagagggaacttcagatggcagtgggaggacatgggagatatctctgagcctagatctgaaggaggagaaagggacagggctgtcaccatttagggacataggataagagcaggacaatgacctgagacaggaagtattttgatatctgggaaaagagaaaagcaaatgtgactggggcagagggattcatgagatgggggcaagctcccaggaggaggctggacactggcaggggccctggacacagggctgtggagccacagtgaggagatgggcttttgtcctggggaacacaggaagccagtggagggttccctgccagggaatgacatgacttactttagatttagctgtgatgtcctcacagtgaaaacattttcaccgagttaccctgagaaggtctgagatgagtaagaagatgtgcctgaattcttacatgggggcctggaagggctaatgggaagggttggtctttatcaccccatccttgaaaattagagaagcatctttcacatacctgggctaaagaaacttcttttgcaaggttctgatgccattaattcctaacatttaatttttccttacaagaaaattacagtaacatttacaaaatgcaaaagtgtaaacacacagctattgaccttgaaaatagggaggccgaggtaggtggatcacctgagttcagcaattgtagaccagcctgacctacatggaggaaccccgtttctactgaaaatacaaaaattatccaggcatggtggcgaatggctgtaatcccagctactcagcaaggctgaggcaggagaatcacttgaaccagggaggtggcgattgcagtgagccaagatcgtgccattgcacttcagcctgggcaacaagagcaaaactgcatctcataaaagaaaagaaagaaagaaagaaagaaaagaaaacagggaaagagagtcagctgttgaactaagacagaagtaacttttttcattcaagaatacataggtggccaggtgtgatggctcacacctgtattcccagcactttgggaggtcgaggcaggtggatcacctgaagtcaggagtttgagaccagcctggccaacatggtgaaatcctgtctctactaaaaatacaaaaattagctggactccatccacagcttatttaacctcttgttgctccttttccccaatctttagattgttctcaatgtccatagatttccacctcttctcccatctctcctgagctctccctgttaaattctctcttccccgttatacccccctggccccactctctggcaccccagatttcccaggtgtcctccctgctgtggttctccctctgttctccttgccaccagcaccactctgctctgtctgccctggctccaaatccctcctcctctccctcattctcatgagcctttctgtttgctgcccctctccctaccttgctgtctgtccttcatctctctgtacatccagcttttctctacatttctccagttgcttttctcctcctgctttgttatcttttgttttttcacttttgctgtctcttggcaaatccctgaccatcccctactttgccatctgttatgggtctttctccttcttcttttatctgtctcaggttttctactgctctctgattccctctctctgtctcctgatccctttggcccacacaatcacaggagggtttggagtaagacgcctgcatcccagagaagcgcattttccaggggctggagctgggcaggcaagaacaccccgtgtcacaggacaggccccgggtacctccccaacgcgggctcagggaaagcggtgactgcggaggggagacttggggagcaacagggcccggcatgaggagggaggtgggggggagatgacgccttcggacaagggtggggtccgcaggatcccaccaccgggcagagaacgcggcctccctgggactgtggtgtcagcgctgggctccaggggccgacgagggtgaggctgggaagcgccagagcagggatccacctctcgggtgaggactttaaaaagcgcggggtgggaggagtcaacaaacggttgtgaacgggaaaactacgcgatacaaactgtatacattgccctatagcaaaaagaccgaggacagggcagcctcagggcgactttaaacccaaaaggaagtgacttccggactcctaggggaatgtctccatttgctcttgttgaaggaagaagggcgagaatttccaggtctgtggagaccccacatcccaggtacagaattgccggggacctggaggcacagcctcaatacaacacagagcaaaactcaccgccgcagtgtgacttccagtccacgcgatccgcttcctggtccgggcgaatctacaagcacaggacagaagccaggcctccgtggagccaacgaggtgggcggggcctgggcgaggtaggggcggggcctgggcgaggtaggggcggggcgccaggcggagagacctgccctgtagaaccggcagacgcggggcgggggcggatctgtgcttctctcagccgcgtacctagccgctgtttttcgggttttggtgagggaagagacagaccctctcatattgttttatattgttttatactcagtacctgttttaagaaaaaaaacaacaaggaagtaaaaccgaagacaggcagccctgcgccacgcccaaaaccaggcctgggcctgcctggcctaaacccaatagttaaaaatcaactcataacttagaaaccaatgtttttcatagattccagacattgtatagaagaacattatgaaactccctgccctgttctgtttctctctaccagtgcacgaaacccctgtgtatatatctgggactgtagtccctgttacgtatcccctagattgctcaatcacgacccttttatgtgaaatctttagtgttgtgagcccttaaaagggacagaaattgtgcacccggggagctcggattttaaggcagcttgccgatgctcccagctgaataaagcccttccttctacaactcggtgtctgagaggttttgtctgtggctcgtcctgctacaccggaggcaagagtggccaggaaggctgaggcatgattcaaaagccctggaattgtctggaacagggatgcaaactagaacgtgaaatgcaaagccctgcctaggcagaaagtacgatctcatgctgatggtacacagaacagaatagaaatctctccctttctattctccatttgcttcggagggagagtccaccctgtgctcagcttcagagacttccctagggccaccgcctgggatgccggagggagtgttcaggccagggaggagtgaggtcaccacctgctacttaaacacagcagaaatgtggaagtgggggcgggagcctgaggtccagctactcaggaagcagtggcgggaggatcattgagcccggaggtccaagccagcctgagtgacaaagtaacaccccctgccgcagggatcccttcctcatctcttttttttttaatttttaaaataaaattttcattgtgtgagatagggatccaactttattcttttccatgtggatatccagttagttgtcccagcacaattgtggatgacatctattagtttcttttttttatttacttttttttctttttcttttttttttttgagacagagtatttctctgtcacccaggctggagtgcattggcaagatctcggctcactgcagcctctgccttctgggttgaagcaattcttctgactcagcctgcatagtagctggtattacaggcacgtgccatcatgcccggctaatttttgttcttttggtagagacagggtttcaccatgttggccaggctggtctcaaactcctgacttcaagtgatccgcctgcctcggccttccgaagtgctgggattacaggcgtgagtcaccgtgccgggcccaagaaatactctttacttcactttttaaatgttgagaaaatacaattgaaaactaaaaaatcttccccagatgaaaaatcatcttcactatgataacagagaaggaaataacaaccattttattaataaagagccttagacctgaatgtaatgggaaatagaggcaaacagttgagaggttgaaaacagagagagaaacttcactgttctatacaacccattaagtacatgttttcttttgtcttttttctttcttttttttggagacaagagtctcactctgttgcccaggctagagtgcagtggcaagatctcagcttactgcagcctccacctcctgggttcaagcaattctcctgtctcatcctcctgaatagctggaactacaggcgtctgctaccatgctgggctaatttttgtatttttagtagagacggagtttgacctttttggtcaggctggtctcaaactcctgacctcaggtgatccacctacctcagcctcccaaagtgctgggattacaggcgtgagccaccgcgcccagcctaagtacatgttttcaagataaacactaatcagtcctcagggaagaggacttgacaatacccttggtcacacatagttcatcctggctctacttggtaatggaggtgaccatttgtgtcagctaattagcttcatcctgaggaaggggggaaaacgctaacccatgtctttttgacaagtgtgagttttacaacatggcgacaggtgccatctctagtgaggctcctacaatccgacagaaaccgacatcagcagtaaataataaaatttagaatacatgattaagtatagagtttatgtgaacacaaaacttgaggatagccacctggaaacatcaactccaaatgaagggggtctgtgttcccaagtagagatgttaaggtttcacacacagggaaagacagagaagctttaccagaatcaacacattttccattcaagaccagtggataagttgcagcaacttgactggtgatggattgatacagttcaagaaaggttactttatcactacataagaagggacaatcggccaggtgcggtggctcacgcctgtaatcccagcactttgggaggtgaggcgggcagatcacaaggtcaggagatcgagaccatcctggctaacacagtgaaacccatctctactaaaaatacaaaaaattagccgcgtgtggtcatgggcgtctgtagtaccagctacttgggaggctgaggcaggagaatggggtgaacccaggaggcggagcttgcagtgagctgagattgcacccctgcactccagcctgggtgacagagagagactccgtctcaaaaaaaaaaaaaaagaaaaaagagggacaatgatgtcaagaggtcttgtctctggggctgctcagtcttcctaattatctacaggaaaacttttgtgtttttttcttttctttttttttttgagacagagtttcgctcttgttgcccaggctggagtgctatggcactatctcggctcaccacagcctccgcctcccaggttcaagcaattctcctgcctcagcctcccgagtagctaagattacaggcatgcatcactacgcctggctaattttgtatttttaatagagacggggtttctccatgttgaggctggtctcgaactcctgacctcaggtgatctgcccacctcagcctcccaaagtgctgggattacaggcgtgagccaccgcgcccggccctctttttttatttttttgagacagtctcgctctgtcacccaggttggagtgcagtggtgtgatcttggctcactgcaacctccgcctcctgggttcaagcaattcttctgcctctgcctcctgagtagctgggactacaggtgcacaccaccatgcctggctaatttttggtatttttagtagagacgggggtctcaccgtgttagccaggatggtctccatctcctgacttcgtgatgctcccgccttggcctcccaaaatgctgggattacaggtgtgagcctctttgcctggccaaaacttttcttttttaaattgatattaggaaactgaattatatagcttttttttttttttttttttttttttggtacggagtcttgctctgttgcccaggctggggtgcagtggcatgatcttggcccactgcaacttccacctccccggatcaagcagttctcctgcctcagcctcccaagtagctgggaatacaggcgtgccccaccatgccctgtaatggctttgtatgtttactggagacggggtttcaccacgttggccaggctggtttctaactcctgacctcaagtgatccgcccacctcggcctcccaaaatgctgggattacaggcttgagccactgcgcctggccaggaaaactcaaaaaagttgcgcctgcggctgggcgcggtcattcatgcctgtaatcccagcactttgggaggctgaggtgggtggatcacaaggtcaggagatcaagaccatcctggctaacacagtgaaaccctgtctgtactaaaaatacaaaaaattagccgggagtggtggtgggtgcctggagtcccagctactggggaggctgagacaggaaaatgacgtgaacccaggaggcggagcttgcagtgagctgagatcgcaccactgcacttcagcttgggcgacagagcgagactgtctcaaaaaaaaacaaaaaacaaaaaagaaaaaaccttgtgcctgcatgccactggactcttgttgcatgaccacgttcctctcaaggctcagaattatttaaaggtcggtagcttttaatttgaaacatttgatgtttgaattatttaatttcctactaagatacaggtactatctcccttgtttgccttaaaaggatcgctcccaagtccttcagaaatacatccctgggtcattaaactgaaaaaaggtttagttactttctaaaaaataccacttcaggccggacgcgtggctcaagcctgtaaatccagcgttttggaaggccgaggcgggtggatgacctgaggtcaagggttcaagaccagcctgaccaatatggagaaaccccatctccactataaatacaaaaattaaccaggcgtggtggcatgcacctgtagtcccagctacttgggaggctgaggcaagagaaacgcttgagcccaacagacagagggtgcagtgagccaagattgcaccattgcactccagcctgggcaataagagtgaaactccgtctcaaaaacaaaaaattaataacaataataaataaggccagtgcagaggctcgctcaggtgagactccgtcttaaaaaaaaaaaaaaaagaaagaacactaccacttacacagtagggcattctcaaaaacaagggcaacgccacctcttttaagttttgtctttcaagatgtgatttgcgactgaaaactttttcacattcttcacatttgtaaggcttctctctagtatgaagtctatgatgacgtgcaaggtgtgctttctgattaaaaaccttgccacattcattacacttgcaaggattctctccagtatgaattgccttatgaattacaagggctgaatttcaaccaaaggtcttgttatgctcactacacttgtaaggtttccctccagtatgaagtctacgatagcatgtaaaggatgacgtctgactgaaggtcttgccacactcataacaactgtaaggtttcttaccagtgtgacatctattatggcatacaaggaatcaattctgattaaagaccttgtcacatacctcacatttatattgtttctatcctaaatggattatctgatatttccttaagagttagctataattaaaggatttgccactctcattacattggaaagatttttctctcatgtgtacttcccaatttttgtatgggtaatgaagaatggagggaattattcccatagttattagaaatacgggttttgggactacaagaaattctttgggatgtcaaaattaaggaggcattgatgatagacttctcaacttgattaccaattttccattcaggctgaaatatgtggagttcaggcagatgcgaatgaaagctggatccaagctgatctttaataggcttgtttccagcatgcctttgatcatgtcggtctgtactaccagtcaactctttgatttctgtcatgggtgcttcgtgaccattcctttcctcttcttgccactgaaactcaaagttatgaatatctttctcaatttcctggaagcaaaaatctctaatgtgatgactttcatgtctttgcaatgtccctgtgtggatcacttctgtattgccttgcgctgtggatgagaactccttcatcatgcatttggaagagatatctacaaaatataaacaccaataggtttctaattaagtacagatgataaacaatactgaaatgtgtaaatatgaaccaaaaaaacaattcttattttaaactttccaaacatgagcttcaaagtttaggaacacaaaaggagtaagattctataacaaataaagggtgatagcatgtacttcaagtcatttctatggaagcctatttctaatatcatgacaaaacactgacagggcacaaacatgtgtaagcctaaagtatggagtgtttttccactgtgaccctaaagtgtatgagagtttgcaaaaaacatatcactgtctatgaaagaagaaaaaaatgtattcttcatacttacagcatatttactgtatacaaataaatgctgtaggaccatacaatatactatattggtaaataatccacaacaagctcatgtaaggataatcaaaatcaatggaaattctgtattgtcaaacaatcatagcactgagaagataacaaaagattacaaaacttagccttgtgtcatggccggcacctgtattcccagctactcaggaggctgaggcagaagaattgcttgaacctgggagggagaagttgcagtgagccgagatcgcaccactgcaattaagcctgggcgacaaagtcagactttgtttcaaaaaaaaaagaaaacaataaaagaaaatgttaatacaatatttttctagataaatatcataaaattacctttatccatgcagaacaggcactttgtgactttaaaaaaatttggtagttttatttttttgagacagagtcttgcactccaggctggagtgcaatggcaggatctcggctcactacaacctttgcctccacggttgaagtgattctcctgcctcagcctcctgagtagctgggattacaggcacacgccactatgcacagctaatttttgtatttttagcagagatggggtttcaccatgttggccaggcaagtctcaatctcctgacctcaagtaatccacacgccttggctccccaaagttctgggattacaggtgtgagcctctgtgcctggtggcactttgtgacattaacaagtggaatgtgtcagttatattgcataccagatacttaaaagccatatgtaaaatcagaaaaattaataatatattgtaacccatgataaaaccagcaagaaaataagtacatttatatagcctgcagaattgtaagcaattctctcttaagaaaaagtccacaatgtctacttaaccaccagcacaccatataagacctgaaatacatattaagatcactaccttctagaccaggcatggtggctcacgcctgtaatcccagcactttgggagaccgaggcaggcggatcacaaggtcaagagatcgagaccatcctggccaacatggtgaaatgccgtctctactaaaaatacaaaaattagctgggtgtggtggtgtgtgcctgtaatcccagctactcgggaggctgaggcaggagaatcacttaaacccgggaggtggaggttgcagagagccgagatcgcactactgcactccagcctggtgcagagcaagactccgtctcaaaaaaaaaaaaaagcccactaccctctgatgtaggaggtcaagaaaatacacaacaatgctgggcacggtggctcacacctgtaatcccagcactttgagaggccaagtcgggcagatcacgaggtcaggagatcgagaccatcttggctaacatggtgaaaccctgcctctactaaaaatacaaaacgttagctgggcgtggtggtgggcacctgtaggcccagctactcagaaagatgagacaggagaatggtgtgaacctgggaggttgcagtgagccgagatggcgccactgcactccagcctgggggacagagctagactctatctcaaaaaaaaaaaaaaaaaaaaaaaaagaaagaaagaaagaaaagaaaagaaaagaaaatacatagcattaaaaggaataagaattgactaacggccgggcacggtggctcacacctgtaatcccagcattttgggaggctgaggctggcggattatgaggtcaggagtttgagaccagcctggccaacatggggaaaccccatctctactaaaaacacaaaaaaatcagctgggcatggtggtgggcacctgtaatcccagctacttgggagactgaggcagttcttgtgggtggaggattacccgggtgccgaggcaagagactgaaggcacaaaccatttcagtataataaagaaaatagttagaataagaacaatcacaacacaaattagatacagagatgatcatggacaattatcaatcattattataaacagtataaatctttagcttttaatattactctttgtggcattactaatataacctaggaataactggcgggtatagggtcaggtgctgaagggacatggtgagaagtgacctagaaggcaagaggtgaggcctctgtcacacccgcataagggccgcttgaggggtccttggtcaagcggtaacgccagtgtctgggaaggcacctgttacttagctgaccgcgaaagggagtctcctttccttggaggagtcagggaacactctgctccaccagcttctcgtggaaggctggatattatccaggcctgcccgcagtcatcccgaggcctaaacccctccctgtggtgctgtgcttcaatggtcaagctccttgtccactttcatgctcctcccgtactcctggctcctctttgaagttcatagtagatagcggtagaagaaatagtgaaagtcttaaagtctttgatctttcttataagtgcatagaagaaaatgctgatgtatgctgccttctctctctgcttcggctacctaagagggaagggccccctgtcccgtgatcacgtgactttcttcaccttgtcaatcacttagaagattcaccctgcttaccctgcccccttgtcttgtatgcaataaataccagcgagcccagcctttctgggccactaccggtctcctcaacttgatggtagttgtctcccaagcccagctgttttctctttatctttttgtcttgtgtctttacttactacaatctcttgtctctgcacacggggtgaatacccgctaagccccatagtgctggaccctataagttctatatatatgcattgaagggggcctgaccctccacacctgtgggtatttctcatcaggtgggatgagagactcagaaaagaaagaagacacagagacaaagtatagagaaagaacagtgggcccaggggaccggcacactcaacatgcaaggacctgcatcggcgccagtctatgagtttcctcagtatttattgatcattatttttactattttagcgaggggagtgtagtaggggaacaagtggggagaaggtcagcagggaaacatgtgagcagaggaatctgtatcatgaataagttcaaggaaacatactgtgcctggatgtgcaattaggctagatttttgtttctcttcacccaaacatctcagtgtaggaaagagtaaaagagcagtattactgccagcatatctcgcctccagccatggggcgcttttctcctgtctcagaagagaacgaatgggaatggtcggctttacaccgtgacattccattcccacggatgagcaggagacagaagcctttctcccttttttttttttttttttgagatggagtctcgctctgtcgcccaggctggagtgcagtggcacgatctcaactcactgtaagctctgcctcccaggttcacgccattctcctgcctcagcctcccaagtagctgggactataggcacccgccaccacacttggctaattttttagatttttagtagagacggagtttcaccgtgttagccaggatggtctcggtctccttttcccgtgatctacccgccttggcctcccaaagtgctgggattacaggtgtgagccaccacacccagcctacagaagccttcctcttttctcaactgcaaagaggccttcctctttcactactcctcctcagcacagaccccttatgggtgtcaggctgggggatggtaaggtctttcctttcgcatgaggccatatctcaggctgtctcagtgaggggaaaccttggacaatacccaggctttcttgggcagaggtccctgcggctttccacagtacattgtgccccttgttaatcgagaatggagaatggcgatgacttttagcaggcatactgcctgcaaacatattgttaacaaggcacatcctgcagggcgctgtggctcatgcctgtaatcccggcactttgggaggccgaggcagacagatcacgaggtcacgatatcgagaccatcctggctaacacggtgaaacccgtctctactaaaaatacaaaacaaattagtccggcatggtggcgggcacctgtagtcccggctactcaggaggctgaggcaggagaatggcatgaacccaggaggtggagcttgcagtgagccaagattgtgccactgcaatccagtctgggagacagagcgagactccgtgtcaaaaattaaaaaataaaaaaaaataaaaaaaaaaaaaaacaaggcacatcatgcacagccctaaatccattaaaccttgattcagtacagcacttttctgtgagcacagggttggggctaaagttacagattaacagcatctcaaagcaaaacaatttttcttcatatggaccaaaatggaatttcttgtcttccttttctacatagacacagtaacaatctgatctctctttcttttccccacaatgcattgcccttatatagtttgctatgcataaaatgcaaaacatagaatgtgtactgggaaaatttataaactgagtcagagaaaactttgtagaaaacaaactgcacagcaaaaacaaaaaatatgatgcaggctatctggcctaaatgtttgtattggctaaaagtcattatcagatttcttattctccgataggatgttcctgcagatgaggccttttatagaatttggtcttctgtgttgactgttcatgaataggactaatgcttttatttttattttttctttatttactgatttttgagacggaattttgctcttgttgcccaggctggagtgcaatggcatgatcttggatcaccacgacctcggtctcctcagttcaagcgattctcctgcctcagcctcccgagcaactgggattacaggcatgcgccaccacgtccggctaattttgtagttttagtagaaacgtggtttctccatgttggtcagtctggtctcgaactcccgacctcaggtgatccggctgcctcggcctcccaaagtgctgggattacaggcaagagccacggcgcctggccaggactagtgcttttataaaaaagagacagtaaagtgttcattgcctgttcctctttacaccatgtcaggacacaggaggaagatggctggacgaaaccatgaagaaggatctcaccaggaaccaatctggttgaaatcttgctcttagattttccactttccagattcatgagaaataaatttctgtgtctgaagctttctagtttacactatttctttttttgtctgtttttgagactgagtcacgcttcatcacccagactggggtgtagtggcacgattctcctgcctgaggagattctcccgcctcagcctctggagtagctgggactaaggcacacgccaccacgcctggttaattttttttgttgggggggggagacagagtctcccactgtcacccaggttggagggcagtggcacgatcatggctcactgcagcatagcctcccgggttcaagtgattctcctgtctcagcctcccaaatagctgggattacaggtgcaccaagctcagctaatttctgtatttttagttgagacagggtttcaccatgttggccaggctggtcttgaacttctgacctgaggtgatctgtctttctcagcctcccaaaatgctgggattacaagggtgagccattgcgctcagccaattttattttcatttagtagatttgaggtttcattatgtttgtgcaactggtctcaaaatcctgacctcaagcgatctacccacctcggcctttcaaagtgctggaattagaggtgtgagtcaccgcggctggctagtgtaagctatttctgacagaacagtgaaatgagcgagacaggaaaagaggcatctcatcaccaacatcaccgaaggctgacaaatcttattaaacaaaaaaagtttacagtctgtaccataaaacttccaatatgtgaagcaatctaaaagcattaacttttaaaaaccaggcgggtgaatcacttgaggttgggagttcgagactagcctgaccaatatgtagaaagttcatctctactaaagatacaaaaattagccaggcactgccgggaacggtggctcacgcctgtaatcctagcattttgaaaggccgaggcgggcgaatcacgaggtcaggaattcgagaccagcctgaccaatatggtgaaaccccatctctactaaaaatattaaaaaatagccgagctctgtggtgcaccgtgaggaaaagcaagagagatcagattgttactgcgtctacgtagaaaaaggaagacaaaagaaattccactttgatctgtactaagaaaaattgttctactttaagatgctgttaatctttaacttttgtcccaaccctgtgtcacagaaacatgtgctgtattgactcaaggtgtaatggatctagggctgtgcagggtgtgccttggtgaaaatgtgtttgcaggcagtatgcttggtttaccactgccattcattgccattctccattctctattaaccagagacacaatacactgcggaaggccgcaggaaaccctgcccaagaaagcctgggtattgcacaggtctcccccgactgagacagcttgagatatggcctcatgggaagggaaagacctgactgtcccccagcctgacacctgtaaacggtctgtgctgaggaggattagtgaaagaggaaggcctctgtgccattgagataagggggaagcatctgtctcctgcacgtctctgggaatggaatgactcagtgtaaaaccgaccagacattctattctgagataggagaaaaccgccctatggctggaggcgagacatcatggcggcaatactgctctttactgcactgagatgtttgtgtaaagtcaaacataaatctggcctacatgcacatccaggcacaacacctttccttaaacttatttatgacacagagtcttttgctcacatgttttcctgctgaacttctccccaccatcaccctatagtcctgccacattcccctctccaagatggtaaagatagtgatcaataaatactgagggaactcagaggccaatgccggtgcaggtcctcacttgctgaccgccggtcctctgggctcacttttctccctctgtactttgtctcttttctcagtctctcacctccaccttgtgagaaatatccatgggtgttggagggacaggaccccttcacaaagtggtagaactatgggcgtgagccactgcacccagctacacatttacattatagcatcttgaccttcggctccccagctgccttgtgactcggtgtgtgtgtgtgtgtgtgtgtgtgtgtgcatgctcgcgtgttgtgacaggcaagaaaaagccactagagcatcatcgccactggcctggtaggaggaggttgcccttgggctgcagttcactgtgctgtttgcactcttgatccttggaagaatcttcctgaagtcacggagcctccagctcctctggaacagaactagttgtgtaggagtgtgtccttcatgccctcaggtccctgaccttctccccacccttcctgaagggaatccagaacccctgactctgagctcatcacctgcttgtggcaaagtccctgcccataacggccaaactgggtcctggtgatgtgcagagcacggaagacccaggagctggagtaaggcagtggcacaggtgataaaagtggggatgcctcggcactgcctgaggacacagggtctggcctgtaaggcttttctgaccctagtgaggccttctcttcttattttgactgaaataaatagccacaggaagttcagatcaattagagttgaaatttcaagaagaaatgtgggaccatcctcacacttgccccaggccctgagtcttccctgaggatgcctcagcatctgaactataaccccagagtaggtgctgcagttgtcctgtggccaagatgagaactgtgcatccttcagtgaagggagacacaaaattttcaaaataacccatgcagaaaggtgtttctgggtgggcacggtggctcccgcctataatcccagcacactgctaggccgaggcagacagatcacctgaggtcacgagttcaagaccagcctggccaacatggtgagaccctatctctactaaaaatacaaaaataggagcaggtgagttggctcatgcctgtaatcctagcactctgggaggccgagacaggtggattacttggggttaggagttcgagaccagcctggccaacatggtgaaaccccatctctactaaaaatacaaaaagtagctgggcttggtgggtgtctgtaatcccagctactcgggaggctgaggcaggagaatcgctttaacctaggaggtggaggttgcagtgagccaagatcgtgccactgcactccagcctgggtgacagattgagactcaaaagtaaaataaaattaaattagaattaaaatacaaaaattagccaggtgtggtggcacacacctgtaatctcagctacttgtgaggtgagacacaagaatcgcttgaacccaggagacagaggttgcagggagagatgtcatgagactgcactcacagcctggatgatagagtgagactctgtctcaaaaaataaaaaaataaaaagagcatttctgatgtgactgatgcagagataataaaatctgagtaatgtgatagagactgacaggcagagggaacttcagatgggggtgggagggcatgggagacatctctgagcctagacctgaaggaggaaatagggaaagggccatgataatttagggacatagggtaagagcagggacaatgaccagagacaggcaggattttaatttttgggaaaacagataagcaaatgtgactggggcagagggagtcatgagatgagggcaagctcccaggaggaggctggacactggcaggggccctggacacagggctatggagccacagtgaggagttgggctttcaacatttgtccacatggaccagagggccttgagggaaacatgcacttaatagctcacagctcaagattttaacaatgacataaggaaagaaaactgaaaaacagactaactggttaaaccacattttgatgtcaaaggttgccaataaataataaagagtagaaagcatgcagacctcgatctgaaccggacgcaactaatttcaaacagaaactactttgaaattgttttgtaaaactcgaacaaattcagatgtcaacgggaaaataactagaacatatacttgtacagaaaggaatgatgtgagctgattataggatgccacaaaggcatctttcagaagaagtgattatggattaaaaaaggaatttttaaaattaacatttatctcaaactccaaaaaaaaaaaaagaaagaaaaaaaaaaagaaagaaatgaagaggaaccagaaagaaaaaaaggaaatctattacacaacgagaacaaaagcacttttgatgtcccttttgttttttaattttttgtttttttttttttgagatgaagcctcgctctgccccccaggctgcagtgcagtggtatcatttcggttcactgcaacctctacctcccaagttcatgtgattctcatgcttcagcctcccgagcagctggaactacaggtgcacgccaccacgcccactttactttttagtgtttttactagagacggggtttcaccatgttggccagaatggtcttgaattcctgaccttagatgattggctcccaaagtgctgggattacagtcatgagccaccacgcccaggtttgatgtgccttttttttttttttttccatttttcttttttgagatggagtctcactctcgcccaggatggagtgcagtggcgcaatcttggctcattgcaacctccaccttccaccttcaagtgattctcctgcctcagcctcctaagtagctggaattacaggcacgtgccaacatgcccaggtaatttttgaatttttaggagacaggatttcaccatgttggtcaggctggtctcaaactcctgaccttgtgatctttgtgatccacccgcctcagcctcccaaagtgctgggattacaggcgtgagccactgcaccctgatgtcccttttaaaaagtactatgggatgggcatggtggctcacgcctgtaatcccagcatttgggagactgaggtgagcgatcacctgaggtcgggagttcgagagcagcctgaacaacatggagaaaccccatctctactaaaaacaaatttagctgaacgtggtggctcatgcctgtaatcccagctactagggagactgagacagtagaatcgtttgaactcgggaagtggaaattatggtgagccgagactgtgccattgcactccatcctagacgagagcaagattccacctcaaaaaaaaaaaaaaaaaaaaaaaaaaaaaaaagactctgtaggccaggtgcggtggctcctctctgtaatcccaactgtaatcccagtaatttgggaggtcaaagcagaaggatcctttgagcccagaattttgagaccagcctgggaaacatagtgaaaccccttttctacaaaaaaaaaaaaaaatacaaaagctagccaggcttgatggctcatgcctgtggtcccagctactcgggtggctaaggtaggaggatcgcttaagcctaggaggtcgaggctgcagttagaggagatcatgccactgcactccagcctggccgatacagccagaccctgtctcaaaatattaattaattaattaaatttatactattatatgataacagaaagtgatttttttctcccacttcactgccccacttcctattccatcctgggaaaagggaagagagtgtctaacaagtgaatgaagacacaaccctctggctgaatagggattccaactggaagctaacctctgatgccaagatttatagaatgtacatgtctcatagataggaattttaaaattctcaatctcatctgtataatttaaacaagttttaagttattaaactacatacatagaagtcagcatgtcacaacgaatcatatctaatgaactcacccactcatctgaacccaaagttccccgcccctttttttcttttgagacagggtcttgctctgttgaccaggctggagtgcagtggcatgatctcggctcactgcaggctggacctcctgggctcaagtgatcctcctgcctcagcctccagagtagctgggattacaggtgtgtaccatcacatccagttaattttttttttcttttggcagagatgggggtctcactatgttgcccaggctggcctcgaactcctggactcaagcaatccccttgcctcagtctcttaaagtgctgggattacaggcgtgagccactgcgcccagcccctctgtcttcattactgtgcttccctccctaattctgtacatatctctcattctccccttctctctctagctcttgttttcttttctttttccctgggattctgctcttcattttgtacccctctcctctcctgctgtttatccccttcttccctctattacttctcttccacctcttctgctccatcgtcgcaaattctttaacctcttgttgctccttctccccaatctttcgatcatcctcaatctccatatatttctgcctcttctcccatctctgcgcctcctctgctctccctgttaaattatctcttccctgttaaatccccctttccccaatctctagcaccccagatccccaggtgtcctccctgctgtgcttctccctctgttcttgccaccagcaccactctgctctgtctgccctggctccaaacccctcctcctctccctcactctgatgagcctccctctttgctgccccctccctaccttgctcttcttcatctctctgtacatcaagcttttctctacttttctccagttccttttctcctcctgtttttcttatcctttttttttttttttttttttccacttttgctgtctcttggcaaatccttcacccatcctctacgctaccatctgttatggcctttctcattcttcttttctctgtctcaggttttctactgctctctctctcagtctcccgatccctttggccaacacaatcacaggagggctttgaagtaagatgcctgcatcccggaggagcgcattttccagaggctggtgcagggcaggcaagaacacacggtgtcataggacagccccgggcacctccccaacgcgggctcaggagaaacggtgattacggagggaagacctggggagcataagggcccggcacgaggagggaggtggggggcgacggcgccttaagacaagactgggaggcgcccagggcgggaatccgcctcgcggtaaggactttaaaaagtgcgggttgggaggagtcagaaaaaagttttgagcaggaaaactacgcgatgggaagtgtatacgttaccctatagcagaaagattcgggacgggaccggtctatggtgactttaaacccaaaaggaagcgacccccagactctcacggggacttctcaatttgctctgggtaaagaaagacggaggagaacttccaggtctatgaggaccccacgtcccaggtacagaagcgcctgggacccgggaagcgcagacttaacacaacacagagcaaaactcacccccgcggtgggaccgtcactccacgcgacccgcttccgggtttgtgcgaatctgctctctggggacagaagccaggcctgggcgggacccgcggggaggtaggcggggcctgagcgaggtaggggcggggcgcgaggcggagagaccttgcccttcagaacagacagagggcggggcgggggcggggccggggcgggacctgtgcgtctctcagcctggctcccagagcctcaatttttcgggttttggaggcgagaccggccaggaaggctgaggcatgattcaaaagccctggaattgtctggaaggggatgcaaactagaatgtgaaatgcaaagccctgcctgggcggaacatacgatttcatgctgacggcccacagaacagaatagaaatcctctccctttctattttccattcactcaggagggacagtccaccctgtgctcagcttcagagacttccccagggcctccgcctgggatgcgggaccgagtgctcaggccagggaggagtgaggtcaccacctgctgcttaaacacagcaggaatgcgggcgcgggggcggaagtctgaggtcccagctgctcaggaagcagcggcgggaggatgctgagcctgggggtccaagccagcctgggcgacaaagtaacaccgcctcccgcagcgctcccttccttgtctctctctctttttttttttaacttttttttaaataaaatttttgattttgtgagatggggatccaacattgttatttttcatgtggatatccagttagttgtcccagcacatttgtggaagagatctattactttcatttttatatttacattttttcttttctttccttttttgagacagagtatttctctgttgaacaggctggagtgcagcggcgagatctccgccttactgcaaaattcacctcccggattaaggtagttctcttgcctcagcttcccaactagctgggattacagatgcgcgccaccaagcctggctaattgttttgtatttttagtagagactggggtttcatcacgttggccgggctggattcgaactcctgacctcaagtgatccacccgccttggtctcccaaagtgttgggactacaggagttagccaccgcgtctggccaggaaaactcttagaagttgcgtctgcagccgggcgccggtggctcacgcctgtaatcccagcactttaggaggctgaggcgggcggatcacgaggtcaggagtttgatgccagcctggccaatacggtgaaatcctgtctctactaaaaaatacaaaaattagccaggcgtggtggtgcgtgaatgtagtcccagctacttgggaggctgaggcaggagaatcgcttgaacccaggaggcggaggttgcagtaagctgagatcatgccactgcactccagcctgggttacatagtgagactacgtctcaaaaagaaaaaagaaaaaagaagttgcgtctgcataccacaggacacaggttgcatgaccacattcctttcaaggctcagaattatttaaaggtccatacctttaaattgtttaaattggaattatttgatatttcaaacgtttaatttcctactgagttacaggtaccgtctctcttgttgtttgcctttcaaagagagaccccaggtccttcagaaatacatccatgggttattaagctgaaaaaaagtttaggttgtttctaaaaaataccacttcaagccgggagcggtggctcatgcctgtaatcccagtgtcaaaccaccgaggcaggcagaacgcctgagatcaggagttcgagaccagcctgaccaacatggagaaaccccgtctcttgtgaaaatacaggattagccgggcatgctggtgcatgcctgtaatcccggctactctggtggctgaggcaggataatcgtttgaaactgggagacagagattgcggtgagctgagattgcatcattgcactccagcactggcaataagagcaaaactctgtctcaaaaaaaaaaaaaaaaaaaccctcagaagtgaagggggcctgcccctacacacctgtgggtatttctcgcaagatggagatgagagactgagaaaagaaataagacacggagacaaagtatagaggaagaaaagtgggcccagcggaccagtgctcagcatacggaggacccgcgccggcactggtctctgagttccctcagtatttattgatcactatctctaccatctcggagagggggatgtggaaggactatacggtaatggtggggaagggtcagcaggaaaacatgagagcaaaggactctgtcataaataagtttaaggaaaggtgctgtgcctggatgtgcacgtaggccagatttatatttgagtttacacaaacatgtcagtgcagtaaagagcagtattgccaccatgatgtctagcctccagccataagatggttttctcctatctcagtaaatataatgtacgatcgggttttactctgagacattccattcccagggacgagcaggagacagacgctttccttttatttcaactgcaaagaggcctttatctctcactaatcctcctcagcacacacggtttacaggtgtcgggctaggggatataaggtctttcctttcccacaaggccatatctcaggctgtctcagtggggggaaacctggacaatacccaggctttctcaggcaaaggtccctgcggccttccacagtgcattgtgtccctgggtaaccgagaatggagaatggcgatgacttttaccaagcatactgccagcaaacacatttttaacaaagcacatcctgcccagccctaaatccattaaaccttgagtcaacacagcacatgtttctggagcacagggttggggctagggttacagattaacagcatctcaaagcagaagaatttttcgtagtacagatcaaaatggtgtttcttatgtcttcctttttctacatagacatagtaagtctgatctctcttttccccacacagaagacagagaaaatgcatttacaaattttctaaataaatgtcccaagaaaagaggcaaaaaaaaatcttttttttttcaaaggaggaattatacctctatttccttgtttgtttgagacagggtctagctctgtcacccaggctggagcgtggtggagagattagaactcactgcagccgtgaaatccctggctcaagtgatcctttcacctcagcgccccgagcagctgggaccacaggcgcacaccaccacacctgactcgttttttgatttttagtacagacaatgtctcactacgttgccccggctgatctcgaactcctgggctcaagcaatcttcctgcctcagcctctcaaagtgctgggattacaggtgtgagccaccgctccgggccctgactttatttccatgaaatatgaaacccctatcctccacctcctgtgtgtaataggcagttttgcttgtcacttttcagtttccattatccactcaaacaacccaggaccttgcttagtttaataagccgttctgtcagttcccgctgcaaccagcgccccactccacccctttaccgaggtccctgcccctctcccccgccctgccccagactgaggggagctcgccccgcctgcaggacgcacgactctacctgctccaaaaaggcgctttgcattaaaaccattttcaatttaagaagagaaactattcagcgttcagcacacgtggtctactacaataagttgttttaccttcgattgtttgaaatgttaacttaaaacgggcaggaagcatccatgtgatattaggggtaacatcacggcacaagagaatgaatccaccaatcagaactcggaggatccagtcctagagggagaggatgacagcaggagacatccacggcccagctgagaaagcccgaacccgccccctccaggcctggccctttagaacaacccaccttccagagcccgccccctagacggcgtcaaccctctggcctggctcctgcccgcagtccggcccggcccccaggcagccttctcccttttgccccgccccaggccccgcccccacagcggcctccactctctcgccccgacccagcacctgttcaggccccgcccgctcagcaaccttttctctcctgccctgtccccgcttagtgtccagaaccctcccagacagggtccaggaccagcccatggttgttctgcacggagagcccggggctgacgcaggtgagtgattttttgtctttctgcttcaaacctgcctttctcagcaccccagcccccagtccagccataccaggaatttgggtgcgtcgggatgttgaaatccccacgcgagtttgtgcagttgtcagggagtcccagcttcgccatgggaagctcgcagacccggtggctctgcagcgtttgtatcgttttagcccatgtcctccccctttcaggtggcaaaatctcggctcaccacaatctctgactactaggttcaagcgattctcctgcctcaggctcctgagtaactggaattacaggcgcccgccactacacccagctaattttgtatttttagtagagactaaaaatgttggttacaccatgttggttatgctggtctggaaaacccaatctcaggtgatctgcccacctcggcctcccaacatgctgggattacaggcgtgagccactgcgcccagcctctaggtagctttttttagtctttgtagctatgttgtttaggaataaaatgggaggcaggtttttctgtcccaattcccagcttgacctttctctttggcttggtaatttttattatcctttcacaagctcagacagacataatgctttgacacaatgatattgctttatatagattttccacatcaataaagtccaagggtctgtcatgaactgggttagaagagacgagaagattcccaggagactcagtctcaagcaatcctcccacctcagcctcccaaggtgcgtggaccacaggtgtgatccactgaacacagtggagtctccagctcaaaaaaacaaaacaaaggttaaggtactctatcgaattacgtcatttgacttattttatttttattttttatttatttattttttttctgagatggagtcttgctctgtcaacccaggctggagtgcagtggcgcgatctcagctcactgcaacttccgcctgccgggttcatgccattctcctgcctcagcctcccgagtagctgggactacaggcgcccgccaccacgcccggctaattttttgtatttttagtagagacggggtttcaccatgttagccaggatggtctcgatctcctgaccttgtgatccacctgccttggactcccaaagtgctaggattacaggcgtgagccaccacgcccaattgacgttttttttttttaaataaaatgtttcacatatttattaccgaacctagccaaccaatgtgttcgtaacagagtcagagataaaaaatatattcccaataaaacatgtccaactctccagataggggtgacattttcagcttgatatggttgcgtgattgtgaccttattatcagttttcatgcgaatccactggggaatggaacaattctgcttttgtttcttggccaggactctcttaatcctgaaagtcttgtgagaagacatggcaagaagccaagtcaagcacacactacgatgacggagagaggagaagggtcttgattttttcttttttttagactaagtttctttctttttgcccaggctgcagtgcaatggtgcgatcttggctcgctgcaacctccgcctcccgggttcaagtgattctcttgcctcagcctggcgagtagctaggtttggccaaaatatgaactagaaaggcaggaacctggccaaaggtggggagcttgaatgttattaccttattcctgcttgacctttactgccaacgccaacacaaatggtcagaggtcccttatatgaaaatcttcatgatcttgtgggaaaaccctgatttttgtaaaggctgcaaaacaggctcaaaaataaataaataaataaaattacatttaaaagagccagttgcagtggctcacgcctgtaatcccaccactttgggaggccgaggtgggtggatcagctgaggttaggatttcaagaccagactgaccaacatggagaaacaccctctctactaaaaatacaaaaattagccaggcttggtggcgggcacctgtaatcccagctacttaggaggctgaggcagaagaattgcttgagcccaggaggcaaaggttgcaatgagcccagaccataccactgcactccagcctgggtgacaagagcaagactccatctcaaaacaaaaaaataaaataaaataaaaaataaataaaaatacaaaaattagcatggtgtggtggcatgcatcactaatcccagctactcaggaggctgaggcaggagaattgcttgaatgcaggaggtgaaggttccagtgagctgagatcatgtcattgcactatagcctgagtgacaagagcaagactccatctcaaaaaataaaaataaaaaacaggctgggtaaagtggctcaagtctgttggccaggctggtctcaaactgctgacctcaagtgatctacctgccttggcctcccaaagtactgggaaaacaggcatgagccactgcacctgacccattcttcttaacattaacactttttatgtcaattaatgcgtgaactcaatgttaagtcaactcaaactcaagtcaatgttgaatcaactctaatgtcaattaaagttttatgattttttatattcattttatttggaacaattatctcaaaaatgaattttctgatgttctgcatggaatgaccacagagtgaagaccttgccacccttacatttgtaaggcatctgtccagtatgaattctctgatgtctaatgaggtgtgaacatgaagtaaaggctttgccacaatcatcacacttgtgaggtttctctcctgtatgaattctatgttttgcataggatgaagcttgactgaagaccttgtcacagtcatgatatttgtaaggtttctctccagtatgagttcactgatgaactacaagttatgaatgacgtctgaaaaatttgccacatttattacacttgtagatctctcttcaatatggattctgtaatgatttgcaatggttgtagcattactgaagactttgtgacaatcattacatttgtaaagtttccctacacccatggattgcttgatggtgaataagtgttgactgtccagtaaaggctttgccacactcattacacttgtaaggtttctctgcagtatgaactctctgatgttttgcaaggcttgctttttgattaaaaaccttgccacattcattacacttgtaaggtttctctccagtatgaactctctgatgttgtgcaaggattcctttttgattaaaaaccttcgcacatttattacacttgtaaggtttctctccagtatgaactctcgtatggtttgcaaggcatgaatcactccggaaagccttgtcacaaaccttacatttgtatggtttttccccagtatgaattctcctatgtctttcaaggtgtgatctgcgactgaaaactttgtcacattcttcacatttgtaaggtttctctccagcatgaagtctatgatgacgtgcaaggttttctcttcgactaaaaaccttgccacattcattacatgtgtaaggtttctctccagtgtgaagtgtatgatggtattgaagggatgacttccgactgaaactcctgccacatttattacacttgtatggtttctctccagtatgaactctctgatgttctgcaaggtatgaatcactccggaaaaccttgtcacaaaccttacatttgtatgatccctctccagtatgaatcttcctatgtctttcaaggtgtgatctgcgaatgtaaacattgtcacattcttcacatttgtaaggtttctctccagtgtgaagtatatgatggcattgaagggatgatttctgactgaaggtcttgccacactcattacacttgtaaggtttctctccagtatgaattgccttatgaattacaagggctgaatttcgaccaaaagtcttgccacactcattacacttgtaaggtttctctccagtatgaagtctacgatggcatctaagggatgacttctcactgaaggtcttgccacactcattacacttgtaaggtttctctccagtatgaagtctacgatggcatacaagggatgacatctgagtgaaggtcttcccacactcattacacttgtaagttttctcaccagtgtgacatctatgatgatatacaatgtattgcttctgattaaagatcttgccacatacatcacatttatattctctctctcttgaatgggttatgtggtgtctccttaagagtgagctataattaaaggctttgccacactcattactttggcaaggtttttctctcatgcatatttcctgtatttgtgtgaatgaagaatggaggaaattcttcccatacttattagaaatatgagttttgagcctacaagaaattctttgggattctgaagctgaggaagcaccgatagacttgtccaattggttactaattttccctttagtctgaaacatgtggagttcaggcagatgcgaatgaaagcttaatccaagctgatctttaataggcttgtttccagcatgcctgtgatcacttcggtctgtactaccagtcaactttttgatttttgtcatgggtgcttcatggccatttctttcaacttcttgccactgaaactcaaagtgatgaatatctttcttcatttctgggaagcaaaaatctccaatgtgatgacttttatgtctttgcaacgtccctgtgtggatcacttctcctgtaatactgtgcctggttgatgagaactccatcatggattttaaagagctatctaaaaaatataaagaccaataggtttccaattaagtacagatggtaaataatagttgatattcagatgtgtaaaaattacacaaaaagcaatacttattttaaacttcccaaatgtgatcttcatagtttaagaacacactgtctctactgaacatacaaaaattagccagtcatggtggtgggtgcctgtaatcccagctactcaggaggctgaggcagcagaattgcttgaagccaggaggcagaggttgcagcatgcggagatcaccacattgcactccagcctgggcaacaagagcaaaattctgtgtagaaaaaaaaaagagttcagtcaagagcctcatatatatgaggcagtgagcctgaatgatgtcctccctaagaggaatttctacagcagtgactactgcttagagaagatgaccattcgtttatgtgatgaacactgtcacagtgctagtgagagatgcttctgtgatggttctcaaaaaccagaatgaaaggccaagcatggtggctcacgcctgtaatcccaacacttcgaggctgaggtgggcaaattgcttgaggccaggagttcaagaccaacttggccaacatggtgataccctatgtctaataaaaatatgaaaatctgccaggtatggaggcatgtgcctgtaattccagttaggttgagaggctgaagtacaagaattgcttgaactcaggatgcagaggttgcaataagatgagatcaagactctgcactccagtctgttcaacagagggagactctgtctgaaaacaaacaaacaaaaagaaaacaaaaccacaagcacagctggaaacacttgtcaatcagtgtcatgctttctatctcgtatcctgggccatgctgaccattctgctcagggcttccagggacatctcttcctagagcaggatgatgttcaattgtattagtcaaagtgttcgtgaattttctgtttttatgtaaaaccactccaaagaagagtctctaagaagctgtccatgacagataggagggtcatcaccgcagaaaacaatgacatgtacatcaaaagcatgtatggggcaaaatcacaaaagagaatataaaaccagaaagagccaagatagacaagtgcagattcctcatgtctggagggacattttcctcacccacaaactccaggttcctgtagttctccaacatcacagccctgtataaagccctctgtgcagggttcaggcatttccactcctccaaagagaactctatagccacatccctgaaagtcaagcgtccctaaaataaaaaacacgtttcaacaaaacattatggaggagtgagttattgccctcacgtgaaatgagaaaacagaaaataagtattgatttgatccaagactgtgttctgacaaatttatgttaaggtatttttgaacaatttttcagtatagttgcattttattgtactttttcatgatagcttttaaaatcccctaagtcactgtggaagtctcagttttatggacaatataaggccaggaatggtggctcatgcctaaaatcccagcactttgtgagaccaaggcaggtggatctcctgagctcaggagttcgagcccaggacaatatggtgtaaccccgtctctactaaaaatacaaaaaaaaaaccaggtgtggtggcacacgcctctagtcccagctacctgggaggctgatgcacgagaataacttgagaacaagagacgaatgttgcagtgagccaagatcgtgccattgcactccagcttgggctgcagagtaggactccatctcaaaaaaaaaaagaaaaaaaatatatatatacacacatacacatatgttttatatatataatatatacttatatatattatatataaatatataatatatattttaatatttaattatatataatatatatttataatatataatatataatacaatattatatataatatgtatttataaaatataatatataatacaatattatatataatatgtatttataaaatatatatgatacaatattatatataatatatattacaatattgtatcatatattatatataatattgtataataaatatattattaaataaagatattaaatatatataatatatattttatatatatatataaaataagtccagacatggtggctcacacctgtaatcccatcactttgggagaccaaggtgggtggatcacttaaggtcaggagttagagaccaacctctccaacatggcaaaactccgtatctactaaaaataaaaaaattggctgagcatggtagggaggtgcctgtaatcccaactattcaggaagctgaaacaggaaaatcgcctgaactctggaagcaggggttgcagtaagccaaggtcacaccattgcaatcctgcctgagcaacagactgagactctttctcaaaaaaaaaaaaaaaaaggtatatatatattgcaaataatgtattttctacataaaccgtgggattggctgcacacagtaggtacacctgtaatcccagcactttgggaggctcaggcaggtggataacctaaagtcaggagtttgacaccagcctgaagaacatggacaaattctgtctctactaaaaatacaaagttagctgggaatggtggcgcatgcctatattcccagctactgaacctgggaggtggaagttgcagtgagccgatatcgtgccactgcactccagcctgggccacaagaatgaaactccgtctcaaaaaaaacaaacaaacaacaacaacaaaaaagaaatgaaacaaaactgtcaaggactcatgagtcttcattcagagaaagctccaaggaggatttaaaagagtgagctatcttgttttctaccttggaaacatgaaaattttcagaacttgcaggataaaatatcataacaaacattcatcagaccgggagcagggctcacacctgaaatcccagcacttagggaggccgacgtggaaggatcacttgaggccaaaagttcgagaccagcctggccaacatggtgaaaccccatctgtactaataacacaacaattagccaggagtgtagcacgcatctgtaaatgcagctactcagttggctgaagcgtaagactcatttgaacctgagagccagaggttgcaatgtgccactacactccaggcggggaggccctgtctcaaaaaacatgcaaaaaaaaaaaaaaaaaaccccattcatcaaataattttttctaaaatctcataacggtatatgaatacatttctaaaggattgcgccgacttgccacagaactctcaacagcgattccccactgagacatgggaatgggtggaaggctggacaggaaaggggatgcataagtgcacttttctttggacttttactacacaacacatatatacatcatgtgatgtttaaaataaaagaattacttaataataatgggtagaaaaagaatggctccatcctctctaacgacgtaagttgtgctcttatgtcagagcaaacttataatcatttttacctaaaatgtttgcttcatcagagtccctgtaaaaaaaacaaaacaaaacaaaaaacaaaaaaaaagtctctgtggggtcaaagtgctgagaatgatttaaagaatcccctgcagttagatatttatattgatttcataatttgaagtcaatgatggaataaagctaactctattactggtatctatatccgctttccattctattctaagacattgaaagtgcagagtcctgctgggctgtctcacacctgtaatcccagcaatttgggaagctcaggtgggagggccacttaagcccaggagttcgaggctgctgtaaactagaattgtgccattgcactccagactgggccccagagtgacaccgtgtctcttaaaacaaaagtttggcgtcagagacatattgactcactagtgtagcttcaaatgcattacaaaatcagacacaaaatatctcccctagtttgtctcctcttccagaatttaccagattaaccagtgaacattaatgtatgactttcatatacagtttctctgatctggtccacaaagagctaaacatgcatccagatgtggcccctgaacaatccctgctgcccaacatcactgacaccatggggcccacaccccatctccatccatgtctggtgtgagcccttcccaggaccatgcccagtggagcctcttcccaagctcatgtcactaggttataggagatggaatttaagtgaagatgagagggactgagaaaagacacgggtgagtgcgagcaaacgtgtgatgtagaatgcttcacactcagagaagattggctactacaatacctggcacttcagaaaggaaagagacagaagaatccaccaaggaatatcacttacctgaggaagagccatccctggctccttttctttgctcttcttggtggcttcctcacgtaacatgagtctttggaaatcctgtatgttaaaaaagcaagagatttaatatttagaaaccattgactcctttcctgtgacaaaacacacacacaggggaaacctcacccgagagaaagatggtcctttgctacccactgcaccagagaccatgcagagataagaaagttccacaggaagacctacaaatgtaattttgacccgttttcagatcttgctcccctcctggaaaagtccacacacacgctgcagcaggacacagatcttcagggcacagatctagccctaaccaaactccatgcagagcacagccccctcacctccctgtggatcacagactgatctcagctctcaacatggaggaaacttccttgatgtttaatgctggacacagataagaatcaccagtgccattgtaagtattattgagtgtgggtcccatcctattataatagcaatctgataaaacagcatgcctgtaatcccagcattttgggaggccgatgcagctggatcccttcagctctggggttggacaccagcctgagcaacatggcgaaagcccatctctacgaagaacacaaaaattagtgtggtgtggtggcacgcagctgtggtcccagctactctggaggctgaggtaggaagcagaccaccacttctcctgctgccttcctccctcccccttgcctagtttataagacaggaggaaaggaagaaagcaaaaagttagaaagaaacagaagtaagataaatagccagacgaccttggtgctaccacctggccccggtggttaaaaataataataataccaacccctgacctaaactacttatgttatctgtaaattctagacattgtatgaagaagcattgcaaaagtttctgttctgttagctgatgcacgtagtgtcaagtcacattccccacacttgcttgatctatcatgaccctttcacgtggatgccttagagctgtaagcccttaaaagggccaggaatttctttttcagggagctcagttcttgagacacgagtcctctgatgcgctgggccgaataaagccacttccttctttaatccgttgtctgagaggtactgtctgcggctcgtcatgctacatttcttggttccctgacttggaagcgaggtaattaacagaaggtcgaggcaaccccttaggtgacttaggcctgccctttggagcatccctgctgggtactccagccagcttgggcgacatggattctgagagtgctaccaggtaggcatgtgccccagaaagatacttagcctggccatccgaacttgcagtgtaaccagtgtgcttactgtaaagaaataggatattagaaggacaagtgccctcagctaaaaggaaaacaaggtggctcagagcaggaggccccagaaggagccctgttcaatatagcagaagagttactgaactgaggaggaccaggctcaactgcccccaaggagcccatggtcaagatgacagttaggggcaaagacattgattttcgtattgataccagtgctgaacattcagtagtaaccgccccggttgcccccctttccaaaaagactattgttataatcggagccatgggagttttatcaaagcaagctttctgttgccccagacttgtactgtaggaagacataaagtgattcaccagttcttgtacatgcctgacttgaaaggacttgaaaggacttgcttagcgagctgagagccaccgtctcttctacagagcacagctctttacagctaaggttacccagaacgggagtcattatggcccttacagtcccccaggaagaggaatggagacttcttttaactgagccaggccaagagataagaccaactctggctaagcggtggccaagggtgtagacagaagacaaccctccagggatggcagttaaccaagccctggtacttatagaagttaagcgtagggcccagccagtcaggcaaaaacagtacctggtccccagagaagatcttgaaagtatccaggtccatctcaagagcctgagagcctttagaattacagtcccttgtcagtctccctggaacactcccctcctgcctgttcccacgccagggaccaatgactacaggccggtacaggacttgcacttagtcaatcaagctacagtgactttacatccaacagtacctaacccgtacacgttaaggttgctgccagctgaggacagctggttctctggcttagacctgaaagacactttctttagcattagactagcccctcagagccagaagctgtttgcctttcagtaggaagatctgggatcaggtgtcactgctcagtactcttggacccggcttctgcaagggttcaagaactcccccaccatcttcagggaagcactggctcgggacctccagaagtttcccaccagagacctaggctgcgcattgctccagtacgttgatgaccttctgttaggacaccccatggcagttgagtgtgccaagggaaaggatgccctactctggcccttggaggactataggtataagttgtccaagaagaaagcccagatctgctgacagcaggtacattacctaggatttactatccaacagggggagcgcagcctgggatcagaaggaaagcaggctttttgcaacctactgaagcctaagaccagaaagcaggtgaaagaattcttaggtgctgtgaggttctgcagaccgtggatcccaaactttgtagtactggccaagcctctgtacggagtcacaaaggggcaggaccaggaaccttttgaacggagatcccaacaacagcaagcctttcatgagttaaaagaaaatcttatgtcagccccagccctggggttacctgacctgacaaagccttttacgctgtatgtttctgagagagaaaatacggcagttagggttttgatccaaactgtggggccctggccgaggccagtggcctgcctctctaagaaactaaatggggattctaaaggttagccctcatgtttgagggccttggcagcaactgccctgctggcagaagaagcagataaactaactcttaggcaaaacctgaacataaaggccccccatgctgtggtgactttaatgaataccaaaagacatcattggctaatgaatgctagactaaacaagtaccaaagcttgctctgtgaaaatccccacataaccattgaagtttgtaacaccctgaaccccgccaccttactcttggtatcagacagccctgttgagcataactgtgtagaggtgttggactcagtttactttagcaggcttgacctttgagaccagccttgggcatcagtagactgggagctataagtggacaggagcagcttcaacagcccacaaggagagagatgtgcaggatatgcggtagtaaccctggacactgccattgatgccagatcgttgtcccagggcacttcagcccagaaagccgagctcattgctttaattcaggccttagaactcagtgaaggtaagactgaaaatatttacactgactctcggtatgcctttttaacccttcaagtgcataaagcattatataaagaaaagggcctgttgaactctggagaaaaagacataaaatatcagcaagaaatcttgcaattattagaagcagcatagaaaccccacaatgtggcagtcatgcactgcagaggacaccagcgagcttccacctcggttgccttagggaactccagagctgactcagaagctcgaaaagcaacatccacaccctactgggcatcagtcacagcccccttgctccctcaagcacctgaccttgtacctacttattctaaagaagaaaaagactttctccaggcagagggaagacaggtgatggaagaaggaaggatccggtcaccaaataggacagtacctgtgccacagctgctaggagccacagttgtactggaggtgcatgaaaccacccatctaggtcaggagtcacttgaacagttgttaggctggtacttctacagctcacaattgtcagccctcgccaaaaccgtggcacagcggtgtgttacctgccgacagcacaatgcgaggcagggttcagccattctgcccggcatacaagcttatgaagcagccccctttgaagatctccaggtggacttcacagaaatgccaaagtgtagaagtaacaagtatttactagttctcgtgtgtacctactctaggtaggtggaggcttatcccacacgaactgagaaagctcatgtgcttcttcgagatcttattcctagatttggacggcccttacgaatcagctcggataacgggctggagtttgtggctgacttagtacagacgacagcaaaggtattaaagatcacgtggaaactgcatgctgccttctgacctcagagttctggaaaggtggagtgaatgaatcggattatcaaaaatagcttaaggccttaggaaaaattacacaaatgatttcagcccaggtaaatgagagatgccccattagcttattctccccagttcactctttctccccgggtgattgagtgtggatcaaggactggaacgtagcccctgtgtgcccccactggaaagtaccccagaccgtcatcctgaccactcccaccgctgtgaaggtagaaggaatcccggcctggatccaccacagccatataaaacctgcagcgcctgaaacctgggaggcaaggccaagcccagataacccctgcaaagtgaccctgaagaagacgacaagccctgctccagtcacacccggaagctgactggtcctacgcacagtggaagcatgaggaagctcatcgtgggactcattcttcttaaattttagacttgtacagtaaaggcttcaactgaccttcctcaaactaaggactgttcccagtgtattcatcaggtcactgagataggacagcaaattaaaacaatctttctgttctatagttattatgaatgtacaggcacgttaaaaggatcttatttgtataattccactcaatacaaggtacgtagcccaggaaatgacaaacctactatgggttataacccatctaagcctcctgcaaccaccgtttttcaaataagattaagaactggtcctttcctaggtgacacaagtaaaataataactagaacagaagaaaaaagaatccccaaacaagaaactttaaatttgatgcttgtgcagccattaatagtaacaagctcagattaagatgtggctctcttaactaagaaaggagctgcacagtagaaaataaatgtttgtcatgaggcagaggtctgtgaaaatttgcctgttgcccatgtgttatttaggctacttagaaaaatgacaaaaaagacccggttcactttcaaaaaaaagaagccaacccctcctgtgctagcagtcactgtaacccactagaactaataatcactaattccctagacccccgttagagaaaaagagaaggtgtaatcctgacggtcaataggacaagggtaaccccccaagttgccattttagtccgaggggaggtccccaggccctttcccaaaccagtgtttcaagccttttataatgagctaaatctgccagcaccagagcttccaaaaaagacaaggaacttgtttctccagttaacggaaaatgtagctcattccctcaatgttgcttcttgttatgtacgcggaggaactactgttggagaccgatggcctcaggaagcccgagagttggtgcccactgatccagttcctcacacaattccagctcagaaggcccaaactagcaacttctaggtcctaaaaacctcagttattagacaatactatgtagctaaggaaagaaaaaacttcagcaaccccgtaagaaagctcaattgtctaggacagaagttgtatacaacagcacaacaaggacagtcacttggtgaggcttaaaccacactgaaaagaactcattacgtaaattttctaaattacagactgcctaggctcatccagaatttcattgagactggacggcccccgctggactatactagtccaggcacagagactatactatactatactagtccaggcacaggctatactagtctgtaggcacagagacccatctccaacaacaaagaagaaaagtgaaaatctgggtcctggctctgggaatctaaggccaattaatgtgaactttgcaaaactagaccaaaaggaataaccccatctccccacccgtagtaacaaaggatcaaagggtactctccctgtagccctcccacttccaccacgtctcagatggaaagggaaagagcccaggagtggccacaaagcaccggccaccctggggctgcggggctgcaacgctgcgctccaggggccgactagagcgaggctgggaagcgctcttgcccagggcaagaatccagctccgggtgaggacttgaaacagcgcgaggcgggaggacgcgtcagaaagggttttgctaaggaaagtttcgcgacaggaggtgtctgcacggccccactgcagaaagaccggggacgggaccagcctcagggcaactttaaactcaaaaggaagcgactcacggactctcacccggacgtttcaatttgctctgggttgagaaaagaggggccggaacctgcaggtctgtggggaccccacgtcccctatatagcagcaccagacaactaggaaacgcacacgccgccgtgcaactttcagtccacgccatccgcttccgggtctgtgccaatcggcgcaggacagaagcgggacctgggccagatccccgagaggtgggcggggcctgggcgaggccggggcggggtgcaaaggacaaggggcccggcgcggaagagaagagtcttgggctgggaggagtccgcgggggcgggaaaggggcggggcctgagcttttctccatctcgctctccgcgcctctgttttcaaggttttagaggtgaaacccgccagtgaggctggagcagctcagcagtcagggaaatagtacctccctgagaagtcgccgtgtggcggtaattggatccgggaaagttccttgctattgaaatttattttagcaatttaattccaaagcctggaagttgtctacggcaggaatgcaaactagaatgcgaaatgcaaagccttgcctgagcgaaaggtacaatttcatgctgacggtccacagaacagaatagaaatcctctccctttcaattctccattcactggagtgggagagtccacactgtgctcagctcctgagacttccctagggccaccgtctggggtgcggagcagaggagtgtgcttaaacacagcagggatgcgggcggggtggcaggagtctggggtccccgctactcaggaagcaggggcgagaggatcgctgagcctggagttccaggccagcctgggcgacaaagtaagaccctctatcccagagctccctcctccgtctcaataaacaaaaaagtgatttaaaaaaagcactgacattgtaacagtgcatataagttgcccagttgtttcttacgtttattatttcatgctgcacttaaaatgagttatttttgtcgtggaaaagaatcaaactgtaaaatatcttaagagatttattctaagctaaatatgaatgaccctcaggaggtcctgagaacatgtgtccaaggtgatggggaacagcttgttcttagacattttagggaggcattagacatcaatcaaatacatttaagaaatacgctgctttggttcagaaaggaggggcaactcaaagcggggacttctgggctacaggtaaattgaaacattttctgattgacaattggttgagtttgtctaaatacctgggatcaacggagaggaaatgttcacgttaaggtaaaagattgtggagaccaatgttgttttcaagtcttctattggctgcccttagagataatagatgataagtgttttctattcagacctttaaacagtgcgagattcttacttaatctcttcaggattggtagggcctagaagaaaaagatctagctatgttaacagagattctttacaaatgcacatgtacccctcacaaagaacagctttgcaggaccatttcaaaatatggcacagaaacatgttttggggtaaaatattttgactttcttctttgtcacgttattccagagtcagactggaaagtaagacaggatatataggactaaataaaacccatctgatgagtatttatggtttgtagggcatgactccccagaccctttagataggaatttgggcaagagaaaaaaattagaccttggtcctcattctcaaattctttttttaaaaaataattcctaagtgtattgtaatatcaaattcactttacgtgccttctgaaaataagtagaaaatgtactttttatcttcaagttgtaatttttttttccctagaaacaggacctagttctgacacccaggatggaatgcagtggtgggaacactgcccactgcaacctcaacctctggggctcaagcaatcctcccgtctcacctcccaactagctggggccacaggccctcaccaccaggcctggctaattttttaatattttgtagagtcgggggtccactatgatgcttaggctggccttgaactcctgtactcaaacaatcctcccaccttagcttcccaaagtgttgggattaaaggcgagctaccacacccatccaattgtaatctattttgggtgttttctttgttgttctctcctaagtgttctatcaggtgtgaacaacaaaggctgtaaaataggcagtcttcaaacattgggatttattttcatatagagaataattatgagatattactaaggatacattgcagtcaggttattctgttttacgtgggccctgaagaaaatataactaaattacaaaattggctgggtgtgatggctcacacctgtaatcccagcactttggcaggcctaggcgaatggatcaccctgaggtcaggagtttgagatcagcctggccaacacagcgaaaccccatctgtactaaaaatacaaaaattagctgggcatggtggcatgcgcctgtaatctcagctactcaagaggttgaggcaggagaattgcttgagcccaggcagcagaggttgcagtgagctgacatctcaccattgcactccagcctgggcaacagagtgagactgcatctcaaaaaaagaaaaaaaaaattataaacttttacatcaccgcatttctgcatgcaataattttatggcaatatctgtaagttaacatgtactatgaactatatttttcactcacatccctagttatcgaaggtttcatttatcaaatactagtaattagctaaaacataattatgtttaggaagaaattagcatatctaaaatattagcaagtttaaaaaagcataatgtggccagggatggtggctcgtgcatgtaattccagcatgatgggagaccgaagcagaaagatagctagtggccaaaagttggagaccagcccaggcacatggtgaaacctcatctttatattttaaatatttatgtatctatgtattcatttattcatctttgagatggagtttcattctcattgcttaggctggagtgaaatggtgtggtctcggctcactacaacctctgtctcctgggttcacgtgactctcctgcctcagcctcccgagtagcaggtattacaggcatatgccaccatgcctgactaattttctatttttactagagacggggtacctccatgttagtcaggctggtctcgaactcccgacctcaggcgatccacccaccgcagcctcccaaagtgctgggattagaggcctgagccaccatacccagcctctatgtagctttgtaaaaaatccttgtagctgtctcttttaggaataaaatgggaggcaggtttgtctgacacagttcccagcctgacttttctctttggcttagtaatttttaagcttctttcacaaccttctgacagacataatgctttgacacactgatattggtttatatagattttccaaaacagtaaagtccaagggtctatcctgaactgggttagcggaggcgagaagattcccagaagactcctgatctcaagcaatcctcccacctcagcctccgaatgtgtgaggaccacaagtgtgatccactgaacccagtggagtctccatctcaaaaaaaaccaaaaagcaatacgggaattaaggtactctatggaattacatcatttgacttttttttgaaatgaaaagcctcacatatttattactgaacccagccaaccaacatgttcataacagattcagagagaaaaaatatattcccaataaaacatgtccaactctccagataatggtgacattttctgcttgatatggtaacgtgattgtaatgctcagacagcataaaaatgtgtgccatctcatgtacaattccttatagacacggattggttcttctccaatgtctccttttaaagttgtacctgattttattaccagttttcatctgaatccactggggaatggaacaattttgctttttttcttggccaggaattgcttaatcctgatagtcttatgagaagatctggtgagaagcagagtcaagtacacaccatgatggtggagaaaggaagagaaggggcttgacatctttttttttttttttttttttttttttttgagagaaagtttcactcttgttgcccaggctggagtgcaatggcactatcggttcactgcaacttccacctcctgggttcaagcgattctcccacctcagcctcccaaggagctgggattacaggtgtctgcgaccatacctagctaatttttgtatttttaatagagatggcatttcaccatgttaaccagcctgttctcaacctcctgactattgtttctgctgttagctgtcagtcctcttcatcacggcacaaacaagattattgtttttctctgaaactgatgtggatggtctgcctgctgctccacgtgtaaccttcaacattgtcttctcccaactcaaaattagttatccatttacaaactgttgatttcttttgggcatcgtccccataaccttttcataaagcatcaatgatatcataattcatctacccaaactttaccataagtattctttttttgagacatgctggagtgcagtggcaagatcacagctcactgcagcctcgacctcccaggctcatgccatcctcatgctacagactccacagtagctggccctgcagtcaggtgccaccctgcccagtgaatttctgtattttttgtatagaaggggttttcaccatgttgcccaggctggtcctgaatgcctgggctcacgtgacccacctgtcttggcctctgaaattactggaattacagacctgagacactgcaactgttctcatcataaattttatgtttcttcttgtttcaattttagcagaatttgtattcctttgatacagtctcttttcaaactcatgtcttatccttctcagtgcctcaaactagagcctgttcagacatgttataacagatttgtatcagtttattttggtgcaaaaactgtgaaattcatgcacaatttttccataatatgtatttttccatgagcttcttgaagaccacttgtactagaaaactgtattcaagaggatatataaaaggattgtagatatgcaagtgccatttacttctggcatgcaaggatggttcaacatattcaagcaaatcaatgtgatataccacttgaacagaatgaaagatgaaaaccacatcatctcaacagatggagaaaaatcatttcacaaaattcagcatctgatcatcatagaaatcttaaacaaaatagatggagaaggaaatttacctcaccaatagaaagaccattgatgaaatgaccaatgtggagataaccaagcagggaaaatagaatccttttcccgtaggatctcacatgatgcaagaacgttctcactttttctattcaataaatactggaagtcctagccagagcaatgaactagcaaaagaaatgaaatgcctcaaaatcagaaaaagtaaaattatattttttgtagatgacatgatcttctgtgtagaaaatcacaaagagtcaaccaaaatactactgtgactaataaacacatcagtagatttgcacaatacaatatcagcaccaaaaattcgttgaattttcatacattaacaataaacaattttaaatgaaaatttaaaaacacttccatttgctagagaacttaaagtaagaaataggaataaatggaaagaagtgagaaattcatacattgaaatctacaaacattgatcaaaatgattaaaaacatatataaagatataacccatattgatgttttggaaaaattaatactgttaaatgattacataacccaatgtgattttgattcaacacaatacccataaaaatctctatcagtttttgttgaagaaacaaaaaacagactgggaaaggtgctcacctctgttggccaggctgctctcaaactcctgatctcaagtgatctacctgtcttggcctcccaaagtgctgggattacaggtgtgagccaccgcacctggcctaatcctcttaacataaacactttaatctcaacaaatacttgaactcaatgttaagtcaactcaaactgaactcaatgctgatttgaatctaacatcaattgtgcttgatggtttgctatactcattgcatttgaaattattacctcaaaaatgaatttcctgatgtcctgcaaggagtgacctcagactaaagatcttgccacacatatgacttttgtaagatctctgtctagtatggattctctgatgtgtaatgaggcatgaacctgaaataaaggctttgacacaatcatcacccttgtgaggtttctttcttgtatgaattcacctgtgttttgcataagatgaagcttgactgaagaccttgccacaatcatcacatttgtaaggtttctctccagtatgagttcgctgataaactgcaaggtatgaacgaagtctgaaaaatttgccacatttataacacttgtaagttctcacttcattatgcattctccaataatttgcaatggttgtagcattactgaggactttgtgacaatcattacattagtaaagtttccctatgacatggattgcttgatggtgaataagtgttgactgaccactgaaggctctgtcacactcatcacacttgcacggtttctctccagtgtgaattctagtatgttgtgccaggtgtgaatcacacccgaatgccttgtcacaaaccttacatttctatggtttctctccagtatgaactctcctatgtatttcaaggcgtgaattgaaattgaaaactttgtcacattcttcacatttgtaaggtttttctccgatatgaactctatgatgatgttcaaggtttgattttcaattaaaaaccttgccacattcattacacttgtaaggtttctctccagtatgaagtctatgatgacatgcaaggtttgatttgtgattaaaaaccttgccacattcattacacttgtaacatttctctccagtatgaatgaccttatgcattacaagagatgaattttgaacaaaggtcttgccacactcattacacttgtaaggtttctctccagtgtgaattacaatatgttgtgccaggtgtgaatcacgtctgaaagccttgtcacaaaccttacatttgtacggtttctctccagtatgaattctcctatgtctttcaaggtgtgattagcgactaaaaactttgtcacattcttcacatttgtaaggtttctctccagtatgaagtctatgatgacttgcaagatatgctttttgattaaaaaccttgccacattcattacacttgtgaggtttctctccagtatgaattgccttgtgaattacaagggatgacttgtaactgaaggtcttgccacactgattacacttgtaaggtttctcaccagtgtgacatctatgatggtatgcaaggtatcgcttctgattaaagaccttgccacatatatcacatttatattttttctctcctaaatggattatctgacatttttttaacagtgagctacaattaaaggctttgccactctcattacattggaaagatttttctctcatgtgtgcttcctggaggaaattattcccatacttattagaaatatgggttttaggaatacaagaaattctttgggatgctgaaactgaggaagcatcattgacagacttctcatcttgactatcaattttccctttgctctgcaatatatgcagttcaggcagatgtgaatgaaagcttgatccaagctgatctttaataggtttgtttccagcatgcctttgatcatatcagtctgtattacctgtcaacttttttatctctgtcatgagtgcttcatggccatttctttcatcttcttgccactgaaactcaaagtcctgaaaatctttctcaatttcctggaaggaaaaatctccagtgtgatgacttgcttgtctttgcaatgtccctgtgtggaacacttctgtattgccttgccttcttgatgagaacttccttgtcatgcatttggaagagatagctacaaaatataaacaacaataggtttccaattaagtgcagatggtaaataatactgaaatatgtaactaggacacaaaaaacaatatttattttgaaattcccaaacatgattttcaaagtttaagaacacaaaaggagtaaggttctttaataaataaagggcgattacaagtcctttaaatcatttctacagaagcctattcccaatatcatgacgaaacactgacagggcacaaacatgtgtaagcctaaagtaaggagtgtttttccactgtgaccctaaaatgtatcacagtttgcaaaaagcatattactgtcacatcaaagaaggaaaaaatatatattcttcatatttatagcatagagtatacaaataaatgctaaaggaccggataacgtactatattggtaaataatccacaacaagctcttgtaaggataatcaaaatcaatggaaattctgtattgtcaaacaatcacagcactgagaagataagaaaagaatacaaaaattagccaggcatggcggcccatgcctgtaatcccactacatgagaggctgagacacaagaatcaccaagaggcaaaggctgcagtgagtcaatatcgcaccactgcactccagcctggatgacaaagtgagactccatctcaaaaaaaaaaaaaaaagcagggcatggtggctcacacctgtaactccagtacttgtttgggaggcagaggcaggtggattacctcaatacaaaaagtagccggtagccaggcatggtggtgggcacctgtaatcccagatacctgagaggctgaggcagaagaattgcttgaatccgagaggcaaagattgtggtaagctgaaatcgtgccactgcactccaccctgggcgacagagtgatactccatcccccaaaaaagaaaatgtgaataccatatttttctgaataactgtgaaaaatttcctatatccatgtggaacaggcactttgtgactttttaaaaaaatgtttattatttttatatttttgagatggagtcttgctctgtcacccaggctggagtgcaatggcacgatcttggctcactgcaacctttacctcctgggttccagtgagtgtcttgcctcagcctcctgaataccttggattacaggcaagcaccagcatgcccggctaatttttgtatttttagtagagatgggatttcaccatgttggccatttgggattacgggcataagccactgcacccagtggcactttgtgacattaatgagtgcagtgtgtcagttatattgcatgccacatactgaatactcacatgtaaagtcataaaattcaattaacaaaatattgtaaccaacgataaaacaagaaaataatatgtacatttatacagcctgcagaattgtaaacaatttccacttaagaaaaaagccaaaacttctacttaccaccagcacacaatataagaactgaattacatgttaagatcactaccttctgatatatgaggtcaagaaaatacacagcattgccaggcgcagtggctcatgcctgtaatcccagcactttgggaggccgatgcgggcagatcacgaggtcaggagatcgagacctggttaacacggtgaaaccccgtctctactaaaaatacaaaacgttagccgggcgtggtggcacatgcctgtagtcccagctactcaggaggctgaggcaagagaatggcgtggacccgggaggtggagcttgcagtgagcagagatcgcgccactgcactccagcctgggtgacagagtgagactgtctctcacaaaaaaaaaaaaagaaaaaaaaaagtacacagcatttaaacgaataagaattgactaattgccaggcgtggtggtgcatgcctgtaatcccagcactttgggaggctgaggcaggcagatcacgaggtcaggagttcgagaccagcctggccaacgtgctgaaaccccatctctactaaaaatacaaaaaaattagctgggcatggcggaaggtgcctgtaatcccagctacttgggaggctgaggcaggaatcgtttgaatccaggaggtggaggtgtcagtgagctgagatcatgccactgcactccagcctgggcaacaggatgagactcaaactactcaactacttctcaaataagctttggtagatgtggtattctctaacaggatgttcctgcagatgcagacttggagagaatttagtcatgggtgttgactacctgtgaatactaaaagtgcatttataaagagacattaaagagctcattgcctgttcctctttcccccatgtcaggacatggcaggaagatggctgggctaaaccatgaagaatgctctcagcaggaaccaatttggctggcaccttgctcttggatttcccactttccaaattcatgagaaataaatttctgtgtctgaagcctcccagtttaagctatttctttttttgtttgtttttgagacagtcatgctctatcagccaggctgcaatgtagtggcacaatgattctcctgcctcaagagattctcccgcctcagcctggagtatcactctgacgcccaagctggagtgcagtggcacagtctcagcccactgcaacctctgcctccggggttcaagtgattctcctatctcagcctcctgagtacttgggataacaggcacttgccactgtgcccagctatctgttgtatttttagtagagatggcatttcactatgttggccaggctggtctcaaactcctgacctcaagcgatccacccaccttggcctcccaaagtgctggggttagaagcattagacaccagggccgaccagtctaagctatttttgacaggacagtgaaatgcctgagacaggaaaaggagcatctcatcatcagcctcacagaagacttacaaatcttattaaacaaaggaagttaacagtctgtactgtaaaacttgcaatacttgaagccatctaataccactaacaagttttcaaaaccttaaggcaagcagggcatggtggctcgcgcctgtaatcccagcactttgggaggctgaggtgggaggatcacgaggtcaggaaattgagaccatcctgcctaacacggtgaaaccatgtctttactaaaaaaatacaaaaaattagccgggtgtggtgacacgcacctgtagtcccagctacttgggaggctgaggcaggagaatcccttaaaatcaggaggtggaggttgcagtgagccaagatcgcatcactacgctccaggctgggcgacagaccgagactccatcttgaaataaaaaaaagaaagaaagaaagaaagaaaaagaaatgaaagaaggctaaagagtaactccaacccacaaatatatataaagttctccagtgaaggtaaataaaaggacagataggccaagtgcagtggtgcagcttatagcttgcagtgaacgccaagaatgaagtactcagataattccagctgagtggggcggggagcaaaccttctgagagagtgctgccccagaatccgtcctccaagtatttattgaaagggcttgtttagaccggtcgcggtggctcacgcctgtaatcccagcactttgggaggccgaggcgggcggatcacgaggtcaggagatcgagaccatcctggataacacagtgagaccccgtctctactaaaaatacaaaaaaattagccgggcgtggtggcgggcgcctgaagtcacagctactcaggaggctgaggcaggagaatggtgtgaacccgggaggcagagcttgcagtgagccgagatcgcaccactgcactccagcctgggcgacagagcgagactccgtctcaaaaaaaaaaaaaaaaaaaaaagggcttgtttaaactacacttcagacaaacaaaaaacatacaccatggagctctttgcagtcgggtcgtgaggcactatggccttgtaaaagcactcagaccacattcacaggagactgtttcagcgtttcttatcacacattctactccttgtcctgatttcagggtcaaggagtgacagtctcatacacaaacaacatacacacagtgcctcagtaattttccattcctcaatctcaaatgccttgtacataagcttatgttgccgcgcatccatcaaagttggttcacacccgtaatctcagcactttggcaggccaaggcaggtggatcacctgagtttgggagttcgagaccagcttgaccaacaaggagaaaccttgtttctactaaaaatacaaaattagccgggcatgatggtgcatgcctgtaatcccagctactcggggggctgtggcaaaagaatcacttgaaactgggaggcggaggttgcagtgagctgagattgtgtcattgcacttcagcctgggcgacaggagcaaaactttgtctcagaaataaataaataaataaataaataaataagtaagtaaatagacagatacagaaacctgtataagtgtatcttttctttataactcaacttttttttccaattatttagcagaaaaaagcacaaaaaaaacactgtacatatatgttaatgaaaatgcaacatatacagaaataattctgacataaataacaaagagttctagtggagaaagtagtctttgcaggttatggaaatttttgtttgtttctttctttgtttttttgagacggagtcttgctctgtcgcccaggctggagtgtaatggtgccgtttcggctcctgcaatctttgcctcttgaattcaaagatttcagcctcttgagtagctgggattacaggtgcccactgcacttcgaattttcagtagagacagagttttgccatgttagccaggctggtgttgaactcctgacttcaggtgatttgcccaccttggcctcccaatgtgctgagattacaggggtgagccactgcacctggccaggtaatggaaatttcaagttttgttattatgctataacttcaagatgtttaacacaccttcaacaataacctccccctaaatatctatacaacacacttcggttcttcatattgaaaggaatggacactaacgtggttgttatgttcacattggaatcatgcttaagccacttatatgtttactaaaaactaaaagacaaaactatttaaaataataataatggctgggcacggtggctcacgcctgtaatgccagtactttgggaaaccgagacaggtggatcacttgagatcaggagttcgagaacatcctggctaatgtgatgaaaccccgtctctactaaaaacacaaaaattagctgggcgtggtggtgagcgcctgtagtcacagctactcagaagctgggacacaagaatcgtttgagcccgggaggtggaggctacggttagaaagatcgcaccactgcactgtagcccgagtgacagagtgagacttcaccacaaaaaaaagtaaataagaagagagtcaaagcatgtctacagaaaaaaagtaattaaacacaaaaagtaggaaatgagaaatgaagaacaacaataaaaacctacaagaaatacagataatatgtaacaaaaacgcaacggtaaggtcttctccatcagtaattattaaaatgtaaatatttaactctgcattcaggaggcaaagactggctgaatcaacaggaaccaactacatgttgtccacagaagactcatattagccctaaggacacacatacgctaaaatttaaaaaataaaaaccaataattaggtatgggggttggggcctataatcccagctactcaggaggccaaagaggacctcttgagcccaggagatcaagaccaacttcaacaacacagcataaaactgaaaaataacctggagaaagcagggaaggatagtctgctggtttaccattttgatccctggtacagacagctcctctatttgtgccccctggcttatagcacaggctccatagctactgagtcagtgaatgaatgagaatgactgagtgatactagtatgtcttctctggggtctcatgtgtgccagggtcctatttgaccttggaatggtcttcatcgtgatgagggagctgagcaggagcagctgagcgggacagcccagagtccctcatgcagaccactctgcttgcccaaccggtaagaaggacaagtgtatgttcactcagaaacacatctggctgatccaacgggtcactgcctgaccctgagcaaacttacattggcaattaaagaccctaaactccgcagaaagaggagaggcttccttgctgcccggactctcaatgaagaaaaattcctggggtctaagacttctgacttggcaatgacattggcttaaatattcccagactcaaatccttgggtcttagttgggtcttgggatggtgcaaaccgatagaattgcaggcaatgagtgtcagaacagaacagcggacaggaaggtggaagacttgagggaggggatcaaggacaggcaaagaaaccactcccctccctcagacgcccacctggggaagcatcaactttgtcattctagagaagacaacgggaaaggaaggactgtgcatagggtaggtgacggtgtgtgctgggtggagagaaaaacccctttttctaaatgtgactccaatagctcagcccatttattctactaactgctgagcacagaggcatcctgtgaggataaatacggcttttccttcctccaattcctgaatctccaggccatgactagtgctgtaaccctcaaaatcccttcccaggacccagcgttccctctgtgggaaaaatatctgtgctccacatttagattatagcttatttatttattaacttatttatttatgttgagatggagtctcactaagttgccaggctggaatacagtggcacgatctcagctcactgcaacctctgcctcctaagttcaagcgattctcctgcctcagcctcttgagtagctgcggctacaggcgtgtgctaccaagcccagctagtttttgcattttttcaatacagacagggtttcaccatgttggtcagaatggtcttgatctcttgaccttgtgatctgcccgccttggcctcccaaagtgctgggaatacaggcataaactaccattcccggccatcatttttcatcttttatttttatttttatttttatttgagacagagtcttgcactgttgccccggatggggtgcaatgatgcttccatccagaagacagaagaagaaacctctgtcttctgggttcatgtgattctcctgcctcagcctcctgagtagctgggattacaggtgcataccaccacactcagctaattttttttttttttgtatttttagtagagacagggtttcactatgttgaccaggctggtgtcaaagtcttgacttcatcatccacctgccttagcctcccaaagtgctgggattacaggcgtgagccaccacacccagccccacatttacattataacattttgatcctcggctccccagctgccttctgactgtgtgtgtgggtgtgtgtgtgtgactgtgtgtgtgtgtgagtgtgtgactatgtgtgtgagtgtgtgactgtgtgtgtgtgtgcacgtgcgcacacactcatgtgttgtgacaggcaaggaaaagccagtagagagtcatcgccattggcctggcaggaggaggtggccctcaggctgcagttcacggtgctgtttgcactctgatccttggaagaatctttcctgaagtcacggagcctccagctgctccagaacagaactagttgtgtaggagtgtgtccttcatgcccctcaggtccctgaccttctccccacccttcctgaagggaatccaggaccctcactctgagtgcatcacctgctggtggcaaagcccctgcccatcatggccaaactgggccctggtgatgtgcagagcgtggagacccgggagctggagtgaggcagttgacacagatgacaaaaatgcagatgcctcggcactgcctgaggacacagggtctggtctgtagggcttttctggctttagtgaggtcttctccttttaatttgactgaaataaatagttacagaaagttcagatcaattagagttgaaatttccagaagaaatatgggaccatcctcacacttgccccagcccctcagtcttccctgaggacacctcagcatctaaatcacaactccagagtaggtgctgcagttgtcctgtggccaagatgagaactgtgcatcctccaaaggggagacacaaaacactcaaaataatccatgcagaagggcgtttctgcctgggcatggtggcccatgcctgtaatcttagcacattgggaggccaaggcaggcagatgacctgaggtcacaagcatgagaccagcctggccaacatggtgaaaccctgtctgtactaaaaatacagaaattgggtcgggtgcggtggctcatgtctgtaatcctaggactctagcactctagcggtctggaaggccaaggcgagcagatcacttgaggtcaggagttccagaccaccctagccaacatggttaaatcccatctctactaaaaatacaaaaagtagccaggcttggtggctgtctgtaatcccagctactcgggaggctgatgcaggagaatcgcttgaacccaggaggtggaggttgcagtgaactgagatcgtgccactgcactccagcctggatgacagagtgagactcaaaaatatgccaggaactgacatgacccactttagatttcgctgtgatgtcctcatacagagaaaggcctcgaagatggtctctgtgtctaactgaatctacacctctgtttctttcattctgcctttttttgttttatttttggggtactgcacctatttaaaattctagttacaactgaacactcctttctcacagaagaaaagccacgcccagacacgcactctattttgccaatcatttcaggggccagggtcactcgggttgagcttttctggtgtagcccctcatctccaagttacagggaggctcactggggccacaactgataagtcactgtcctctggctgaagaggggttgcagagggaagctgcctctgacgccatcattataaaagtcaccacacttagacacaggagtttggcaactctcattctcatctgtataatttaaacaaattttaaatttgttaccttataaacagagaaaacaacatgtcatcacttcatcgtcacatccaatcaactcaccgctcatctgcacccagggtcccccttcgtcttcattactgcttccctccatcattctgtacatagctctcattctcaccttctctgaaattgggattagccaggtgtggtagcacctgcctgtcatcctggctccttaggaggctaatgtgggtatcacttgagcccacaaacttgaggctgctgtaagccagaattgttccattgcactccagactgggcccaggagtgacaccctgtctcttaaaagaaaactttcaagtcagagacatattgagtcactagtgtagcttcaaatgcattacaaaatcagacacaaaatatctcccctaatttgtctccatttccagaatttacctgatgccagtgcacattaatgtatgactttcatatacagtttctctgatctggtccacaaagagctaaacgtccatccagatgtggcccctgaacaatccttgctgcccagcatcactgacaccacggagcccacaccccatctccatccatgtctggtgtgagcccttccaggaccatgcccagtgcagcctcttcctaagctcatgtcactaggttataagagatggaatttaagtgaagatgacagggactgagaaaaggcataagtgaatgcaagcaaatgtgtgaggcaggatgcttcagactcacaggagactgactactacaatacctggcatttcagaaaggaaagagacagattaatccaccgagaaatatccacttcacctgaggaagagccaccctggctccttttctttgctcttcttggtgtcttcctcatgtaacaggagtttttggaaatcaatcctgtttgtgaaaaaaaaaaaataagagatttaatgtttagaaaccactcactcctttcctgtgacaaaacacacacacaggggagacctcacccagtaggaagatggtcctctgctgcccaccacaccagagatcatgccaagataacaaagccccacaggaagacctacaagtgtaattttgacccgttttcagatcttgctcccctcctggaaaagtccacacacacactgcagcaggacacagaccttcagggcacagatctggccctaaccaaaccccatgcagagcacagccccctcagctccctgtggatcacaggctgatctcagctctcaacatggaggaaactgccttgattttcaatgctggacacagatgagaatcacctgcaccattgtaagaattattgagggtgggtttaatcctatgataatagcaatctctgataaaacagcttaaaagatgtatttgcaaaatgcctgagaaccctaatgtgaagccagggttgagctccactcagacagcgccagcccagcacagccccaccttctggctctgctctccacttcgggacttgttcccaccaggatccagtgaaaagcgaaggagcaaaaagaatcacaaagaacaggcaacatggaccagaggtgggggtgaaggtggagctgccatgtcaaatgggggactgtgggtgatcacaaacgtttccatagagaaagcaatgtcagaacaaagacttagggatgaaacactgcttgtcacttgtagctgaggggccagagagtcctgggcagagtgacatctcaggtgaaggcactgagacaaaagcaacctcagtcccagaaaaaggaaagaggtgtgcgtggctggagcagagggagtgaggaggacacaggcaggagatgacctcagagaggtcctggaagtgaagatccctagggacgaggtcttgaaacatttttctcccacacctcaaaagaattttggaaatgatgtatttcctcactcctttcatgtatacatgcaactttctctttacattgtaagttacaacactcacaaatagtggaatttatttcccatatttaaaatacatgctgtcagtttcagctaagctcccagaagtacactgtcgccctcatctgagaggtgtaggactgcaagggaatgtgtttgggggttcaagaagtcacttatgacttcttgacacatgaaggtggagatgcctgtttgatgtcccagcagagagctgaagagacaactggacacagaattgtggagctcaggggcgaggcctgcaggggacgtggagtcatacaggtgggctaaagcggtgagatgataaggttcaaggtgatttgattctaatctcattttttccttcttgtgcttttgttttttacatttttggaggactgaaatccatttaaaattcaaattacagctaagcacctccctgtcctaaaggaaaagccacacactccattgtgcccatcatttcaggggtcagtgtcactctgagcttttctggtcttctccctcacctgtatattacaggtgggctcagtgaggttcacagcgggggacgtttcaccaagttatcctgagaagctctgagttttgtaagaaggaggagtcgctgattttcatgtgatggccaggaagggtcaacaggctgcgttggtcatcttcctctataaaattccaggactggccacatgtggtggctcactcctgtaattccagcactttggaaggctgaagcaagtgggtcagttgagcccaggagtttgagacaaacctggcaacatggtgaaactccatctctaacgaaagtacagaaaattagccagacatggtggtgtgcatctgtggtcccagctatttggcaggctgactgggggggatcacttgggcctcagaggcagaggttgctgtgagccaagatcgtgccactgtacttaagcatgggtgacagagtaacactccatttcaaaaaaaggaaaaatattccaggaccatcttttatatccccaagcaaaagaaatgtctctttcaatgtccaaaattctgatggcacgaatcctaaacatgtaaatattttcccagaaaaatgacagtaatacattcaaaataaaaacaattgtgaacacatagctataggtttttaaaacactgaaagagaggcagtggtagaaataagctgtgagcaaatgttttcttcatgaacacgtgggctctgctgaaacaaggttccaagtcaatccagcccatccttcaacatctgcaaagaatattatggaccagaggaacttgaggagaatgtttacttagaaggtcacagttcaccattttatcagatgacataaggaaagaaagtagagtaacaggctacttgaactaaatttttatgttagcataaagaaaataggtcctagggtcaggcgtggtggctcatacctgaaatcccagcactttgggaggccagggcaggtggatcacctaaggtcaggaattcgagaccagcctgaccaacatggagaaaccctgtctctactaaaattacaaaattagctgggtgtggtggtgcatgcctgtaatcccaactatttgggaggctgaggcaggagaaccacttgtaccctggaggcggaagttgcggtgagctgagatcatgccattgcactccagcctgggcaacaagagtgaaactccatctcaaaaaaaaaaaaaaaagaaagaaagaaaatagattcttgacatctttatcaaatatgcattgaaacaacctaaaatcatttatcaggtactagaaagtgtttccaatatgtggtacagactagaaagcatgcagtcttcaatgtaaactggacacaataaatttcatagagaaactatattaaaatggttaaaaatatatacatctaatgaaatgtggggtcaaaggagaaaattttgaacacatagataaaaacaatgatgtgaggttgggtgtggtggctcacgcctgtaatcccagcactttgggaggccaaggttggcagatcacaagatcaggagtttgagaccagcctggccaatatggtgaaaccctgtctctactaaaaatacaaaaattagcctggcatggtggcgggggcctgtagtcccagctactcgggaggctaaggcaggagaatcacttgaacctgagaggtggaggttgcagtgagccgagatcgcgccattgcactccagcctgggcaaaagaatgagactccatctcaaaaaaaaaaatgatatgagctcataaaattctaccaaagcttatttgagaagtagttatttattttatgtttttgagatggagtcttgctctgtcacccaggctggagtgcagtgacatgatctcagctcactgcagcctctgcctcctgggttcaagcgattctcctgcctcaccctcctgagtagctgggattacaggcaccagccaccacacccagctaacctgtattttagtccagatgaggtttcaccatgttggccaggctggtctcaaactgttgctgttacattgggactgaatggaggaggacgaacacgggaatggagtatggagtcaaagacaaaagtatctgtttgcaagaagggatcgggggctctttgcttctagagaacaagagccctgagcttctacagcccttcatatttattgggtagagtaaacagagaggaaggggtaactgtcagtcaactatttaatttaacacaggtgtaagtgattgccttttttgttcaacaggctccagatgtttctgtagataatttcaaggaacatggcacctgggatgtgactgccctcagcattccttctggtggcagattcagttgtcaccttgccaactgctttcacaagaacagtttgctgtttgctcatacagcctccaatggtatactgagttgacaaccctcattccttcagtgtccaacatctccccctttatgtttttgcattaattgaataaaggtaattccaggctgtgcaactttcaattgccagttggtggtccacccagtcttacagactataaacagaaaacagagacataataacattgttcctataagtctaaaagagacattaaggtgatgtttaacgtaggtctaaggattgagactttctaaaccctgctggaattctgtccaagtttctaaagaaggttgaaactcttgagtctgcttattcaagtcaagaattttactttgtatttcactgatatcaaaagcgacattggatgtaaaagccccctgaatatgggcttttacaaggtcccatggatattcgatttggttatattccaaattggctacacaaatgtgagtatggttaaaatgacagtgcaattgctgttgccattgtaaactctgtatttgctcccctaaccacaaaacagtagtctttaacattgccacctaagtttgtaattcagtattaatttgattttgaagcatccatgcctggtcggctgtgcacatccaattttccatatattgggctgtttaaacagagctgtgcagtgctactgaggacaccacaacagaggttattagtgtgactaaggaaacaatagcaaaaattaccatacccaagactctaggagcatgatgagtgagctgagtgagaaggagtttcacaaagtgtaaagccagggcagcagcccaaggttcagacagattgacagggacccatatccaagaatgacatttaccttcttagaaaaacacaaactgtaaattgagtggtaatattccttacaaaggtaacattaaaactgtgttaagtaacattattagtattggagagtgtcccaacccagatgctgccgttcgtaaataggagtgctgctttccatatcgactcctgaattgggcccctctttccttgatgctgccactgaggcaaaggcgagctaaagcctgctctgtgccaagcaagccgcacagccgactgggattgaatcccagtgtgatgtagtgaagagatgttgaaggtctgccaccagtgccagcgaagtttgtgccatgaggtctgattctcatctcttccatctaattaaccacggggtccccagtcaccaatgtctcccattagcatagactgttgtctagctaaaggaccaagacattgggtccaaggaggggggtggtgagaactatcaaagggagcccattctgtataatcaatacaattttggtgatgggggcgggagtggttgatgagcacactagttatattaatagagctaaggcctaataaatacataacttttccatggtgactcaaccatgcctggggttggactgcaagacaactgtggttgagtgacatatctttggtgatgcataaagggagtccctccaatggggcggtataactgatgctattgttgtgagagtttaattgctctatatcagggggagttaggggccctagagcccacgctccctgatcatgatatacctcaggaggaatgtcactccagagtacaggtcacactacagggtgattaggaacatatgcccagtatgttttggcctctacacaggggaaacatacctcacaggacactactgctaacatggccaagcacatggatgctccagcattttctcagcttcctgctttgttttcttgatctgtccccatgttatgggggtggatgtcagtgtgactccagtcggcccttgctccatctttgcattcaaattcagctggctcacgactcctactggagggaccaggtccacggttggccaacgtgggtcctgctagtctcccatttcatggtcgcacacacctggagggcacccacatggtttgtccatctcctgtaaaaacacaagcatactctcgtccccacatcagcaattccaccgggcctttccactgtccctcatctggagatttccataacacctttgggtaaacttgcctcttttcctctaacacttgccaatgtcgttctgctagtcttaccgtctgtaccaggagtcaaaaagtttaaagtaagcaaggctaatgtaattttgcctgaggtggtagttggtctcctattccccctttttgttttttcaacatacgttgtaccgtttgatgtacccactcagtaaggccttgccctcgaggattgtaaggaattcctgttttatgggtgactgcccataactaaaaaattttgaaaggcatcactagcataagcaagttcattgtcagttttcaattgtttagggacccccctatatgggcaaatgacaacaatgtcaccaggcatgaccagctatttcccctgtttggcatgtggcatgcagcatatgggagtaggagtctatagtcacatggacatagctgagtttgccaaaggtggctatattggtaacatccatctgtcagatttcatctggagccaaacctcgtggggtgcatccttctacacgggcaacaccagggacatactggcaagtggggcaggcttgcacaatagcttaagcttggctgcaaggcagatgaaacatacgagtaagtgcagagttgttttgatgcagtaatgcatgagaagcttgggcttgttgaaatatagaaccgatcagtttatctgctctatcattacctagagatagtagtccagggagttgtgtgtgagagtgaatatgagaaatatgaaaaggggaagcatgagagcaaatagcttattggagtcttagaaacaagttaagcagttcttgttctagggtactcttaatagtggcagtctcaatgtgactggctacattcacaacataggctgaatcacagacaatattaataggagataaatctggaagctctaaaaccagaataactgcgattaattctgaacattgagctgaaactgcagaggtctttattgtttgagtgtgtttaggtccagaaacagctgcgtgaaatttggaggaaccatcagtaacataggtctgtccacctgaaataggcctgtgatgagtaatcacaggaaggatgaaagggtgaactttagaaaattgcgagattctttttttttgattgcttttgtcacccaggctggagtgcaatggcacgatcttggctcacggcaacctctgtctcccaggttcaagcaattctcctgcctcagcatcccaagtagctgggattaaaggtgcccgccaccacaccaggctaattttttaatttttagtagagatggggtttcaccatgtttttcaggctggtctcgaactcctgacctcaggcgatctgcctgcctcagcctcccaaagtgctgggattacaggcgtgagccactgagcatggcctaaaattgcaagattttgtctgatggataatggttacctattattcccacaaaatctgcgagagtgatttgccaaccagtcaacatctcccaagctgcagcctgctgtcaggaatccaaaggaacaataattttattaggatcatatcctgtaagcattcctgatctatgcctgcctattgtcataagttgtataattaaagaaagataaacttacaaagttttcactgtctgattggataaaaagagccattctattaccattatggatttctctatgaattggcctaaaagtcctgttggacaatgaggggtaggaagaataaaaaaagcaaaggcttttgtgatttcagccgaaaggcctgtcgtgttgaagcatctgctctacaagctgtaactcagcttctgcctctttagtaagttgccaaggggaatctaatgaagaatctccttggagggtttgataaaggtgtatgagttggtaagtagcaatacctagcatcgtgcacagccaattaatatcccctaataattgttggaaaccgttcagagtttgtaacctgtccctatggacggctactttttgaggctgaacatttctttcagtaaaaatagtacctaagtactggtatggggcggttctttgtaccttttcaggagctattttgagattccattcagttaaggcctgctttatttctctgaataactggtgtaatatttgaactgtaggagcggccaaaagaatatcatccatataatgaacgatgtaggcagtgggaaacatattctgagagtcctttaatgctcttcctacaaaatgctgacttaacgtaggtgttgagcatgccctggggtaaaactttccattgataatgagagacaggctctctatgattaatagagggcacagagaaggaaaatcgaggcttatctttctcatgtaagggtatagtataaaagcagtctttaagatctattactacgagaggccaatctctaggaatggctgttgggaatggtagaccttgctgtagtgcacccatcggttcaatctgtgcattaatagctctcaaatcatgaagcagtcaccattttcatgacttttttgggatcacaaatactggtgaattccaggggctgactcctctgtatgtcctgaatccagttgctcttttaccagctgatggagttgagtcagtttcttctgtgatagggggcattgattcactgccacacaggtttatcagtcacagggaggctcactggggctcagagcggggacattttcaccaagttaccctgagaaggtctgagatgagtgagaaggtgtgtctgaattcttacatggaggcctgaaagagctaatgggaagggttggtctttatcacccctatccttgaaaattagagaagcatctttcatatacctgggctaaagaaacttcttttgcaacgttctgatgccactgactcccaacatttaattcttccttacaagaaaatcacagtaacatttataaactgcagaagtgtgaacacacagctattgactgtgaaaacagtgaaagaagttcagccgtagagctaagacataagcaaattttttcaatcaagaatacatgggtggccaggcatggtggctcaggcctgtaatcccagcactttcagaggtcaaggtgggtggctcacctagggtcacgagttcaagaccaacctggccaacatggtgaaaccgcatctctactaaaaatacaaaaaattacctggtagtggtggtgggcacctgtaatcccagctattcaggaggctgaggcaggacaattgcttgaacccgggagacagcagttgcagtgagctgagatctcgccattgcactccagcctgagcaacaagagtgaaaatacatctcaaaaaaaaaaaaaaaagaagctgggcgcggtgactcacgcctgtaatcccagcactttgggaggccgaggcgggtggatcacctgagtgggttcaagaccagcctggccaacatggtgaaaccccatctctactaaatatacaaaaattagccgggtatggtggcaggcacctgtaatcccagctactcagggggctaaggcaggagaatcgcttgaacccgggaggcaaaggttgcagtgagctgagatcacgccactgcactccagcctgggcaacaagagcgcaacttcatctgaaaatgaaaaaagagagaaatggagaagaaccagaaagaaaaaagaggaaatctattacacaatgagaaaaaaagcgcttttgatattccttttgttttttattttttgtttgtttgcttttttgagatggagactcactctgccacccaggctgcagtgcagtggcacaattttggctcactgcaacctctacctcctaggatcaagtgattctcatgcctcagcctcccaagtaactggaactacagatgcacgccaccacgcctggctaacttttgtatttttagtagagacagggtttcaccatgttgaccagggtgcttttgaactcctgactttaggtgattcgctcacttcggtctcccaaagtgctggaattacagtcatgagccaccacgtccggctttgatgtcccttttaaaaagtattatgggctgggtgtggtagctcacacctgtaatgccagcactttggaaggccaaggcgggtgggtcaattgaggtcggaagttcaagaccagcctaacatagagaaaccctgtctctgctaaaaatacaaaattagctgggcatggtggtgcatgcctttaatcccagctacttgggagactaaggcaaaagaatcgcttgaaccggggaagtagatgttgtggtgagccgagattgcgccattgcactccagggtgggaaacaaaagcgaaactccgtctgaaaaaaaaaaaaagtactatgtaggagaagcgtggtggctcatccctgtaatcccagtactttgggagtccaaacaggaggatcatttaagcccgggattttgagaccagcctgggaaacacagtaaaaccccatttctacaaaaaacaaaaacaaaaaaacaaaaaaaaacaaaactagccgggcttggtggctcacgcctgtggtcccaactacttggtaggctgaggtaggaggacagcttgagcccaggaggtcgaggctacagttagagatcacgccactgcactccagcctgggtgatagagccagacactgtttcaaaatattatttaattaattaaattaaaagtcacatgtaataacagaaagtgcttttgtctccccacttcactgccccacttcctatgccaccctgggaaaagggaagagagtgactcacaactgaataagtcactgccctctggctgaatagggattccaagtggaagctgacctctgatgccaagatttatagaatgtacatgactcatagataggaattttaaaattctcaatctcatctgtataatttaaacaagtttttagttattagattatatacacagaagtcaacatgtcacactaatcatatccaatgaactcacccactcatctgaacccaaagtccccaccccttttattcttttgagacagggtctcactctgttgaccaggttggagtgcagtggcatatctcggctcactgcagcctggatctcctgggctcaagtgatcctcctgcctcagcctccagagtagttgggattacaagtgcgcaccatccccttctttggtctatttcttctcttccacctcttctgctccatcctcacaacttacttaacctcttgttgcttcttcttcccagtctttcgatcgtcctcaatctccatacattaccacctcttctcccacctctgcgcctcctctgctctccctgttaaactctctcttccctgttaaaccccctgtccccactctctggcacccccgacctccaggtgtcctccctgctgtggttctccctcttgccaccagcaccactctgctctgtctgccctggctccaaatccctcctcctctccctcactctgatgagccaggtccccctctttgctgcccctctccctaccttgctgtccttcatctctctgtacatctagcttctctccacatttctccagttttctcctcctgctatcttaactttttcttttcactcttgctgtctcttggcaaatccctcacccatcctccaccttgccatctgttatgggcctttctcattgttctattctctgtctcgagttttctactgcccttgctcggtctcctgattcctttggcccacacaatcacaggagagttttgagtaagacgcctgcatcccagaggagtgcattttccaggggctggggctgggcaggcaagaacaccccttgtcacaggacaagccctgggcacctccccaacgcggactcagaggaagcggcgactgctgaggggagacctggcgagcagcagggcccggcacgaggagggagttagggggcgacggctccttaagacaagggtggggtctgcaggatcccaggaccaggcagaggatgcggcctcctcgggacgggggaggcggcgctgcgctccagggaccgacgagggtgagggtgggaggcgcccagggtgggaatccacctctcgggtgaggactttaaaaagcacggggtggagggagtcagaaaatagttacaaacaggaaaactacgagatacgaagtgtatacgttgccctatagcagaaagaccggggacgggtctagcctcagggcgactttaaacccaaaaggaagcgacttctggactctcaccgggacgtcaaattttgctctggggattagccgggcctggtggcgcatgcctgtaatcccagctactcaggaggctgaggcaggagaatcgcttgaacccaggaggcggaggttgcagtgagccaagaccgagccactgcactccagcctggcgacagagcgagactccgtctcaaaaaaaaaaaaaaaaaaaaaaaaaaatttgctctgggcgaaggaagaatggtagaaatttccaggtatgtggggaccccacgtcccctgggacagaagtcccagggacctgcggagcgcagacataacacaacacagagcaaaactcaccgctgcggtgactttcactccacgcgatccgcttcccggtttacgctaaactgggcgctcgggacagaagccaggtctcggcgggacatggcagggggtgggcggggcctgggcgaggtgggggcggggcgcgaggcggagagaccttcccctatagaaccggcagggggcggggcgcgaggcggagagaccttcccctatagaaccggcagggggcggggcgcgaggcggagagaccttcccctatagaaccggcagagggcggggcgggatctgtgagtctctcagcctcggcgtgtttttgggttttggagacgagacctgccaggaaagctgaggcatgattcaaaagccctggaactgtctggaaggggaatgcaaaccagaatgtgaaatgcaaagccctgcctgggcggaacgtattatttcatgctgacgaccacagaacagaatagaaatcctctccctttctattctccactcactcaagagggagagtccaccctgtgtcagcttcagagacttccctagagccaccgcctgggatgcgggatggagtgctcaggccagggaggagtgaggtcaccacctgctggttaaacacagcagagatgcgggcgcacaagggggcgtgggagggcgcggggtgggatcctgagttcccagctactcaggaagcagcggcgggaggatcgctgagcctggggctccaggccagcctgggcgataaagtaacaccccctcccgcaggactcccttcctcgtcactctctctctgttttttgttttgttttgtttttaaactttcgtaaataaaattttttatggtgtgagacagggatccaacattatttttttccatgtggatatccagttacttgtcccagcacatttgtggaagagctctattactttcttttttcacttacttttttcttttctttttcttttttatttatttatttattttttttgagacagagtatttgtctgtcgcccaggctgcagtgcagtggcgagatctcagctcactgcacactctgcctcctgggttgaagcgattctcctgcctcaacctccagaatagctggcattacaggcgtgcgcccccatgcccggctaagttttgtattttttggtagagacgaggtttaacagtgttggccaggctggtctcgaactcctgactttaagttatctgcctgcctcagcctcccaaagtactgagtttacaggcgtgagttaccgtgcctgtcccaagaaataccctttttctttctttcttttttgagacggagtctcgtattgtcaccccagctgctgtgcagtggcgcgttcttggcttgctgcaacttacgcctcccgggttcaagcgattctcctgcctcagcctcccgagtagctaggaatacaggcgcctgccaccatgcctggctaattttttgtctactaaaaagtagagaccaggtttcactatgttggccaggctgttcttgaactcctgacctcgtaatctgccccactcggcctcccaaagtgctgggattacaggcgtgagccaccgcgcctggccaagaaatactctttacttcactttttaaatgttgagaaaatataattgaaaacaaaaaaaatcttcccctaaatgagatatcatctccaccacgataataaaagactttgccacatacatcactttcatattgtttctctccctctcccaaatggattatcggatgtttccttaagagtgagctacaattaaaggctttgccactctcactacattggaaagatttttcggccgggcgcggtggctcacgcctgtaatcccaacactttgggaggccgaggcgggtggatcactaggtcaggagatcgagaccattctggctaacatggtgaaaccccgtctctactaaaaatacaaaaaaattagccaagcgtggcggcgggcgcctgtaatcccagctactcgggaggctgaggcaggagaatggcgtgaacccgggaggcggagcttgcagagagccgagattgcgccactgcactccagcctgggcgacagagcgagactccgtctcaaaaaaaaaaaaaaaaaaaaaaggaaaacagcaagctatcgtgtttcctaccttcaaaacacggaaattttcaaaacttgcaggataaaataccacaacaaaacatttatcatgccgagctcagtggctcacgcctgaaatcccaacactttgggagtctgaggagggaggatcacttgaggccaggagttccagaccacctggccaatatggtgaaaccccatctctactaaaaataaacaaacagccaggcttggtggtgcacacctgtagtcccaactactctgaacgctgaggcatgagaatcccttgaacctggggggcggagtctgcaatgagctgagattgctccactgcgctccagtctgggtgacaggcgcattcatcaaagaattttttctaaaatctcaaaatggtgtctgaatacatttctgtaggacttacgctgacttgccacagaactctcagcagtgattccccattgagccatgggaacgggtggaaggctggacaggaaaggggatgcgtaagtgaacttttctttgaatttttactacacaacacatatatacattgtgtggtctttaaaatttaaaaaaattaataatgggtagaagaagaatatggctccatcttctctaatgataagttctgctctgacgtcagaacaaaattataatcatttttacctaaaatgcctgcttcatcagagttcctgcaaaaaaaaaaaacactttttttttcttttttttgagacagagtcttgctctgtcacccaggctgcggtgcagtggcgagatctcggctcactgcaacctccacctgccggattcaagcgattctcctgcctcagtctccccagtaggtgggactacaggctggcctgccaccacgcccggctaattttttgtatttttagtagagacggggtttcaccgtgtttcgatctcctgacctcgtgatccgcccgcctcggcctcccaaagtgctgggattacaggcgtgagccgccgcgcccagccaaaaaagaaaactttaataactttaaacatcagccatcacacggtgtgtgtgcgtgtgtgtgtgtgtgtgtaaataatctaggtaaactacaaaattagccgggtaaatgtaatggaatacatgcttgtaaacaaacttgtcataatttgtgatctaaggttattatttgacattagcaatctgggtaatttccagtttaagaattacaggggccgtggtggctcaaccctgtaatcccagcactttgggaggccgaggcgggcggatgcacgaggtcaggagatcaacaccagcctggccatcatggtgaaaccccgtctctactaaaaatacaaaaatcagctggccgtggtggcgcgcgcctgtagtcccaactactcgggaggctgaggcaggagaatcgcttgaacccaggaggaggaggttgcagtgagcagagattgccccactacactccagcctacgcgatagagccatagagcgagactacgtctaaaaacaaacaaactcagtctaaaaacaaacgaacaaaaaaacaacaacaaaaaaaaaaagaagaagagaaaatacagttacaaattttctaaataaatgtcctgagaaaagaaaggaagggaaagttgtccttcacctccagtgtgcaataggcagttccacatgcaggtcaccctccatgttccattatccgctcaaacaacacaggacctcgcttaaacaagccgttttctggggtttttttgtttgcttgattgtttgtttgagacggaatcttgctctgtcgcccaggctggagtgcagtggcgcgatctcagctcgctgcaagctccgcctcccgggttcacgccattctcctggctcagcctcctgagtagctgggactacaggcgcccgccaccatgcccggctaattttttatatttttagcagagacggggtttcaccgtgttagccaggatggtctcgatctcctgaactcgtgatccacccgcctcggcctcccaaagtgctgggattacaggagtgagccaccgcgcccggccccttaagctgttctaattctcagtcctggctgcaaccagcgccacactccacccttttaccgaggtccttgcccctcgccctccccctaccccagctaccccaggctgcggggagctcgccccgcctgcaggacgggcgtctttacctgctcacaaaaggcactttgcatttaaaccattttcaaattaagaagaaaaacaggtaattccagcactttcggaggccgaggagggcggatcacctgaggtaaagagttagagaccagcctggccaacatggcgaaactccgtttctactaaaaatacaaaaattagcccggcttggtggtgggcacctgtaatcccagctactcgggaggcggaggcaggagaatcgcttgaactcgggaggtgaaggttgtggtgagcccagatcacaacattgcactctagcctgggcaacaagagcgaaactccgtcttaagaaaaaaaaagaaaagaaaagctaccagttacacagcagggctcctcagaaagcagggggaacacctgtttcaagtttttcttgtataggggcctacgtaaaagctaactgccggtgggctgatggtgtgacaaaacttactactttgttgatttaaaacgatccttggtattttagtgtgcaagtacttgaaagcatggctgtaattatcttagaagcacacattgtcatgagatattgggtcatgtggacattgtgtttctgtaggagtttgtccttgcaaatatcattaagctgctttccttaaccattaacatcttatgactttgactcgcgcagtaaggagtacgttttcctagttttaatggacttgagctttgacatcctggttctcctaggttcctgcttaacagtgtatccactcatgcaccacagagtctcagcaccattatggaagacaccactctagtaatatatcaaagacagactgagcatctactccaataacataaatagtaatagcaatgctacggaaaatattaggaagtttaatgtatgtatacaattgatcatttattattttcagttttatattggctaaaactacattggatgggttattttaatcaaatattagaaatatctttcaaaactgcgatctaatataaacacacacagtttgagaccatttcctctatgttcaatatatatgaaagagttcagatttatgaacttattttatgtttttcattagatctagtttgttttctatcttgatttcttctgtgttcatgagcttgtgaaccaaaagtatctaataggtctcaattaatttagaaagtttactttgccaaggttaacgatgtgttttttgcagccaatgtggtccagatgcagctgggttttatacattttaggaagacaggagacataaatcaataaatgtaagatgtacattggtttggtcttgaaaggcagagtaatgaaaatcagagacttccaggttataggtagacaacagataaatgatagcatttttaaaatttatttttatttatttatttatttatttatttatttttagagtcttgctctgtcgctcaggctggagtgcagtggcgcaatctcagctcactgcagcctctgcctcccgggttcaagcgattctcctgcctcagcctcctaagtatctgggattacaggcacacgccaccatgactggcaaaatgtttaaattcacctatagcctgaaaccaacccatcccgctttgagttgccccacctttctggaccaaaccaatgtatttgttaaatgtatctcattgatgtttcatgcctctctagaatgtacaaaaccaagctgtgcccccaaccacctgtggcccatgttctcaggacctcctgaggactgtgtcatgggccagctcactcatatttggctcagaataaatcttttccagtattttacagagtttgactcttttcatcaacactaatattgctatgtcattaatttctaaatatattgtaatttcaaattcaccatgtgcattctgtaataagacaaatttcattttaaaattgtaacgtattttagatattttctttgttttctgtttctcaatgttctgtcacgtgtggatagcaaagccaataaaatactcttcagaagtcatttagatttattttcccttagagaaaaaataattttgcaatatttctaaagataaatggcaggcaagttattttctttcataggaactctcaagaaaggacaactcggccaggcgcactggctcatgcctgtaatcccagcactttgggaggcagaggcagggggatcacgaggtcaagaggtcgaggccatcctggctaacacggtgaaaccccgtttccactaaaaattagctggatgtggtggtgcgcactctagtcccagctactcaggaggctgaggcaggagaatcgcttgaacccgggaggcagaggttgcagtgagccaagattgcatcactgcattctggcctggagacagagcaaaaaaaaaaaaaaaaaaaggacaactcaattattaaatgtttacaagtagcctcatttcttcaggcaataattccatggcaatctccaacttaacatgtaatatggaagtatgttttcctgtcacagcattataattctgtattatgcaatattgctaagtagccaaaaaagaacactgagcctggacttccatgcttccatgcaaaaaaaaaaaaaaagaattgattgtgacagtttttgttaacctcagaacggtagacaagaagctgattgtagcggaaagtcatgattccattttgtatatgtaaagttttgttgcttctagaaatgtcaaggaagcaacatggacatactgattcacaagaaatttaaaagaatatttcctgccgggtgtggtggcccacacctgtaatcccagcactttgggaggccaagtcgggcggatcacctgaggtcagtagttcaagaccagcctgaccaacatggagaaactccgtctctactaaaaatacagaattagccgggtgtggtggcacatggctctaatcccagctactcaggaggtggaggcaggagaatcacttgaacccgggaggcggaggttacagtgagctgagatagcaccactgcactccagcctgggcaacaagagagaaactccatctcaaaaaaaaaaaaaaaaaaaaggattttcttaatcacagaaagattttgacatatacatccttgtaatatcattataagagaaatgcaaagtaattagatgtttccaaaaagttaaaatagaaactacttgttttttgaaaaagggtctcactctgtcactcaggctggagtgcagtggtgccatctcagctcactgcagcctcaacctttctggttcaggtgatcctcccacctcagcctccctagtagctgggactacagggcgtgccaccacgcccagctaatttttgtattttttagtagagatgggtttcgccaagttgcccaggttggtttctgactcctgggctcaagccatctggccgcctttgctttcaaacgtgctgggattacaggcatgagccaccatgcctgaaactactttcatctattgagcttatattatagccagtgtcacaggaaaaagcatgtgcatattctaacacagacggaacaatgaaaatgtttactactgggccgggcgcggtggctcatgcctgtaatcccagcactttgggaggctgaggcaggtggatcacaaggtcaggaaatcgagaccatcctggctaacatggtgaaaccccatctctactaaaaatacaaaaaattagctgggcgcggtggtgagcacctgtagtcccagctactcaggaggctgaggcaagagaatggtgtgaacccgggaggcggagcttgcagtgagccgagattgcaccactgcactccggcctgggcgaaacagagagactccgtctcaaaaaaaaaaaaaaaaagaaaactaaaaagaaaatgtttactactgtcaaaaaacaaatttagatattggttagattttattcaaaaggtatattgcaatagggaaaatgctccaaccccaagatctgcaaatatatgagttgcacagaaaagggcttctcttttataaggagaaggaagcaaggttagaaagcgccaggtacagggcagtggataagcatctgctgtgacctattcagtgaatattttatcctaaggtcagcttactcttgggatgggacattaaaaaggcaaagttgggctggacgccatggctcatgcctgtaatcctagcactttgggacaccaaggcgggtggatcgcttgaggacgggagttcaagaccagcctggccaacatggtgaaaccctgtctctactaaaaataaaaaaattagctgggggtggtggcacaggtctgtaatcccagctactggggagtttgaggcaggagaatcacttcaacccgggaggcagagcttgcagtaagccaagactccatctctaaaacaaacaaacaaacaaagagaagttgttctcaatcacagtgcccatatgtggttaagaaatagaggttgttagccgggcacggcggctcatgcctgtaatcgcagcactttgagaggccaaggcaggtggatcacctgaggtcaggagttcgagaccagcctgaccaacatggagaaaccctgtctctactaaaaatacaaaattagccaggcacagtggcgcatgcctgtaatcccaggtactcgggaggctgaggcaggagaatcacctgaatctgggaggcagaggttgcagtgagccgatatcatgccattgcactccagcctgggcaacaagagtgaaactgcctcaaaaaaaaaaaaaaaaaaaaaaaaaaaagagagagagagagaaatagaggttgttctgaatttcaatggccaagaatagtccaacagtcaggggcttggagaaacagggaagcctaaggtttgagtaagttaagaagcattgtttccaccatcagtgagaaatccttgatgagacaaaccgtgggaatttggagttttttcttatgtaaacaaagagggtaagctttgaagtaagctgtttctagggaaaacaaaaacaagggattgggcaggggagtggtttccggtgggttttatttgtttttttgtttgtttgtttttgtttttgtttttgttttgcttttgccctagaggcctcaagaggcctggggaacatgtgctcctctggtggtttcttcaatctttgctatttcttcaaccctttactaggtttacagggttgtaataaacttcaacactgtcaccacacgtaacataaaacaaaatttaaaaaataataaatataggccaggcgcagtggctcacacctgtaatcccagcactttgggaggccgaggcaggcggatcacctgagatcaggagcgagaccagcctcaccaatatgaagaaactccgtctctactaaaaatatacaaaatagccaggtgtggtggtgcatgcctgtaatcccaactactcaggaggctgaggcaggagaatcgcttgaacccaggaggcggaggttactgtgagccgagattgcaccattgtactccagcctaggcaacaagagcgaaactccgtctccaagagaaaaaataataatacatgtgtagaatttgaaaaatagaactaaaaataggaacaatagcgatgttgccccatacctcagtttttgaatggaacgaaagggccttgagtgttcattttggctgtgtgttattcattcctatcacatacaagagacattagtaattattggaagatatggctctaaatctctaaattcaggggtctgtgtaactgttaaattgaacagaaacctagagatatattaagacaaatagtgggctgggtgcgatggctcacacctgtaatcctagtactttgggaaactgaggcgggtgaactgcctgagctcaggagtttgagaccagcctgagcaacatggtgaaaccctatctcaagtaaaaatacaaaaaaattagccaggcgtggtggtgtgagcctgtaatcccagctaatcgggaggctgaggcaggagaattgcttgaacctacctgggaggcagaggttgcagtgagccaagatcacaccactgcactccaacctgggtgacagagcgagactctgtctccaaaagaaaaagaaaaagaaaaatggtgtttccttttccattttcctgctgaccatggaaaaacacactctcacagttttatcaattctttggtaacaattacaaaatgcaagcactggttcacgtcgacagcccagagtccgcaaatcctctgctctgagcccgtccggacttccccgatcccagccttctctcctttgaaaacactaagaatgacatcactgcatcagtttttactagagccaatcacctgtcgtgcctggaacagggatcgtacccagattgccctcagtcctgataatcaggaagcgcacatctataagaagcatgggagccagcgagtgaaagctcgtgaactcagtgagcacaatggacatatcacaggcattcactgggctcccaagagcgaccgcatcgtcacttgcggggtagactgcaatgcctatgtctggagtcagaaagatggtgtctggaagccaaccctggtgatccttagaattaatcgtgcagctacttttgtgaagtggtccccgctagagaacaaatttgctgtgggaagtggagcatgactcatttgtttgttactttgagtctgaaaatgactggtgggtaagcaagcatattaaaaagccgattcgctccacagtcctcagcttggattggcatcccaacaatgttttgctggcagcaggatcatgtgacttcaaatgcagagtgttttctgcttacattaaagaagtggatgaaaagccagccagcatgccctggggcaccaagatgccttttgggcagctgatgtcagagtttggtggcagtggcaccggtggctgggtccacggggtaagcttctctgccagtgggagccgcctggcctgggtcagccacgacagcaccgttatctgttgctgatgcctcaaaaagtgtgcaggtctcaattctgaagacagagttcctaccactcctgagtgtgtcatttgtctcagagaacagtgtcgtggctgctggccatgactgctacccaatgctctttaattatgatgaccgcggctgcctgaccttcgtctccaagttagacattccaaaacagagcatccaacgcaacatgtctgccatagaacacttccgcaacatggacacgagggccacgattgaggaccacaacatggccttggagaggctgcaccagaatagcatcactcacgtctctatttatgaggtagacaagcaaggttgtcgcaaattttgcactactggcattgatggagccatgacaatttgggatttcaagaccctcgagtcttccatccaggtcctccacataatgtgaagctgagtgagccttcgccatctagcatgacaaactgtggccaaccgcagctgtgccgtggcacgatggcgaggaagctagacccaaggaaacactgaaaacacatagcaggccaatgctgtgtggttttgtttgaatataaaattggtgaaaatgctggtttttttaaagcagtatttttttttttatttttttattttttttgcgatttcattccattcttgaccaaagcttccctttaagtagtttattatggaaaattgtcacactaacttaaaagacagggtgagggagatatgtaaattgtccactagaaaattaaataaaagaactaaatgtgggaaaaaaaaaaagaaagaaagaaaatacaagcacttaggtcgggtgcagtggcttacgcctgtaatcccagcactttgggaggctaaggcgggtggatcacctgaggtggggagtttgagaccagcctgaccaacatggagaaaccccatctctactaaaaatacaaaattagccaagcacagtggtgcatgcctgtaatcccagttactcgggaggttgaggcagaagaatcgcttgaacccaggaggtggaggttgcagtgagccgagatggcgccactgcatgccagcttgggcaacgaaagcggaaaaaagaggccgggcatggtggctcacacctttgggagcactttgggaggctgaggtgggtaaatcacctgaggtccggagtttgagaccagcctggccaacatggtgaaacccatctctactaaaaattaaaaaaaaaattatctgggcatgctggcgggcgcccataatcccagctacttgggaggctaaggcaggagaatcccttgaacctgggaggcagaggttacggtgtgccgagattgcaccactacactccagcctgggtgacagagtgagactccctccccaccgcccccccaaaaaaaaagaaaaaagaaaagaaaatactagcactaatttatatgtcagattcatgtcacatctcaaattcatctaaattttcttgacatccctttttataccagtggagccctgatgaagacacttaatagaagttttctctctatcagagaaataagttgatgagaataaactcaacgaaggtgaaaattctgtttttttctgtgacctgggggaaaaagcttaaggtgaatttacattcagattggttatacagagagaacatacagaagtggatgaactcggtgtaattaagtttttctatccacaaaccaggtgaaagtattgcaggaggcagatagcgaggcatgagcaggtaaggagattctgtgtcacccgcaaggggtcctgatccagaacctaagagagggttcttggatctcacgcaaggaagaattcaaggtgaatccatacagtaaagtgaaagcaagtttattaagagagtaaaggaataaagtatggctactccatagtcagagcagcctcctgtttcatcctatgactaagaatgccttcacttactgggaatgtaacccagcaggtctcaggcttattttctccagcccctattccagatggaattgctctggttcaaatgtctctgacactttggaaaggaatatttagaaatgcaactcactggccaggcacagtggctcatgcctgtaatcccagcactttgggaggccgagacaggtggatcacgaggtcaggagatcaagaccatcctggctaacacagtgaaactccatctctactaaaaatacaaaaacttagctggcctggtggtgggcgcatgtagtcccagctactcaggaggctgaggcaggagaatggcgtgaacccgggaggcggagcttgcaatgagccgagatcgggccactgcactccagcctgggtgacagagcgagactctgtctcaaaaaaaaaaaaaaaagaaaagaaaaaagaaaaaagaaatgcaactcactgagagtctccttaaagatgctgcccactgacagcaagaaaagatcagtggctacattgcctccacctggccttgtggctgcactcctctggcccagaaggggacttatcaggggctagctggacataatcgagatgggggattttccccattaacaaccatgtgtacttctgcaataacccaccctagaagagccttctgctcaaaatgatactgaaacacacatccctggctggagatttgagatgctaatgagatatgtgacgtgtgtaccagcacggaccgtcacagggctttcctgatcagaggacttcctggaacgtgcttactaggaacatccctgcacagccccttcatgaataatcatgtcagattctcacaaaaaggctctgcccaacactagtagggacaggctcattcttttgaggagcccaccctgctccactgttcagggtatctcttctttccgagctcctacgcctttagataaagggcacttacctgcttaactctttctgcgtgtctcttgactgaattcaaggagaccaagaaccagaggacttccacgcccctcctggtaacatctggtgttttcccctggtggcctgtgaactgttcttctgggtaagtgccaaaaagctggtgccagatcctctggttgacgacctctgcttctttctgcactgaagaacctcctgccctaatgcagatcttgcagccttaaggggaggggcttttcctctcgggctctgttcactatcaactgcccagtaccatttcccttcagccactgtcactctgctccctctggctgacttctcagctcaccctgaggggtgacaagcagaggagggaggatttaaactccacagtgagtagatctgagacacggtgaccctccctgcaggaggcttgtgaaggtggcagaaaatccaccctggctgtgcagtgactggggagcttcatatcttcaactaaaactactattccatgttgagtcggctcttctacttgctgttcatggcagttcattctcctggacacaatatgccgccaccggtgaataatcccccaggtcactctgcttactctttgctgtccctgtcctcgtcgccgggcttccttgaattcctccttcgtgtacaagtgccttgtctgtcctgcttgtctgggacctgctgcgtttgcttcactgccaatcgccggaggcctgcccgggcctgtgaggaagtttatacttattttttccctagagatgagacccagcttcgtcctttcagttgcctcctttctcactgcagggaccggcactggcaggatgctcgcttacaggcatccctcgtttactatcgggtccttctccgcccgactactcttcaagaatgcctcattctgtggctcctcaagcgagctgtctggttcctccggatggtcatttataggcctctttctcagaccccagtttctctttacaaccggggtttcctgtgggtcaatgggaagttcttcatccgcctcctcaagccattgttacagacctgtacggcagtcaggtgctttttgtattatgttgaaaaagctgacagaaaatgcccccggcactccccttgctgcttatgtgatcatatcagggacgtaaaaaaccagaatcaacagcccagtccactaactctgagccccaggggccttccatgcctgtttaagcattttttctgtatgatccccaaggaacctactatgaccaggggaagatatcaaatttacctccattcctctaaccatctgtatgcattaatccaatattatcatgcattaaggggaccttaccatggagtcccttctctgcagactttagcaggggcagaactactggacttcttgcagaaccaaggtcactgggaatatgagagacaagagaactactcccatgcccgacgttcttacatgcttcctggcccaacacagaggtgagaaaggcgtccctcctaggcatcaatcctaggaaatctaagaaaggcttctgagcaaaatgagatacagggagacaatggatggtgcaaatgctaaggctagctaattctggagccccagggtgaagaaccaatcatccctgtaaatagaggcatggacacttcacctaggccaaggtgtggaatgcctcaccttcctgaggcacccaataggtggagagatgccttctctatcctatattcattcctgtcttctctttcagatgggtaaccagagctccgtaccccaggattcccctctcggatgcatccttagaaactgggataagtttgatccccaggcattgaaacgaaaaagattggtttttctttgcaatacagtttggccaaaatatgaactagaagggcaggaagcctggccagtggggggaagcttaaatgttaataccatactccagcttgacgtctactgccgacagcagcgcaaatggtcagaggtcccttatgtgcaaaccttcatgatcttgagggaaaaccccgatttttgtaaaggctgcaagatagatcctgcccttttagctatcctcagtcgtccactccagagacctcaaccaggaggcttcaatgatttcctggtcaacccacctcaacctcctcttcctgagaccaaagagaaagagcaagcacccccagctccttcctccttgtatcgcactcttagccttcatgggtcagcctcaacctacactaggccctcaggcccccgctctggaatctgcctgctaccagtggtgagccgaccagtaggaccagtccaagtccaggtccccttttccatgcaggacttgtcccaagttaaggaaggcctgggaaaattctcagagaatccgggaaaattcctggagggcttccgtaaattaaccctcacttttgaactaacctggaaggatgtcgccatcctcctaggacaaaccctgtctctggaagaaagacagaccatctgggaggcagcacgtcaatgcggggatgagctacacttggcagatgccaactaccccgtgggagctacagctgtccccctgcaggaccccaactgggactacgataccccggcaggaatctgcgccagaaatcatatgctcctatgcctgatagagggaatgaaaaggagtcaagtcaagcctgtcaattataataagttagcaaccatcgaccaagggccacatgagaatcccacggcctttctcgaaaggctccaggaaactcttatcaaacataccaacctagacccgggatccccagaaggacaactagtcctaaaggatcacttcctcacacaagctgccccagacattaggagaaaactgcgaatgctggctttgggaactagagcccccatgtcagaaatcctcaaattcgcttcctcagtgttttataaccgagaccaggatgagagggacagggccgagaggaaggaaaaacagaaagaagagaggcaggctcaattactagctgctttgcaagttcaccagccccctccaggttgccctaaggataccttcccagggaactgctatcagtgcgggaagccgggccattggaaggcaaactgcccctacgggccaaggggggaaaagccctgcacggcctgtcccctctgccgtaagctcaggtactggaaagagaactgtcccgagagccaaaagggcccctgagccaatgatggctttgagctgagggtgccctctgccttggccagctcccagatgtgacatcatcatcaaagggatggagcccagggcaactctggatgtagcaggtaggacaatacattttctatttgatttgagagcagcctgctcggtgctgacccccttctctaggcaactttcctctgtcaggtaatcagggtaaatggcatctcttcctaagatttacaccttctttattgttaaaagaccaattaatcttttcccatgagttcctgatactgtctgaatgtcccatacgtctttagggcagggatatactctccaaactaggggcacgcttcacatttacctgaacttccctgaaaggctttctttttttttggaagactcacccatgacattgctgaattatcttgatctggaatcacaaataaccctgagatatgggctttgatacactaggaagggcaataactgcagtcccagtcaaaatccagctaagaaaaccttccacttctttcataagaaacaatactcgctatggccagaggcaacagaaggacttgagcctatcattaacccattccttagacatggcctgttaaagtctgtaactctccctgcaacacaggaaatctattctgctggtagaaaacatttaaagggttctccactactgaaccctgattaagtctggttttctgatggcggcagtttcatccaacatggagtgacacatgcagttatgcaatagtgtctctatttgacattatagaagccaaatcccttcctccaagaacattggcacagctagcagagctcatttccttaactagagccatagaaatagggaaaaacccaaaagctacaatttatacagattcaaaatatgccctctcaggactccatgctcatgtggccatctggaaggaacagggatttttaccagcaaaagatacccctaaggaatgtggaccacagatcctggccctgctctaagctgtacacctatcacaggaaatagctgtagtccatggccagggacaccaaaggaccagggagaaaatgcccagcaaaacaggagggtggatcaaacagccaggaccactaccctgtagggaactcctcatggcccttaacccatctttacccaacaccttacccacccacaaaaacccaagaggaaaaggaatgggctatcaaatatgaatctacccgagaacctgaggtgtggtatacagtgggaggaattctccactttcctaggccctccagtaaaaacttgtgagagcactccatgagtcatgtcactttgggagacatcatctccagcacatgtgcaaaaacctcttttccaggaaagggctctactagactatttgtcaggtctttaacacctgtgcatcctgtgcctgtaatagcccccagggccctacgctgccctgcttttttttttttttttttttttttttgagtcaaagtttcactcttagtacccaggctggagtgcaacggcgtgatctcagctcatcgcaatctctccctcccaagttcaagcgattctcctgcctcagcctcctgagtagctgggattacaggcaggtgccaccaaaaaaagaccaaaaaaaatttttttttttttttggtatttttagtagagatggggtttctccatgctggtcagactggtcttgaactcccaacctcaggtaatccgcctgcctcggcctcccaaagtgctgggattacaggcatgagccaccgtgcccagccaaatttttttttttgttcaatgttgcccaggttggcctcaaacgcgtagccttgcctccttgtgacccaggacaaccggccagagccaatgcagctccctgtcctgcttagttgagccagttcagcattgggaagcttacccagggaaagactgatggatgtatttcactcaattgccagcctgtagaggctataaatgccttctggtgtttgtggacacctttattgggtgggttaaagcctttcctacaagaacagaaaaggcccaggaagtagccaaggtacttcttaaaaaaaaaaaaaaaatcatcccggccgggcgtggtggctcacttctgtaatctcagcactttgggaggccgaggcaggcggatcacgaggtcagagaattgagaccatcctggctaacacagtgaaatcctgtctctactaaaaaagagaaaaaattaggtgggtgtggtagcgggcgcctatagtcccagctactcaggaggctgaggcagaagaatggtgtgaacccgggaggtggagcttgtggtgagctgagattgtgccactgcactccagcctggacaacagagcgagactccgtctcaaaaacaaaaagaaaaaaaaaatcacccctcagtgtgggtttagtttgtgtttacaaagtgacaacggcccagtttttatttcacgcaccctttaattagtgacaaaagccctagaaataaagtactcctagcactcctggagaacacattcctctggcaaggtagaaagcactaatcaaactattaaaaggaccctgaacaaagtgtgccaggaaacctcctcaccatggttagaactcctgtccgtagcactgttctgagcatgacccctaatattacttatgccttcctacatgcagacctaatgttagatccagaagttacccaattaatcaaatacataacatcactggcccaatttcaacaagccatccaggagtttgagcaaaaggtactgcctgccactgacccctccagtaatcaacccttatactagccagggtcacaagtcctcatcaaaacctggagagatgggtcacccaggtctcaactagcctgggtctctcctttatggaaaggcccctttattactttctaccccgacagctatcaaagtttctggaatctctagttggatacatcactcctgagtaaaactgtgagaaggtcccgaagaaccaacaacagaatcagcatctgagtagtctcatgagccagccactggagagcttccaattcctcttcaagtgaaaagataagtaaagccttctctcctttcacctcaaaaaaaggtctctcagtacggggaatcttggttgcggtggcatcggttcttctccttattttgacccacactggcatgccacctgaagtcccgataacagcctgatttctcactaaacactccatcgaaccatttcattatttgtctctcctattttcagcactttccttttgctttcacaaagcttaagggagaatcagctatgacagagaaattccttttcctttatctttccctccttcccatgcccctactctcacaggcacagtggaatgaaaattcccttgtcagtttttccaaaataattgcttcgggaaaccatctaagcaactgttggatctgccacaacttcatcaccaggtcctcatcttaccaatatattttggtaagaaatttttctttaaacctaacatttggttcaggaatccctgaaggccaacataaatctgttccgctccaggtttcgcttgctaactcagcgcaccaagtcccctgcctggatctcactccacctttcaatcaaagctctaaaacttctttctatttctacaactgctcttctctaaaccaaacctgttgtccatgccctgaaggacactgtgacaggaagaacacctctgaggagggattccccagtcccaccatccatcccatgagcttctccccagcaggctgccaccctaacttgactcactggtgtccagctaaacaaatgaacgattatcgagacaagtcaccccaaaaccgctgtgcagcttgggaaggaaaagagctaatcacatggagggttctatatttgcttcccaaggcacacactgtccccacatggccaaaatctactgttcccctgggagggcctctatcccctgcatgcaatcaaactattccagcagggtggaaatcgcagttacacaagtggttcgacagccacatcccccggtgggcctgtacccctcctggctatgtatttttatgtgggccacaaaaaaataaactgccctttgatggaagtcctaagataacttattcaaccccccctgtggcaaacctctacacttgcattaataacatccaacatacgggagaatgtgctgtgggacttttgggaccacgggggataggtgtgaccatttataacaccacccaacccagacagaaaagagctctgggtctaatactggcagggatgggtgcggccataggaatgatcgccccatggggagggttcacttatcatgatgtcaccctcagaaatctctccagacaaatagacaacatagctaagagtaccagagatagcatctctaaactcaaggcctccatagattctctagcaaatgtagtcatgaacaacagattggccttagattacctcttagcagagcagggtggagtctgtgcagtgatcagtaaatcctgttgcatttatgtcaataacagtggggcgatagaggaggatataaaaaagatctatgatgaggttacgtggctccataactttggaaaaggtgattcagcagggtccatttgggaggctgtgaagtctgccctcccctccctcacatggtttgtccctttactgggaccagctgcacttaatagcctgctttctcctctttggcccttgtctctataattcactaattaaatatgtctcttccaggatatggcaatttcacacagagcccctaaaaatggaaagagatcatccaatcttccttggaggtcccagcacctacaagtacatatctcccttggatgccagtgggcaaagattctgcaactacggaggggctccttccctgacagagagcaagagagggagaccctgatgacttcttcgtcccacgtcagcaggaagtagttacagaagacccacgacgtccttatgcccaaagcttttcagggtctccaactcttgagggggaatactgttagggtaggcaggtagccagacaagagcaggcaaggaagcccctgggaaaggaatctttagaaatgcagcccgctgatggcctccttggaaacgctgcacgctgagtcagcaaaaggaggagcgtggctacactggctacacctggccttgtggctgcattcctctgttccagaagggaacttatcaaggcccagccagaggttaccaaggtaggagctattccccactaagaagcatgtatacttctctaataattcaccctaatataccattttgttcattaaaataataaaaaaaaccacacacctgtgtggagattttattttttaaccagaaattccttgttagactttagatccaaatgacatggcacatgtgtgcccagaccagttcccaacacatgcttactagtaacgcccctgcatgaccccttcatgaataatcatgtaaaattctcataagaagcatctccccagccaggtgtggtggctcacgcctgtaatcccaacactttgggaggctgaggcaggcagatcacctgaggtcgggagcgcgagaccagcctgaccaacatggagaaaccccgtctctactaaaaatacaaaattagctgggcgtggtggcgcatgcctgtaatcccagctacttgggaggctgaggcaggagaatcgcttgaacccgggaggcagaggttgtgttgagccaagatcgtgccattccactccagcctgggcaacgagaggggaactccatctcaaaaaacgaacaaacaaaaagaagcgtctccccagcattggtgagacagactcattcatttgagcagcccagcctgttctgtctttcagggtgtactgtttatttaaaagcccccataaaaattcctcccaggccaggcatggtggctcaggcctgtaatccctgcacttccttgggcggatcctcagacagatcacagctcaggagtttgagaccagcctgacaaacatggcgaaaccccgtctctactaaaaatacaaaaaaattagccgggcctggtggcacgcacctgtaatcccagctactcaggaggctgagggaggagaatcacttgaaaccaggaggcggaggttgcagtgagccaagattgcgccactgcactccagcctgggctacaggagactccatctggggagggcggcggggaattcctcctaagtcactagcagctgactcactctctgcagcagccagttctgtctcttcttgacctcctgtctttaaataaaggttacttaacgatttaactctttctgtgtgcctcctagatgaattctttccttcaggaagataaactgaaggacctccacacccctcctggtaacaaaggtctttgtgcaatccctcctgaagaagcaatggaggatttagtatatctaaactagtaaatacaaactgtactcaattatccaagaaatcattgaagaaacactctttactccattttttatatcttgggaaaaatataattaaagacaaaataatatttgccaaacccagaaatcctcaccaaaaaggaaaaaaataaataaacaatcccagttggtggctggtgaatgcttctaccttaatcaatacatgttttgaagctgtcagcttctttttgctcataagtgactccacagaatctagtctttgctttgccctctagacaaggaatacagaatttttaaatcttatcagaaacatataaattgtttggttttgcacaatatttactaattttctccactcatccactgtggagtcatagcacaaaatgaggcaccaccctctcgtattgcaactaaaacagactgagcttctgctccataaccataaacagtaatagcaatactaattgaaagatgaagtaattttacgtaagtaggtataaaactgataattcattgttattttcagttttacaataagtgggaattacatagaataaatctttctctctctctctttctatttctgacagtcccgctctgtcgcacaggccaaagtgccatggggtgacctcagcttactgcaacctccgcttcctgggttcaagtaactcttgtgcctcagtctcctgagtagctgggattgcaggtgtacaccaccttgcttggctaatttttgtatttttcatagagatgaaatttcactatgttggccagagtggtctcaaactcccaacctcagatgatcagcctgccttggtctcccaaggtgctgggattacaggcatgagccaccacacccaacggagttttcactcatttactttaatcatcatgggttagagatatagcttttaaaaatgtaattgaatatacccttacagttaggatctaaaaagagcatttcctctattaatgtttattaaataatatggtggaactcagacttgctctgttgcccaagttggagtgcagtggcatgatcttggctcaatgcaatctctacctcatgggtttaagtgattctcgtgcctcagcctcctgagtagctgggattgcaggcatacaccaccatgcctggctaaattttgtatttttactagagacagggtttcaccatgttgctcaggttagtctcgaactcctggccacaagtgatccacccaccttggcctcccaaagtgctgggattgcaggtgtgagccaccacaccagcttaattttttttctttttcttttcttttcttttcttttttttttgagatggagtttcactcttgttgtccaggctggagtgcagtggcacaatctcagctcactacaacctgcacctcctgggttcaagtgattctcctgcctcagcctcctgagtagctgggattacaggcatgtgccaccatgcctaattttgtatttttagtagagatggggtttctccatgttagttaggctggtcttgaactcccgacctcaggtgatctgcccgtctcagcttcccaaagtgctgggattacaggcgtgagccatcgtgcccagcaattttttctatctgagtttcttccgtactaatcagcttgtgatagacacatggtttctgaaacagaaaagtgcaagggctttttatgagcagggtgtggaagactaccagtaacaaatgctttggcataagtgatgagtgagaaggggagtgagagtctctactgtcctacctactaattgtgctttgggaatttggattgaaaaaagccaccttaatggtgtttggttatcatttattctcccccacctggcaggaaataaggacagggtccccaaagctgctagggcacttagggtggatatgaaacattaaaatatgaaacattaaaacttcacttgcttgaaaccagagcagccaccaaactgctcaaaattactgccaatgatgtcttgcttcctggcattcagaaaccttctccttctctacccctgactcttccttccctctctatcccaatctcaatcaccttaaggaagagctgagtatcctgaaaaatttgaaaggaaaaaagagattcaaacttttgtagctctcttggtaagaggtgccccaatcaccttccgaggagaaatgctttgtaggagtgtctcaaaccaccaagacctgtgggaccaagcacatatggggcccataggaagaagccactgagcctcaggatcctccagatgctgggaggtacatggagcagcaggcagcattatgcttgtatcaagcacccaaggagaaaacaaggccactgagctgccccagccttccctgacatgattgtctcctatggccctgggtttgtttggagacctgcaacataactgtaattcctccttctcctttgtgagttcaaactaagggtaggtttgctaccagtcttttaaaaaagattggtgccactcttgcttacagggcagagaaggcacccagaatggtggccactggcaccccactcccaagccaataccacctctagtgtaaccatgcacacaatctccagaaggggaccccagcccctgacccagctgcattgtctctgccactgtggtgaacacttgcatggaggcaggtactctggcgccctctagcactctggctcttgaggagtcagaggaaaacactggggcccaatacaagtcccctaaagttagagcacacagtccagataagtgctggccccctaaaatcttccagaaatgaagccagtcagctgaatccaccttataccacaatccacaatcaaaccctcaaggtcatcaaatagttatgataaaagtaaaaaacaaaaacaaaaaacaatcctcatccaaaggtcagcaacctcaaagactgaaggtagataagcccaaaaagatgagaaagaatcagtgcaagaaccctggaaactcaaaaagctagagtgccttttttcttccaaacaactgcatcacctttccagcaaggtttctgcaccatgcagagatggcagaaataacagaaatagaactcaaaatgtggataaggacaaagttcattgagctatgggagtatgttgaaacccaatccaagaaagataacaaacacataaaacaatgggattatgtaaagaggccaaatctatgattcactggtgtccctgaaagagagtgaaaccaatttggaaaatatatttttgcatattatccatgagaacttccccaacctagctagagaggccaacattcaaattcaggaaatgcagagaaccccagtaagatacttcacaagaagatcatacccaagccacataatcatcagattctccaaggtcaaaatgaaagaaaaaatgttaaaggaagctagagagaaaggtcaggtcacctacaaaggaaagcccataagagcagacatctcagcagaaagcctacaagctagaagagattgagggccaatatttaacattcttaaagaaaagaaattccaacccacaatttcatagttggccaaagtaagcttcataagcgaaagagaaataagatccttttcagagaagcaaatgctgagggaattcattaccatcagacctgcagtacaagagctcctgaagaaagcattaaatatggaaagaccattaccaaccactacaaaaacacactaaaggacatagatcagttacactataccacctaacaccatgataacggatcaaatccacacatatcaatattaaccttaaatgtaaatgggcagccagctggatgcagtggctcatgcctgtaaccccagcactttgggaggtggaggtgggtggatcatgacattaggagtttcagaccagcctggccaacatggtgaaaccccatctctactaaaaacacaaaaattagctgggcatggtggtgcatgcctatagtcctagctactcaggaggctgaggcaggagaatcgcttcagccccagaggcggaggctgcagtcagctgagattatgccattgcactccagcctgggcaacagagcaagactctgtctcaggaaaaaaaaaaaaaaaagtaaatggcctaaatgccccaattaagagacagactggcaaggtgggtaaagaaccaaaacccactggtatgctgtctccaagagacccatctcacaagcagtgacacacataggcttaaaataaagaaatggacaaaaatccaagtctttgctattgtgaatagtgccacaataaatatacgtgtgcatgtgtctttagagcagcatgatttataatcctttgggtatatacccagtaataggatggctgggtcaaatggtatttctagttatagatccctgaggaatcgccacaccgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgattagcatttctctgatggccagtgatgatgagcattttttcatgtgtctgttggctgcataaatgtcttcttttgagaagtgtctgttcatatccttcgcccactttttgatggggttgtctttttcttgtaaatttgtttgagttcattgtagattctggatattagccctttatcagatgagtaggttgcaaaaattttctcccattctgtaggttgtctattcactctgatggtttcttttgctttgcagaagctccttagtttcattagatcccatttgtcaattttggcttttgttgccattgcttttggtgttttagtcatgaagtccttgcccatgcctatgtcctgaatggtattgcctaggttttcttctagggtttttatggttttaggtctagcatgtaagtctttaatccatcttgaattaatttttgtataaggtgtaaggaagggatccagtttcagctttctacatatggctagccagttttcccaacacaaatgtccaacaatgatagactcgattaagaaaacgtggcacatatacaccatggaatactatgcagccataaaaaatgatgagttcatgtcctttgtagggacatggatgaagctggaaaccatcattctcagcaaactattgcaaggacaaaaaaccaaacaccgcatgttctcactcataggtgggaattgaagaatgagaacacatgaacacaggaaggggaacatcacacacccggaactgttgtggggtggggggagggagggatagcattaggagatacacctaatgctaaatgatgagttgatgggtgcagcacaccaacatggcacatgtatacatatgtcacaaacctgcatgttgtgcacgtgtaccctaaaacttaaagtataataataaaaaaaagagaaaaaaaacctgcttattaggaaagcagagtaattatagaatgtaaaattagtgaaaaaatttatgaaattttgcctttataatgatatttaaaataaataccatcatgcctcttttgcaggtaaagaaaatgaaaaactagaatatttaggctcagggtggggtaactttaaaaaagaaggactggtcatgtctatacaatacaatatccttcctcccctaataaactaactcctaaaataaaaaaataaaaaataaataaatggacaaaaatctaccaagaaaatggaaaacagaaaaaaagcagggggccaggtgcaatggctcatggctataatcccaggactttgggagaccgaggcaggaggatcacttgaggccaggagttcaagaccagcttggccaacatggtgaaatgctgtctctactaaaaatacaaaaaattagctgggcatgggggcttgtgcctgtaatcccagctactagggaagctgatgcaggagaattacttgcacaccggaggtggaggttgcagtgaactgagattgcaccactggtctccagcctgggcaacagagcaagactccaactcaaaaagaaaaaaaggaaagaaaaagaaaaaaaaaagcaggggttgcaattctagtttctaacaaaacagactttaaaccaacaaagattctaaaaagacaaggaagggcattacataatggtaaagggttcaatttgacaagaagagctaactatcctgaatacatatgtacgcaacacaggagcaccctgtattcctaatgcaggaacttgctcaaaatgcaggttcttagagactttcaaagagacttacactcccacataataacagtgggagactttaacaccccactggcaatatcagacagatcattcacacagaaaattaacaaaaatattcaggacttgaattcagcactggatcaaatggacctgacagacatctacggaactctctactcaaaaacaatagtatatacattctccccattgtcacatggcacacactcctttttttttttttttttttttttttgagatggagtctcactctgtcccccaggctggagtgcagtggcacgatctcggctcactgcaacctccgcctcccaggtacaagcaattctctgcctcagcctccaaagtagctgggattacaggcacctgccatgatgcccggctaatttttgttatttttagtagagatggggtttcaccatcttggccaaactgctcttgaacttctgacctcatgattcacccacctcagcctcccaaagtgctgggattacaggcgtgagccacggcacctggccggcacacactcttaaatagatcacataattgaaagtaaaatactcctcagcaaatgcaaaataactgaaatcataacaacctctttgatcatagtgcaatcaagtcagaaatcaagactaagaaattcgttcaaaaccatatattacacagaaattgaatcacttgctccagaatgacttttacctctataattgacaattcttgtctcccatcttgctctttcttcttaaatttccttggctattccctccaagatgatgttggataagaggagactagaagctccttagtgtcatttctgactttagtgtgactttctgtaacatgtcccagatgtttgtcaatttgatgaagatatatcacttcctagttcactatttttaggtaacattatttcctgttaaatactgccaattttttttgcatttatgaatgtgggcaccttatttttctctcaacatagagagaccccatctctacaaaaaaatacaaaaatcagccaggcatggtggcacatgcctttggtcccagctattcaggagactgagatgagaggatcatgtgaacctgggagagggaggttgcagtgagtgagtcaagatcatgaacgctgcactccagcctgggtgacagaatgagaccctgcatgaaaaaaaaagactgcatggcattggtggggagtgatatatatatccatggaacagaatagagaatgcacaaatattttcctttcaactgatatttgataaagataccaaagcaggccaggtatggtggctcacgcctgtaatcccagcactttgggaggccgaggcaggcagatcacgaggtcaagaaattgagaccatcctggccaatgtggtgaaaccccgtctctactaaaaatacaaaaattagctgggtgtggtgacacgtgcctgcaatcccagttactcgggaggctgaggcaggagaatcacttgaacccaggagacggaggttgcagtgagccgagatcatgccactgcactccagccaggcggcagtgagactccatctcaaaaaaaaaattaaaaaaaaaaaagataccaaagcaattgaaagcaggactttcaaataatggtgctggaccaaatgaatatccacaatgaaaaaagatcaatctgcacctaaatttgacactcattcaaaaaggaccatgttgtgaaatgcaaaataaagaaaccatcaaatgttaatctatcaagaattagaaaaacatactgtaaactaattgggaacaagcacaccaaagagttcatagatatgacaccaaaagcatggaaaaaaatgataaatgaaacttcgtcaagttaaaacttctggtctgtgataccaatggaacagaacagagaacccagaaataaggccacaaacctgcaactatctgatcttcgatgaagctgacaaaaacaagcaatggagataacactctctacttaataaatgatgctgggataactggctagccacatgtagaagactgaagctggacctcttccttataccacacaaaaaattaagtcaagatgaatcaaagacttaaatgagaaatcccaaactataaaacacatggaagataatctaggcaataccatcctggacatacaaatggacaaagatttcataacgaagacaccaaaagcaattacaacaaaagcaaaaattgacaaatgggatctaattacaccaaagagcttccacatagcaaaagaaactatcgcaatgaatagaaaaccgtacagaatgtgagaaacttttgtgcaaactatgcacctgacgagtctaatatccagcatctatgaggaacttacacaaaattataagaataaaacaaccccattaaaaagtgggcaaaggacatgaacatttttcaaaagaagacatatggcccagctcaatggctcaaacctataatcccagcactttgggaggccaatcctggtggatcacctgaggtcaggagttccagaccagcttggccaacatggtgaaaccccgtctctactaaaaatacaaaaattagccacgcgtggtggctcacgcctgtaatcccagccactcgggaggaagaggcaggagaattgcttgaacccgagagaggcggtggttgcagtgagccaagatcgtgccactgcactccagcctgggcaacagagtgagactatgtctccaaaaaaaaaaaagacagaaaaaagaaacaacccagagcacaggaaaagggaagacgcctgtgtggctggaacagacggagtgagcgctcactagcaggagataaggtcagagatgtcctggggaagcagatcagatagggacaaggtcttcaaacaactctctcccacaccacaaaagaaattggaaatgatttatttcctcacctgttttaagtaaacatttaacttttttctttctcgtagaagagaaagtgatcaactgtaccacatactaccaaaaggaagagaaagatgaggacaggaagttaaatattgcatttaaaaatggggaggttctctgggcgcagtggctcacatctgtaatcccagctctcagggaggcagaggcgagaggatagctagagcccaggagttcgagacccgcctgggcaatatagcaagaccccgttgttctccacaaaaagcaaaaaaaaaaaaaagacaaaaaaaagtgtaggccaggtgtggcgactcacgcttgtaatcccagcactttgggaggccaaggcgggcagatcatgaggtcaagagatcgagaccgtcctggcaaacatggtgaaaccccacctctactgaaaatacaaaaattagttgggcgtggtgcgcgtgcctgtagttccagctactcaggaggctgaggcaggagaattgcttgaacctgggaggcggaggttgcagtgaaccgagatgcaccactgcactcccgcctgcgcgacagagcaactctcaaaaaacaaaaaaaaaaaagtgtaaaaatggggaggttggctgggctcagtgactcacacctgtaatcccagtactttgggaggccaaagtgggcaaatcacaatcaccttaggtcaggagtttgagaccagcctggctaacatggtgaagccccgcctctactaaaaatacaaaaattagctgggtgtggtggtgcatgcctgtaatcccagctactcaggaggctgacgctggagaattgcttgaatccgggaggcggagtttgcagtgagcagagatcatgccactgcactccagcctggatgacagagtgagactccgtctcaaaaaaaaaaaaaaaaaagaaagaaagaaatgggaagtcactgatgattgaaaaagaagggatcagttgaatgctggaagtgaatgtttgattcaagcaagaattcaagggttcaagtaaaagttggaggcaagacttgaagagaaagtaaaagcaagctttcagagtatgacattctttctttctttcttttcttttttttttttttttgagatggagttttactcttgttgcccaggctggagtgcaatggtgcaatctcagctcactgcaacctccacctcccaggttcaagcaattctcccgcctcagcctcccaatagctgtgattacaggcatgtgccaccacgcctggcaaatttttgtatttttagtagacacagggtttcaccatgttggccagtctggtttcaaactcctgatctcaggtgatccacccgccttagcctcccaaagtgctgagattacaggcgtaaaccactgtgcctggccacgagtatgacattctcaaaggggctcagaagaggggaattaccatagagggaaatatagttaccactaatttttgttttaaagatggtgaagggggcctgcccctccacacctgtgggtatttctcgcaaggtggagatgagagactgagaaaagaaataagacacggagccttgggcccaggggaccggcgctcagcatacgaaggacccgcaccggcactggtctctgagttccctcagtatttattgatcactatctctactatctcagcaagggggatgtggcaggactataaggtaatggtggggagagggtcagcaggaaaacatgtgagcaaaggactctgtgtcataaataagtttaaggaaaggtgctgtgcctcaatgtgcatgtagaccagatttatgtttgactttacacaagcatctcagtgcagtaaagagcagtattgcccccagcatgtctcacctccagccataaggcagttttctcctatctcagcaaatagaatgtatgatcaggttttacaccgagacattccattcccagggatgagcaggagacagatgctttcctcttatctcaactgcaaagaggccgtcctctttcactaatcctcctcagcacataccctttacgggtgttgggctgggggatggtcaggtctttcccttcccatgaggccatatctcaggctatgtcagtgggggggaaaccttggacaatgcccaggctttctcaggcagaggtccctgcggccttccgcagtgcattgtgtccccgggtactcgagactggagaatggtgatgacttttaccaagcatactgcctgcaaacacattttaacaaagcacatcctgcacagccctaaatccattaaatcttgagtcaacacagcatatgtttctgcgagcacagggttggagctagggttacagattaacagcatctcaaggcagaagaatttttcttagaacagatcaaaatggagtttcttatgttttcctttttctacatagacaaagtaacagtctgacctatctttcttcccccaacaagatgggcgagcagaagggaaaaaatggctttattctgtatgtgtgcatgtgtgtttatgtgtcttttaaaggagaagaccatcattggagtatgctgatgaaaataattcccttgagcctggcgcggtggctcatgcctgtaatcccagcactttgggaggccaaggcaggtggatcacgaggtcaggagttcgagaccaggctgaccaacatggtgaaactccatctctactaaaaatacaaaaattagccgggcttggtggcacgtgcctgtaatctcagctactcaggaggctggggcaggagaatcgcttgaacccgggaggtggaggttgcagtgagctgagatcgtgccactgcactccagcctgggcaactgagcaagactccatctcaaaaaaaaaaaaaaaatcagagcttagtcttcacttgtgaaatagatttgtgaagggagcacctgcatccttggagagctctgtgattgatcttctctgtatgccagatcttacaatgggaaccagtcactcaattgaaaaacttaaatgcagtgggaataactggatcttaaggaggtagggaccaactagcgagacttatggcccctcaatttccagacttgagccagtttacagacccaggatcccttgaatgaaagggaagctggatttccttaagaaaagatctcactgcacgacaatttatactgtcaatctttctcccatcctttgccaaggagaccgctggccttttaccagggtaaatatgcattgaggaaagtggaatgatcagaccttttggggactagtggacccggctctgagctaacattgattccaggggacccaaaacatcattttggtcctcagttacagtaggggtttatgggagatcagataattaatggagttttagctcaggtctgatttacagtgagtccagtgtgtccccagactcatcctgtggtcatttccccggtgccaaaatgcataaatggaatagacatacttagcagcaggcagaatccccgcattagcttgctgactagtagagtgagggctattatggtgggaaaggccaaacggaagccactagagctgcctccatctagaagaattgcaaataaaaaacatcacaggccaggtacagtggctcacacctataatcccatcactttgggaggttgaggctggtggatcacgaggtcaggagtttaagaccagcctgaccaatatggtgaaactccgtatctactaaaaatataaaaatacaggctgggcgcggtggctcacgcatgtaatcccagcactttgggaggccaaggtggtcagatcacgagatcaggagttggagaccagctccaacagtaaaaccccatctctactaaaaatacaaaaattagctgggcatggtgtcatgtgcctgtgatcccagctgctcaaaaggcagaggcaggagaatcgcttgaatctgggaggtcaaagttggagtgagctgagacggcgccaatgcattccagcctcggcgacagagcaagactccgtctcaaaaaaaaaaaaaaagacaaaaaaaccccacaaaagttagctgggcgtggtggcgcacacctgtagtcccaactacttgggaggctgaggcaggagaatcgcttgaacccaggaggtggaggttgcagtgagctgagatcgcgctgcactccagcctgggcgttaaagcaagactccatctcaaaaacgaacaaaaacaacaacatcatgtctctggacttgaaagatccaggggtggtgattcccaccacatctccactcagctctcttatttggcctgtgcagaaggcaggtggatcttggagaatgacagtggattatcataagctcaaccaagtggtgcctccaatggcagctgctgtaccagatgtggtttcactgctcgagcacattaccacatctcctggtaactggtatgcagccactgatttggctaactgcttttttttccttccattcctgtccataaggcccactagaaggaatctgccttcagctggcaagaccagcaatataccttccctgtcctgccttggaggaatacgggctctccagctttatgtcataatcttgctcacagagatcttgatcagttcgctttcataagatatcacactgctcctttacattgatgacgttatgctgagtgggcccagtgagcaacaagtagcaaccacactgaatttattggtgagacatttgtatgccaggggatgagaaataaatctgggtaaaattcaggattctttcgcctcagtgaaatttctaggggtccggtggtgtggggccggtcaagatatttttcttttctttttttttttttttaaatggagttttgctcttgttgcccaggctggagtgcaatgactcgatctcggctcactgcaacctctgcctcccaggttcaagcaattctcctgcctcagcctcctgagtagctgggattacaggcattcgccaccatacccggctaactttttgtatttttagtagagacggggtttcaccatgttggtcagactggccttgaactcctgacttcaggtgatccgcccgcctcggcctcccaaagtgctgggattacaggcatgagccactgcgtccggccaagatcttccttctaaggtgaacgataagttgctgcatttggcccttcctacaacaaagaaagaggcataacgcctagtgggcctgtttggatttggagacaacacatttctcatttgggtgtgttactccagcccatttatcaagtgatccaaaaggctgccaatgttgagtgtggtccagaacagaagactccacaacagctccaagctgttgtgcaagctgctctgccactgggccatatgacccagcagatccaatggtacttgaagtgtcagtggcagataggcatgctgtttggagcctttgtcaggcccctaaaggtgaatcatagtggggcctctgggattttggagcaagggcctaccatcctctgcagataactactcaccttttgaaagacagctcccagcctgttgctgggccttggtagaaactgaatatttgactatgggtcaccaagttacaatgagacctgatctgcctatcatgaactgggtattttctgattcatggagccataaagctgtgcatgcccagcagcattccatcatcaaatggaaatggtatatatgtgattgggctcaagcagttcctgaaggcacaaggaagttacatgagaaagtggctcaaatggccaggcatggtggctcacacctacaatcccagcactttgggaggccaaggtgggcggattgcttgaggtcaggggttcgagaccagcttggtcaacaaggcaaaaccccatctctactaaaaatacaaaaattagccgggtgtggtggtgcatgcctgtaatcccagctactcaggaggctgaggcaggagaatcgcttgaacccgggaggtggaggttgcagtgaactgagattgtgccactgcactccagcctgggtgacagaatgagactccatctcaaaaaaaaaaaaaaaaaaaaaagagaaagtggctcaaatgcctatggtctctactcctgccatcctgccttctctccctcagcctgcatcaacatcctcatggggagttccctatgatcagttaacagagcaaaagaagactagggcccagtttacagatggttctgcatgatatgcagttaccacctgaaagtagacagctgcagcaccttctaggacatccctgaagaatagtggtgaagggaaatcttcccagtgggcagaactttgagcagcacagctggttgtgcacttcggtttgaaggagaaatggccagatgtgtgattctatactgactcatgagttgtagctaatggtttggctggatggtcagggacttggaagaagcatgattggaaaattggtggcagaaaaatctggagaacttccatccaaatgttgatggacccgagtggtcaaaaacagtgaagatatttgtgtcccacatgaatgttcaccaaaggatgacctcagcagaggaggattttaataatgaaatggataggataactcattctgtggataccactcagcctctttccccagccactcctgtcatcacccaatgggctcatgaacaaagtggccatggtagcagggatggaggttacacatgggctcagcaatatggacttccattcaccaaggctgacctggctatggccaccgctgagtgcccaatttgccaggagcagagaccaacactgagccctcaatatggcaccattccttgggagtgatcagccaggtacttggtggcaggtcttccatcatggaaagggcagcagtttgtccttgctggaatagacacttaggccagatatggatttgcctttcctgtgattctcccacctcggtctcccaagtagtagctgagattataggcgtgcattaccacgcccagctaatttttgttttttctctgtttttttgagacggattctcgctctgtcacccaggctggagtgcagtggtgtgatctcagctcactgcaagctccacctcctgggatgacaccattctcctgcctcagcctcccgagtagctgggactacaggtgcccaccaccacgcctggctaattttttgtatttttagtagagatggggtttcaccgtgttagccagatggtctcgatctcctgatcttgtgatctgcccgcctcggcctcccaaagtgctgaatttttgtattttcagtagagatggggtttcaccatgttggcaaggctgatcttgaactcctgaccccaggtgatccgcccgcctcggccttccaaagtgctgggattacaggtgtgagccacagcgcccagctgactgctgaacttttttttttttttttttgaaatggagttcacctttgttgcccaggttggagtgcagtggcacgatctcggctcaccacaacctctgcctcccaggttcaagtgattctcctgcctcagcctcccaagtagctgggattacaggcatgcaccaccacacctggctaattttgtatttttagtagagaaggggtttctccatgttggtcaggctggtctcgaactcccgacctcaggtgatctgctcactttggcctcccaaagtgctgggaataatgagccaccaagcccagccccaagaaaaaaagttttttttttcaaagctgaagcctggaagaacatataggtgactaaaaattagacaaaaagaaaaaaaaaaaaacagaaaaaaagtcaatgtagtacaccgcactgacaaagtgaaggacaaaaatcacgtgatcagctcaattgatgcataaaaagtatttgagaaaatccaatactgttcatgattttaaaaaaccatttaaactagaaagagaagaaaataccagaacatgagatttagctgtgatttcttggatacaatatgaaaagcactggcagaaaagcaaaaacagatgaaaggaactacatctaaatgaaaaacttctgtgcatcaaaagagaatgctccagcaaggatgtagaagagcgagctcctgtttcccaacacaaaagtaaaatctcaaaacttgcaggttaaaatatcacaataaaacattcactgaaaaacatgttttaaatctcatatcgatgtataaatacgttactataaatcttgtgctgactcttgccatgaactgagaatggtggttctccactgagcacgaggaaggaagcggaacagaaaagacgatgtgttacatcttagtgcctaagctataagtttggagttttactataaaacattcaccatgtgatgttcaaaataaaatagaatatttaataattattgggttaaaaaaatggttcaattctctccaatggcaaagaagctgtgattcactgtatgagcacagtgataaccattctcacctaaaacacagttcacaggggttcctccaggaatacaacatctctgttctggtctgtctgaaaatagtttaatgtatctcctgctgtttgacatttatgttgacttcatatattaaaatgtgaggaatgaaaaaatcctatcactgatgtttccatctaaactttccattccattcccagtcattaagagtttgaactcagaaacacagtgactcacttgttcagttccaaatataataaaaacgaggcaggaaagatttccccatagtgttctcattttaaagcattcaacaggaacttgtgcatattaatacctgacgtcatgggcaacttcttgaatcctggtctacaaagaggtggcatacatccaaatgtggctcctaaacaatccctgctccccagaagcactgaaaccacaaggcccacaccccatctccaatccatgtctgggtgtcagcccttccaaggaccatgcccagcagagcctcttcagaagttcatgtcactaggtcatgcaggatggaatctaagtgagatgagagggactgagggaaggcatgcgtgagtgagcaaacatgtcaggcaggatgtttcaaagatttgcaatgacattttgttacagtaggtagcttacctggtatgagaaggagagggctccccctccccattcacacacatcaggaatgagccaggcaaccatcaggtgatggtcaggtggttgttaactgtctctctaaaataataattagtcacagccggcaccagggaaaggcatagatagaaaacacctgaaactggtgatcagcctcttcccatgagatctcaggagttgggcgagtggactaaagcatgtgcatgtggacagcccaccccaaggcaagaacagcccaccccaaggaagcaagaccccggaagtatgccaacgtataaaaccctaagtcaaaaggtcaaactgcacacttgcctttcaagtcgatcacttggccctcttccaagtgtactttccttcctttcagttctgctctaaagctttttctttttttttgagtcaaagtctcactttgtcgcccaggctggagtgcagtggtgtgatctcggctcaccacaacctccacctccagggttcaagtgattctcctgcctcagcctcccgagtagctgggactacaggcgtgcaccagtaggctcggctaatttttgtatttttagtagagacggggtttccccatcttagccaggctggtattgagctcctgacctcaggtgatccgcctgccccggcctccgaaagtgctgagattacaggcatgagccaccacacccagaaaaaaatttaaaatttaatatgtgttatattataaacagagaaatcaatatgtcacaatttaatcaactcatccaatcaacacccccaaccttgttcattattctgtgtttccctcccttattccgtacatatctctcattctcatcttctctaactcttgggttcttttctgtttccccctgggtttctgctcctcattttgagcctctctcctctcttgctgtttctccgcttcttcctgctattccatcttttccacctgttctgctccagtcttacaacttgtttcacctcctgtccctctttctccccaatcactggattgtccccagtgtccatacatttctgcctctgtctttccccatctctgcttcccctgttaaattccctcttccctgtttacacccccttgtcctcagtctctagcaccctcagatccctaggcttacactgaggtctatgatccattctgagttaatttatgcacaaaacgtgaggtttttgtctggatttttttcttttttgcatttggatgtccagttgttccagcaccaaaactcaaacagaaacacacaatctgaacaggcctatagcttttaatgaatttgaaccaataatccctgagcaccctgctgtggttcttcttctgctctccttgtcaccagttgccccttcttgctgtcccagcaccacgctgctgcctgccgtggctccaaatccctcctcctctccctcactctctgtctgaggagcctcccctctgctgcccctctccctaccttgctgtccttcacctttctggacatggagcttttctctacatttctccagttgtttccccatcctgttactttctcagcttcttctttgactcttcctgtctcttcgcgaatcccccacgcatcctccattttgccatctgtttatgggtttccctcattctctgtctcagtttgtctacttctctcgcagtccctgtttccagatccccttggcccacacattcacaggagggtttagggtaagacacctgcatcccgcaggagcacatttttccagggggtggagctgggaaggcaagaacaccaggtgtcacaggacaggccctgggcacctccctaacgcgggctcaggggaagcggggactgcaaacgagaggcctggggagcagcagggcccagcaagagttggagggaggtgggggcgaaggcgccttaggataggggtggggtctgcaggatcccgccaggcagaggacgcagcctccctgggactggggctgcggggccgacgagggcgaggctgggaggcgcccaggacgcgactccacctcgcgggtgaggacttgaaaaagtgcggggcaggatgaggggtcagtacagggtttcgaacggaaaaatttaaggaaagaacatgtctacatgacctgaaggcagaaacaccggcgacggaaccagcctcagaatgattttaccccaaatcactgaaacgaccccaagagtctcatagcgatgtgtgacttactagcagtgaggggagcggtatgagaattttcaggcgtgtacgaacctccaaatccggggtatggaggtgagaggactgcgaagcccaagtttaatcttaataatagacagagggaaatccacgcgccgccataccaggttcactccgcgcgatctgtttccgggtctgcaggaaactaagcgcagagcggaatcctgggcgggtcccgcgagcgacggcgtcgggagggaagaaggaagggggcggggcctccgcggagtgggggggcctatgctttcctcttctggctcccatggcatctctatttttcgggtttaggaggcaacatttaccagtgaggctgaagcaactcagcaggatctccctggggcagggcaaaccgttggtgattggatccaggaaaattcctgctattgaaaaagtttagcaacttaatttaaaagccccagaattgtctgtgaaggggatgcaaactggaacgtgaaaggcaaactctgcatggggggatggatcaatcccatgctgatgtcccacaaaacaaaatagaaatccttttattttttatttatttatttttttgagactgagtcttgctctgtcacccaggctggagtgcagtggtgcgatctcggctcactgcaagctctgcctcctgggttcacgccattttcctgcctcagcctcccaagtagctggaactacaggcgcccgccaccacacccggctaatgttttgtatttttagtagagatggggtttcaccgtgttagacaggatggtctcgatctcctgacctcgtgatctgcctgcctcagcctcccaaagtgctgggattacaggcgtgatccaccgcacctggccctagaaatccttttattttctaatctccatttactccagagagtcaaccttgtacttgtttccaaagactgactttgttttttttttttttttggaaacgtagtttcaaatctgtcagccttggcttcccaaagtgctgggattacaggcgtgagccactgggcctggcctccagagactttcatagacgcaacacctggggtgttaagcatggaaagctaggtctgtcatcaccctggattcatcttgtctctgcccagaagagacagtgcactgaaaacaggagagttttgcagcaaagagtttaattatcgcagggctagccaagtggaacaagttgggagagggggaagttagttctcaaatctgtcgcccgaaaagttgggagactagggttttgaggataattcggagagcaaggggctagggaattggtgtggctcattagttgtggagaaaatcataagagggttcaaaacaggcctcctggagctgagtcagtttctgggtgacggtcacaggaccgggcagtgccagttctctggtaccagtgaagaagacgtccaggtggcctgaatgactctgcccaattgtaaaagtctgaaaaatacctcaaagaccaatcttaggttttcacaatagtagtgttatctacaggagcaactgagaaattacaaatcactggttattgtttctgtctacattttagcagaattcagttacctcccataatcctaacatttagcctttcattagtcttagaaagttggtttcagtcacctgagagggtcactttgggagggactagtatcatcctttcttcaaagtcataactataaactgaattccacccatagttagctgggccaatgcccagtaatgagcaaacacagcttgtgaggttagaagcaacaattaggttagatttctctcactatcatgatttttgcaaaggtggtttcaggttcagtgatgttagatcaccgatttttgctttaaataataagcaatggccgggtgcagtggctcatgcctgtaatcccagcactttgggaggctgaggcaggtgggtcacctgaagtcaggagttcaagaccagcctggccaacatggcaaaaccctgtctctactaaaaatacaaaaagtagccgggtgtggtggtgcatgcctgtaatctcagctacttgggaggctgaggcagaagaatcacttgaacctgggaggcggaggttgcagtgagccaaggttgtgacattgtactccagccttggcgacaagatcgaaacttccttgaagaaaaacaaaacaaaacaaaaacctaaaacatctgatgggagaaagaacgcacaaataataacacaaaacccccaaacaatatgattactgagtgctctaatggtaaggagaaatttaaaccagctggttattaatcttaactttagccaagacagaaccccaaattcacctacatacctaggaatgggtataccatcctaggaggaggaaaaaaactgaaattcaccttcccaattggaagcgagcttaaactttagaaaggagttacctgccttctactgtcatggaagcaggaaaacgtgccttccttattggaagcaagtaaaactccagaaaaagatgtacagcaaaataaagttaagatctcaaccaaattttgatagatcagggattctctagagagggagctcccaggcctcagccaattgtcctactggtttgagccataaggatagctcaatctggtaccaagcaccaataggagatcgtcaaaggtcagggcccactctactcagagttacttccttgggtcaccaatttgtcaacgaagagtacctgagacaggtctcaatcaatttagaaagtttatattgccaaggttaacaacatgcctgtgacacagcctcaggaaatcctgatgacatgtgcccaaggtagtctaagtacagtttggttttacacattttagggagacatgagacattaatcaatatatgaaagatgtgggccaggcgcagtggctcatgcctgtgatcccaacaatttggaggccaaggtgggcggatcacaacgtcaggagttggagaccagcctggccaacatggtgaaagcctgtctgtactaaaaatacaaaaattagcctggtgtggtggcacgtgtctgtaatctcagctactcgggaggctgaggcaggagaattgcttgaacctgagaggtggaggttgcagtgagctgagatagggccattgcactccagcctgggcgacagagtgagactctgtctcaaatttaaaaaataaaataaaatagaaatatatgaaagatgtccatcgacttggtctggaaagtcacacaactcaatcagggaggaagcttctaggtcataggtagataacagacaaactgttgcattcttttggagtttcagattaggctttcactgaattcgtgatttacaggaatagtcacttatgccttagtctggcttagtgaaacaataggacaaaggaaaaaatcagatacgcatttgtctcatgtgagcagagggatgacactgagttctgtctgtcctttgtccacaaggaatttccttgtaggtaaattttgaggaaggtatgtagcttttaaaaatctttgtagctatcttatttaggaataaggaataaaatgggaggcatatttgcctgacagagttcccagcttgacttttcccttggctaagtgattttggggtctgagatttattttcctattacacctccttgtaatatcattataagagaaatgcaaattaatatggatttttttcaaataagttaaagtaggaactactttgtgtgtgtgtgtgtatgtgtgtgtgacagaatctcattctgtcacccagactggagtgcaatggcatgatcattgctcattgcagcctcaggtgatcctcccacctcagcctcctggtagctgagactacaggcatgtaccatcatgcctggctaatttttgtattgcttgtaaagacaggattttgccatgttgcccaggccagtcgcaaactcctggtctcaagtgatcctcccacctcagcctgccaaaatgccaggattacaggcatgaaccacttagcccatccaggaagtactttcatctcttgagtatatattatagcctgtgtcacacacaaaaaagagaatgtacatattctaacacagatggaacaatgaaaatgtttactactgtcaaagaacaaatttggacattggttagaagagattctattcaaaaagtatattgtggtagggagaatgctccaaccacaagatctgcaaatgtttgagtcacaagaaatgggcttttcttttctctaaagaaggaagcaaggctagaaagcaccaggtacagggcaggggatgagcatctgctgtgacctattcagggaattttttttttttttttttttttgagacagaatctcattctgttgcccaggctggagtgcagtggtgcaatctcggctcactgcaagctccgcctcctgggttcacgccatcctcctgcctcagcctcccgagtagctgggactacaggcgcatgccaccacgcccagctaattttttgtatttgtagtagagacagggtttcaccgtgttagccaggatggtttcgatctcctgacctcgtgatctgcccgcctcagcctcccaaagtgctgggattacaggcgtgagccaccacgcccggcccaaacaaagattttaaaaaataataaatacatgtgttctacttgaaaaacagaactaaaagtaataagaacaatagcaaactttgctccttacctcagtttttgaatgacattgaagggtcctcaatgtgcatttcggctgtgtggtattcatttcgatcacatgcaagacactgatcagttcttgttggaagatatggctctacatttctaacttcaagggtctctgtaactgtcgaattaagcagaaagctagggtcatattaagaaaaatagtgttcccttatacatttttctgctgatcatgggaaaacatattctcacagcttcatgaattatttggtcacaatttgacaataaaaacactaatttatatgtcagatccatgtcacattctcatattaatctaaattttcttttttttttttttgagacagagtcttgctgcattgcccaggctggagtgcagtggcgcgatctcggctcactgcaagctccgcctcccaggttcacgccattctcctgcctcagcctcccgagtagctgggactacaggcgcctgccacctcgcccggctaattttttgtatatttagtagagacagggtttcaccgtgttagccaggatggtctcgatctcctgacctcgtgatccacccacattggcctcccaaagtgctgggattacaggcatgcgcccgacctcaatctaaattttcttgacatcctttttggtaccagctgagccctgacaaaggaaggtaattcagagacattttctcttgtgatcagagaaataacctaatgagaataaacttatgttgattgggtttttttgttttttgtttgtttttgagacagggtctcactctgtcccctaggctggagtgcagtggcatgatcacagctcactgtaccctccacctcctgggctcaagccatcctcccagctcagcctcctcaatagctgggactagagggtcacgacactatgcccagctaatttttttgtattttttgtagacatagggttttgtcacgttgcccaggctggtcccaaacttctgaactcaagtgatccgcctgtgtcagcctcccagtgtgttgggattacaggtgtgcaccaccatgcccagctgaaaataaaattaaggtgaagaaagttgttctctgtgatctcaggggaaaaccttcaggtaaatttgcattcagattgaatagaagaaacatacaaatgtggatgaactagatactactttaaaagtctttctagcgccaggctcagtggctcatgcctgtaatcccatcactttaggaggctgaggcaggcagatcatgaggtcaggagatcaaggccatcctggccaaagtggtgaaaccccatctctactaaaaatacaaaaactagctgggcgtggtggcatgtggctataatcccagctactcgggagggtgaggcaggagaatcgcttgaaccagggagctggaggttgcagtgagccgagatcacgccactgcactccagcctgggtgacagagtgagacacctttacaaaaaataaataaataaagtatttctgtccacaaaccagcttggagtaggtaggtagccaggcatgagcagttaaaggagcccctgggaaaggaatcttaagaaacacagcccactgacaatccccttttgacagcaaaagcaggacagtggctacattgcctacacctgtccttgtggctggacttgtctggcccaggaagggagttatctggccctagccagaaataacccagctaggggattttccctattaaggagcgtgcacactcctctaataattcatcctagaatggccttttgctcattataatactaagaaacacatccccttttttcaaatatgattttagaaaaaaataaataagggctgggtgcggtggctcatgcctgtaatcccagcactttgggaggccgaggcaggtggatcacgaggtcaggagatccagaccatcctggctaacacggtgaaatcccgtctctactaaaaatacaaaaaaaaaattagctgggcgtggtggcaggcacctgtggtcccagctactcaggaggctgaggcaggagaatggcgtgaacccgggaggcggagcttgcagtgagccgagatagcgccaccgcactccagcctgggcgacagagtgagactccgtctcaaaaaaaaaaaaaaaaaagccacacccctgggtggagatttgagatgctaaggagatatgtgatgtgtgcatggacagtcacagcacattcctgcccaaatgacttcccagaacatgcttactaataatggctgtgcacggccccttcatgaataatcatgtcaggttctcattaaaagggtcaggccagcataagtaaggacagactccttcttttcaggagcccactcggttctgtcgttcagggtgtcgcttctttctgagctcctgtctctttaaatgaagggcatttaccctttaactctttctgcgcatctcttgactgaatccaagaagaccaagaaccagaggacttccacacccctctgggtaacatctggtgttttcacctggttacctggttacctcgcctggttatccaggtaagtaccaaaaagctggtgccagattctctggttgacgacctctgcttctttctgcactgaagaacctcctgccctaatgcagatctggcagctttaaggggaggggtttttcctctcaggctctgttcactaacgactgcccagtaccatttcccttcagccactgtcactctgctccctctggctgatttctcagctcaccctgaggggtgataagcagaggagggaggatttaaactccacagtgagtagatctgagacacatggtgacccttcttgcaggaggcttgtgaaggtggcagggaatacgcctggctgtgcagtgactggggagcttcatatttttttttgtgggggggaggacagagtctcactctgtcgcccaggctggagcgcagtggtgtgatctcggctcactgcaacctccacctcccgggttcaagcgattcttctgcctcagcctcccgagtagcagggactacaggcgtgtgccaccatgcccggctaatttttgtatttttagtagagacagagtttcaccatattggccaggctggtctcgaactcctgacctcgtgatccgcccacctcggcctcccaaactgctgggattacgggcgtgagccactgcgaccggcgcatatcttttaattaaaactacaatccggtgttaagtcagctcttatacttgccattcatggccgttcactcccctgaacaccatatgcccccaccgttgattaatctcccaggtcactctgcttactctttgctgtccctctcctcgccgcagggatttcatgaattcttcctgcgggtgcaagcctcttgcagggcctgtttatccaggacctgctgcgtttgcttcactcaggcgccagagtcctttgagggcctatgctgatgtttatacttttttcctcagaaatgagactcagctttgtcctttcccttgcctcctgtttcactggagggaccggcactgggaggatgcctgcttaaagaaatccctcattttggccgggcacggtggctcatgcctgtaatctcagcactctgagaggttgaggggggtggatcacctgagggcaggagttcaagaccagcctggccaacatggtgaaaccccatctctactaaatatacaaaaattagccgggcgtggtggcacacgcttgtaatcccagctacttgggaggctgaggcaggagaatcgcttgaacccgggagctggccattgcagtgggccgagatcgcaccattgcactccagcctgggcaacaagagcgaaactctgtctgaaaaaaaaaaagaaagaaagaaatccctcacttattattgggtccttctccgcctgcctactcttcaagaatgcctcattctgtgactcctcaatggaactgcctggctcttccagagggtcacctgtgaccacttccttactccctagtttctctgtacaaccagggtttccaatgggccacaggagactgctttctccacctcattaggccattgtaacagacccgtgaagtactcaggtcctttttgctttttgttgaataagctgatagaaaatgcttctcacattccccttgctgtttatgtgatcatataatggactaaaaaaccagaatcaacagcccagttcactaactctgagccccagggggtcttctatgcttttcaagcatttttttctgtataaaccccaaggaaccttttaagagtgggggaagatatcacatcttttccgttcctgtaatcattagtattagcccaatatcattatgtattaagaagacctaggctgggcgcattggctcacgtttgtaatcccagcactttcggaggccaaggcgggcgtgtcacccgaggttgtgagttcgagaccagcctgatcaacatggagaaaccccgtatcggctgggcacggtggctgatgcctataatcccagcactttgggaggctgaggcgggcagatcacgaggtcgggagtttgagaccagcctggccaatatggtggaaccctgtctctactaaaaaattagccgggcctggtggcatggatctgttatcccagctattcaggcggctgaggcagaagaatctcttgaaccctggacacagaggttgcagtgagctgagatcgtgccactgcactccagcctgggtgacaaagtgagactccatgtcaaaaaaaaaaagaaaccccgtctctactaaaaatacaaaaatagctgggcatggtggtggacaccagtaatcccagctactcaggaggctgaggcagaagaatcgcttgaacccaggaggcggaggttaccgtgagccaagatagcgccactgcactccagcctgggcaacaagagagaaactgtctcaaaaaaaaggactttagaagtcccttctctgcagaattcagcaggggcacaactactgggcttcctgcagaaccaaggtcactgggaacatgagagaagagaagagaactactctcatggcagacattcttccacccgtccttacccaacacggaagagtggaaggcatcactgctgggcatcaatcccaggaaatctaagaaatccttctgagcaaaacaataggaagaaatgcaaacagcagagcacacagtagggctaattccagagctccaaggtgaaggacacttcacccttgcagggagaggcatgagacacctcatttaggtcaaggattggaatgcctgaccttcatgagtcaccaaataggtaaagggacacttcctctatcctgcattctctcttgtcttgtctttcagatgggtaatcagatctttatatcccaggattcccctcctggatccccttggaatctgggaaaaggttgatccccagattgtaaaacaagagactgattttcctttgcaatatagtttggtcaaaggtggggagcttaaatgttaataccatattccagcttgacctttactgccaacaccaacacaaatggtcagaagtcccttatgtgaaaatcttcatgatctcgtgggaaaaccctgatttttgtaaaggctgcaaaacgggctcaaaagaaaaagaaaaggaaaggaaacagccaagggcggtggctcacgcctgtaatcctagcactttgggaggccaaggtgggctgatcacctgtcaggtaaccaggtggccaggtgaccaggctggtcaggagtttgagaccagcctggccaacatggtgaaaccccatctctactaaaaatacaaaaaaattagccgggcatggtggcggtcacctgtaatctcagctactcgagaggctgaggcaggagaatcacttgaaccccaggaggcggaggttgcagtgagctgagatcgcaccattgcactccagcctgggagacaagagcaatactacatctcaaaaaaacaaacaaaaaaaaggccagccacagtggctcatgcctgtaatcccagtactttgagaggctgaagcaggtagatcatctgaggtcaggagttcaagaccagcctgaccaatgtggagaaaccttgtctactaaaaatacaaaattagctgggcatgctggtacatgcctgtaatcccagctactcgggaggcttaggcaggtgaatcacttgaacctgggaggcggaggttgcggtgagccgagatcccgccattgcactccagcctgggcgacaagagcaaaattccatctcaaaaaaaaaaaaaaaaaaaaaaatacaagccattcaggagtttggacaaaaggtactgcctgctcttgaccctttcaggaatcaacacccattataccaaccagggtcaaaaaacctggagagatgggtcatctgggtctcaactcccttatggaaagacccctttactgtcttactttccaccccaacagctatcaacatttctggcatctccagttggatacatcagtctcaagtgaaactgtgggaaggtcccgaagaaccacagaagaacaacagaattcagcacctgagcattcttgtgagccactggagaacttaaaattccacttcaagtgaaaagataagtaaagccttctctctgttcacccaaaactaaagtcaatctcagtacggggaatcttggttgcggtggcattggttcttctccttattttgacccaactggcatgccacctgaagtcccgataacagcctgatttctcactaaacactccatcgaaccacttcattatttgtctctcctattttcagcactttccttttgctttcacaaagcttaagggagaatcagctatgacagagaaattccttttcctttatctttccctccttcccatgcccctactctcacaggcacagtggaatgaaaattcccttgtcagtttttccaaaataattgcttcgggaaaccatctaagcaactgttggatctgccacaacttcatcaccaggtcctcatcttaccaatatattttggtaagaaatttttctttaaacctaacatttggttcaggaatccctgaaggccaacataaatctgttccgctccaggtttcgcttgctaactcagcgcaccaagtcccctgcctggatctcactccacctttcaatcaaagctctaaaacttctttctatttctacaactgctcttctctaaaccaaacctgttgtccatgccctgaaggacactgtgacaggaagaacacctctgaggagggattccccagtcccaccatccatcccatgagcttctccccagcaggctgccaccctaacttgactcactggtgtccagctaaacaaatgaacgattatcgagacaagtcaccccaaaaccgctgtgcagcttgggaaggaaaagagctaatcacatggagggttctatattcgcttcccaaggcacacactgtccccacatggccaaaatctactgttcccctgggagggcctctatcccctgcatgcaatcaaactattccagcagggtggaaatcgcagttacacaagtggttcgacagccacatcccccggtgggcctgtacccctcctggctatgtatttttatgtgggccacaaaaaaataaactgccctttgatggaagtcctaagataacctattcaaccccccctgtggcaaacctctacacttgcattaataacatccaacatacgggagaatgtgctgtgggacttttgggaccacgggggataggtgtgaccatttataacaccacccaacccagacagaaaagagctctgggtctaatactggcagggatgggtgcggccataggaatgatcgccccatggggagggttcacttatcatgatgtcaccctcagaaatctctccagacaaatagacaacatagctaagagtaccagagatagcatctctaaactcaaggcctccatagattctctagcaaatgtagtcatggacaacagattggccttagattacctcttagcagagcagggtggagtctgtgcagtgatcaataaatcctgttgcgtttatgtcaataacagtggggcgatagaggaggatataaaaaagatctatgatgaggctacgtggctccatgactttggaaaaggaggtgcttcagcaagggccatctgggaggctgtgaagtctgccctcccctccctcaactggtttgtccctttactgggaccagcaacagttatactcttacttttcctctttggcccttgtttctttaatttactgattaagtgtgtctcttctaggataaagcaatttcacatgaagtccccccaaatggaaagatatcagctatctgtcattggaggccccagcacctataagcacatctcccccttggatgccagtgggcaaagattccgggaaactatggaggaattttctctctgagacagagcaagagagggagaccctgatgacttcttcgccccatgtcagcaggaagtagttacagaagacccacgacgtccttacaaccagagcttttcagggtctccatctcttgaggagggaaatattagggtaggcaggtaggcaggcatgagcaggcaagagagcccttgggaaaggaatctttagaaacgcagcccactgatagcttccttggtgatgctgcccacagacagtcagcacttctctaataacccatcctagaacagccttttgcttttttttttttttttttttttttttttgagacaagttcttgctctgtctcccaggctggagtacaatggtgcgatctcggctcactgcaccctccacctcccaggttcaattgattctcctgtttcagcctcctcagtagctgggactacaggcatgtgccgccatgcccggctaattttgtatttttagtagagatggggtttcaccatgttggtcaggctagtctcaaactcctgacttcaggtgattcgctcgcctcggcctcctaaagtgctgggattatagacgtgagccactgcgcctggctactcagaacgcttctgaatggcacattcatgaaaaatcatgtaaggttctcataaaaacatctgcccagccattagtaggagtagacacgtccttttgatcagcccgccctgttctgtctttctgggtgtactgttttgatgactttaaaagctcccataaaaactaaggcactagcagctggctcattcttctgatgtcctctctttttaaataaagcttacttaaccctttaactctttctgtgtgtctcctgactgaattccttccttgaggaagaccaagaactgaaggattccccacccctcgtggtaaccaaaggtctatgaaggatttagtgcatctaaactagtaaatacaggctgggcgtggtggctcacacctgtaatcccagcaccttgggaggctaaggcaggtggatcacctgaggtcaggagttcgagaccagcctggccaaaatggtgaaaccccgtctctattaaaaatacatatattagccaaacgtggtggcgggcacctgtaatctcagctactctagggggtgaggcaggagaattgcatgaacccgggagatggaggttgcagtgagctgagattgcaccactatactccagcctgggcaacagagcaagactccatctcaaataaataaataaataaataaatagctaaataaataaactagtaaatacaaactgcactcaactgtccaagaaatattctttatttcttaaacgttgggaaaatataattaaaggcaaaataattttctcctcacccagaaatcctctccacaaaggaaaacaataaattgataatcccagcccagttagtggttggtgaatgcctctaccttaatcaatacatgtttcgaagcagtcagcatctattttctcatgaaagatgactccagagaacctggtctttgctttgcctggtaggtgaggaataccttaatcttatcagaaatatataaattggtcgggtgcggtagctcatgcctgtaatcccagcactttggaagtctgaggtgggtggatcacgaggtcaggagattgagaccatcctggctaacacggtgaaaccccgtctctactaaaaatgcaaaaaattagccgggcacagtggcgagtgcctgtagtcccagctactcaggaggctgaggcaggagaatggcgtgaaactgggaggcagaacttgcagtgagctgagattgcgccactgcactccagcctgggcgacagagcaagactctgtctcaaaaaaaaaaaaaaaaaaaaaaagaaatatataaattatgtggtttttcacaatatttactaaatttctcaactcacccactgtgaagacagcacaatttgaaagggacaccactcccttgtaatggaacacaaactcagcttctgctccgtaacaataaatagtaatagcaatactaaatgaaatattaagtagtttcatgtaagtatgtatacaattgatagtttgttattattttcagttttgcaattggtacaaattccatagaataattttccttctttctttttttgagactgagtttcgctcttgttgcccaggctggagtgcaatggcgtgatctcggctcaccacaacctccgcctcccaggttcaagcaattctccttcctcagcctcccgagtagctgggattacaggcatttgccaccacgcctggctaattttgtatttttttagtagagatggggtttctccatgttggtcaggctggtcttgaactcccaacctcaggtgatctgcccgcctcggcctcccaaagtgctgggattacaggcgtgagccaccgcacccagcctgaaaagttttttctgcagctattgagataatcatgggggttttgtccttagttctgttcatgtgatgaatcacatttattgatttgcgtaggttgaaccaaccttgcatgtcagggatgatatccttgatgaacactgatacaaaaatcctcaaccaaatactagcaaactgaatatagcagcgcatcaaaaagcttacccaacatgatcaagtaggctttattggcatatatatgccaataaagtaagataatgcagaatgaataaatctctagaaatatataacttactgccaggcgcagtggctcacgcctgtaatcccagtactttgggaggctgaggcgggtggatcacaagatcaggagttcaagaccagcctgacgaacatggtgaaaccccgtctctactaaaaatacaaaaattagacagggatggtggtgcgtgcctgtaatcccagcaacttaggaggctgaggcaagagaattgcttgaacctggaaggcagaggttgtagtgagccgagatcacgccattgcattccagcgtgggcgacagagtggtactttgtctcaaaaaaagaaaagaaaaagaaaaagaaaaaaaaaagaaatatataacttaccatcactgaatcaaaaataaattgtaaaaatctgtacatgcctataaataacactaaagtagtaatgaaaatgtcccaacaaaagagaccaagtatagacacgtaatttgtaatcactgcataattctactgaacatttaataacaaattaacactgagaacaatggttctccgctgcgacgagcaggaggaaggaaagctgaacagaaacatcttggtgcctaagccgtatgttgggggtttactataaaacaaatacattaatcatgtgatgtttaaataagtcgaatatttaataattactgggttaaaaaatggttccatcctctccgatggcaaagaagttctgatcctctgtctgagaacaatgataaccattttcaccaaaaacacatttcacaggcgctcctccaggaatacacagactgtggtctgtgttctggactatctgcaaatagtttaacatttgctgtttgacatttacatggacttcatatcttaaaatgggtaatgagatgaaagcatcttatcactgatgtctgtgtctcagctttccattccattcccagtcatgaagaatttggagtcagaagaccaggcgcggtggctcacgcctgtaatcccagcactttgggaggccgaggcaggcaaatcacgaggtcagaagattgagaccatcctggctagcacggtgaaaccccgtctctactaaaaatacaaaaaattagccaggcgtggtggcgggcacctgtaatcccagctactcgggaggctgaggcaggagaatggcgtgaacctgggaggcggagcttgcagtgagccaagatcgagccactgcactccaggctgggtgacagagcgagactccgtctcaaaaaaataaaaataaaaataaaaaagaatttggaatcagaaacacagtgactcacttgtagagtttcaaacataacataaacgaggcaggaatgctttccccttagtgttctaattttaaagcatttagcaggaacttgtgcacagtaatatttgacttcatgggcagtttcttgaatcctgttctgcaaagaggtggcatgcatccagatgtggcccctaaacaatccctgctgcccagcatacaacccacacaaatatacgacaagaaaacaaaaccttagaccaatatccctgaaaatattggtgaaaaagtcctcaacataatattagggggcccacaccccatctccaatccaggccccagtggagcttcttcccaagttcatgtcactaggtcacgggcaatggaatgtaagtgagataagagggactgagggaccgcatgggtgagtgagcaaatatgtcaggcaggatgcttcagactcaaagacttgcaactccaaagaatgacattttgttattgtaggtaactcctctggtatgagcagagcagggcagggcaggagagggctccccctccccatacacacacatcaggaatgtcaggcaactatcagatgatggtcaggtggttgttaaacatgtaaaataatagtcacagctggcaccagggaaaggcaggctcctcacacacagaaaacacctgaaactggtgatctgctgcttcccatgagatctcaggagttgggcgagtggactcaagcacgcacatgcggacagcccaccccaagggaagaatcagggaagcaagaccccggaagtataccaatgtataaaaccccaagtcaaaaggtcgaagtgcacacttgcctttcaagtcacccacttggcacttggccgtcttccaactgtactttccttcctttcatttctgctctaaagctttttttcttttcttttcttttctttttttttttttttttttttgagacaaggccttgctgtgtcactcaggctggagtgcgatgacatcatcttggctcactgccaacctccacatcctgggctcaaaagattctcctgcctcagcctcccaagtagctgggattacagccatgcaccaccacacccggctaatttttatcttttttgtagagatggggttttgccatgttgcccaggctggttttgaactgctggactcaagtgatacgcccatctcagcctaccaaagcattgagattacaggtgtgagccactgcgcctggccatttctgctctaaaactttttattcattcattcattcattcattcattcatttatttttgagacggagttttgctcttgttgcctaggctggagtgaaatggcgccatctcggctcactacaacctccgcctcccacgttcaagcgattcttctgtctcagcctcaggtcaggctgatctcgaactcgagacctcaagtgatctgccgcctcaggtcaggctggtctcggactctcgacctcacatgatctgccgccttggcctcccaaagtgctaggattataggcatgagacaccgcgcccggccctgctctaaaactttttaataaacttttgctttcattcctgctctaaaacttgcctcagtctctccttctgccctatgcccctcagttgaattttttcttctgaggaggcaagaattgaggttggtgcagacctgtacggatagggattcaccacctgtaacaatttcagaaataagagaaataaaaatcaaccgatactattactttacctgagtaagagccatccctgtttccttttcttcctcttctaggcatcttccttgggtaacatgaaaaagcctttacaagtcgatcctgaatgtctaaaatatgccatttaatgactggaatcaacaccctcatttttgtgcctcaaacacccattcagggaagccctcactgtggaaagccagttctctgggagtcattgcaccagatggaacacagggacgacaggctcctacaggaagaccaacaggtgagttttgggcccatttcttcagaacccgctcccctcccagagaagcccacacacacactgcagccgtgggaagctgggctggactgagcttctcttcaggacacagacccagccctgaccaaaccccatgcagagcacagcccccctcacccatctgtggatcacaggctgatttcagcccttagaaacaaagggcggagcctgggtgctcaatgctggacacccatg

SEQ ID NO: 437 - DNA, 37781 bp, Homo sapiens
ctttttttttggaagactcacccatgacattgctgaattatcttgatctggaatcacaaataaccctgagatatgggctttgatacactaggaagggcaataactgcagtcccagtcaaaatccagctaagaaaaccttccacttctttcataagaaacaatactcgctatggccagaggcaacagaaggacttgagcctatcattaacccattccttagacatggcctgttaaagtctgtaactctccctgcaacacaggaaatctattctgctggtagaaaacatttaaagggttctccactactgaaccctgattaagtctggttttctgatggcggcagtttcatccaacatggagtgacacatgcagttatgcaatagtgtctctatttgacattatagaagccaaatcccttcctccaagaacattggcacagctagcagagctcatttccttaactagagccatagaaatagggaaaaacccaaaagctacaatttatacagattcaaaatatgccctctcaggactccatgctcatgtggccatctggaaggaacagggatttttaccagcaaaagatacccctaaggaatgtggaccacagatcctggccctgctctaagctgtacacctatcacaggaaatagctgtagtccatggccagggacaccaaaggaccagggagaaaatgcccagcaaaacaggagggtggatcaaacagccaggaccactaccctgtagggaactcctcatggcccttaacccatctttacccaacaccttacccacccacaaaaacccaagaggaaaaggaatgggctatcaaatatgaatctacccgagaacctgaggtgtggtatacagtgggaggaattctccactttcctaggccctccagtaaaaacttgtgagagcactccatgagtcatgtcactttgggagacatcatctccagcacatgtgcaaaaacctcttttccaggaaagggctctactagactatttgtcaggtctttaacacctgtgcatcctgtgcctgtaatagcccccagggccctacgctgccctgcttttttttttttttttttttttttttgagtcaaagtttcactcttagtacccaggctggagtgcaacggcgtgatctcagctcatcgcaatctctccctcccaagttcaagcgattctcctgcctcagcctcctgagtagctgggattacaggcaggtgccaccaaaaaaagaccaaaaaaaatttttttttttttttggtatttttagtagagatggggtttctccatgctggtcagactggtcttgaactcccaacctcaggtaatccgcctgcctcggcctcccaaagtgctgggattacaggcatgagccaccgtgcccagccaaatttttttttttgttcaatgttgcccaggttggcctcaaacgcgtagccttgcctccttgtgacccaggacaaccggccagagccaatgcagctccctgtcctgcttagttgagccagttcagcattgggaagcttacccagggaaagactgatggatgtatttcactcaattgccagcctgtagaggctataaatgccttctggtgtttgtggacacctttattgggtgggttaaagcctttcctacaagaacagaaaaggcccaggaagtagccaaggtacttcttaaaaaaaaaaaaaaaatcatcccggccgggcgtggtggctcacttctgtaatctcagcactttgggaggccgaggcaggcggatcacgaggtcagagaattgagaccatcctggctaacacagtgaaatcctgtctctactaaaaaagagaaaaaattaggtgggtgtggtagcgggcgcctatagtcccagctactcaggaggctgaggcagaagaatggtgtgaacccgggaggtggagcttgtggtgagctgagattgtgccactgcactccagcctggacaacagagcgagactccgtctcaaaaacaaaaagaaaaaaaaaatcacccctcagtgtgggtttagtttgtgtttacaaagtgacaacggcccagtttttatttcacgcaccctttaattagtgacaaaagccctagaaataaagtactcctagcactcctggagaacacattcctctggcaaggtagaaagcactaatcaaactattaaaaggaccctgaacaaagtgtgccaggaaacctcctcaccatggttagaactcctgtccgtagcactgttctgagcatgacccctaatattacttatgccttcctacatgcagacctaatgttagatccagaagttacccaattaatcaaatacataacatcactggcccaatttcaacaagccatccaggagtttgagcaaaaggtactgcctgccactgacccctccagtaatcaacccttatactagccagggtcacaagtcctcatcaaaacctggagagatgggtcacccaggtctcaactagcctgggtctctcctttatggaaaggcccctttattactttctaccccgacagctatcaaagtttctggaatctctagttggatacatcactcctgagtaaaactgtgagaaggtcccgaagaaccaacaacagaatcagcatctgagtagtctcatgagccagccactggagagcttccaattcctcttcaagtgaaaagataagtaaagccttctctcctttcacctcaaaaaaaggtctctcagtacggggaatcttggttgcggtggcatcggttcttctccttattttgacccacactggcatgccacctgaagtcccgataacagcctgatttctcactaaacactccatcgaaccatttcattatttgtctctcctattttcagcactttccttttgctttcacaaagcttaagggagaatcagctatgacagagaaattccttttcctttatctttccctccttcccatgcccctactctcacaggcacagtggaatgaaaattcccttgtcagtttttccaaaataattgcttcgggaaaccatctaagcaactgttggatctgccacaacttcatcaccaggtcctcatcttaccaatatattttggtaagaaatttttctttaaacctaacatttggttcaggaatccctgaaggccaacataaatctgttccgctccaggtttcgcttgctaactcagcgcaccaagtcccctgcctggatctcactccacctttcaatcaaagctctaaaacttctttctatttctacaactgctcttctctaaaccaaacctgttgtccatgccctgaaggacactgtgacaggaagaacacctctgaggagggattccccagtcccaccatccatcccatgagcttctccccagcaggctgccaccctaacttgactcactggtgtccagctaaacaaatgaacgattatcgagacaagtcaccccaaaaccgctgtgcagcttgggaaggaaaagagctaatcacatggagggttctatatttgcttcccaaggcacacactgtccccacatggccaaaatctactgttcccctgggagggcctctatcccctgcatgcaatcaaactattccagcagggtggaaatcgcagttacacaagtggttcgacagccacatcccccggtgggcctgtacccctcctggctatgtatttttatgtgggccacaaaaaaataaactgccctttgatggaagtcctaagataacttattcaaccccccctgtggcaaacctctacacttgcattaataacatccaacatacgggagaatgtgctgtgggacttttgggaccacgggggataggtgtgaccatttataacaccacccaacccagacagaaaagagctctgggtctaatactggcagggatgggtgcggccataggaatgatcgccccatggggagggttcacttatcatgatgtcaccctcagaaatctctccagacaaatagacaacatagctaagagtaccagagatagcatctctaaactcaaggcctccatagattctctagcaaatgtagtcatgaacaacagattggccttagattacctcttagcagagcagggtggagtctgtgcagtgatcagtaaatcctgttgcatttatgtcaataacagtggggcgatagaggaggatataaaaaagatctatgatgaggttacgtggctccataactttggaaaaggtgattcagcagggtccatttgggaggctgtgaagtctgccctcccctccctcacatggtttgtccctttactgggaccagctgcacttaatagcctgctttctcctctttggcccttgtctctataattcactaattaaatatgtctcttccaggatatggcaatttcacacagagcccctaaaaatggaaagagatcatccaatcttccttggaggtcccagcacctacaagtacatatctcccttggatgccagtgggcaaagattctgcaactacggaggggctccttccctgacagagagcaagagagggagaccctgatgacttcttcgtcccacgtcagcaggaagtagttacagaagacccacgacgtccttatgcccaaagcttttcagggtctccaactcttgagggggaatactgttagggtaggcaggtagccagacaagagcaggcaaggaagcccctgggaaaggaatctttagaaatgcagcccgctgatggcctccttggaaacgctgcacgctgagtcagcaaaaggaggagcgtggctacactggctacacctggccttgtggctgcattcctctgttccagaagggaacttatcaaggcccagccagaggttaccaaggtaggagctattccccactaagaagcatgtatacttctctaataattcaccctaatataccattttgttcattaaaataataaaaaaaaccacacacctgtgtggagattttattttttaaccagaaattccttgttagactttagatccaaatgacatggcacatgtgtgcccagaccagttcccaacacatgcttactagtaacgcccctgcatgaccccttcatgaataatcatgtaaaattctcataagaagcatctccccagccaggtgtggtggctcacgcctgtaatcccaacactttgggaggctgaggcaggcagatcacctgaggtcgggagcgcgagaccagcctgaccaacatggagaaaccccgtctctactaaaaatacaaaattagctgggcgtggtggcgcatgcctgtaatcccagctacttgggaggctgaggcaggagaatcgcttgaacccgggaggcagaggttgtgttgagccaagatcgtgccattccactccagcctgggcaacgagaggggaactccatctcaaaaaacgaacaaacaaaaagaagcgtctccccagcattggtgagacagactcattcatttgagcagcccagcctgttctgtctttcagggtgtactgtttatttaaaagcccccataaaaattcctcccaggccaggcatggtggctcaggcctgtaatccctgcacttccttgggcggatcctcagacagatcacagctcaggagtttgagaccagcctgacaaacatggcgaaaccccgtctctactaaaaatacaaaaaaattagccgggcctggtggcacgcacctgtaatcccagctactcaggaggctgagggaggagaatcacttgaaaccaggaggcggaggttgcagtgagccaagattgcgccactgcactccagcctgggctacaggagactccatctggggagggcggcggggaattcctcctaagtcactagcagctgactcactctctgcagcagccagttctgtctcttcttgacctcctgtctttaaataaaggttacttaacgatttaactctttctgtgtgcctcctagatgaattctttccttcaggaagataaactgaaggacctccacacccctcctggtaacaaaggtctttgtgcaatccctcctgaagaagcaatggaggatttagtatatctaaactagtaaatacaaactgtactcaattatccaagaaatcattgaagaaacactctttactccattttttatatcttgggaaaaatataattaaagacaaaataatatttgccaaacccagaaatcctcaccaaaaaggaaaaaaataaataaacaatcccagttggtggctggtgaatgcttctaccttaatcaatacatgttttgaagctgtcagcttctttttgctcataagtgactccacagaatctagtctttgctttgccctctagacaaggaatacagaatttttaaatcttatcagaaacatataaattgtttggttttgcacaatatttactaattttctccactcatccactgtggagtcatagcacaaaatgaggcaccaccctctcgtattgcaactaaaacagactgagcttctgctccataaccataaacagtaatagcaatactaattgaaagatgaagtaattttacgtaagtaggtataaaactgataattcattgttattttcagttttacaataagtgggaattacatagaataaatctttctctctctctctttctatttctgacagtcccgctctgtcgcacaggccaaagtgccatggggtgacctcagcttactgcaacctccgcttcctgggttcaagtaactcttgtgcctcagtctcctgagtagctgggattgcaggtgtacaccaccttgcttggctaatttttgtatttttcatagagatgaaatttcactatgttggccagagtggtctcaaactcccaacctcagatgatcagcctgccttggtctcccaaggtgctgggattacaggcatgagccaccacacccaacggagttttcactcatttactttaatcatcatgggttagagatatagcttttaaaaatgtaattgaatatacccttacagttaggatctaaaaagagcatttcctctattaatgtttattaaataatatggtggaactcagacttgctctgttgcccaagttggagtgcagtggcatgatcttggctcaatgcaatctctacctcatgggtttaagtgattctcgtgcctcagcctcctgagtagctgggattgcaggcatacaccaccatgcctggctaaattttgtatttttactagagacagggtttcaccatgttgctcaggttagtctcgaactcctggccacaagtgatccacccaccttggcctcccaaagtgctgggattgcaggtgtgagccaccacaccagcttaattttttttctttttcttttcttttcttttcttttttttttgagatggagtttcactcttgttgtccaggctggagtgcagtggcacaatctcagctcactacaacctgcacctcctgggttcaagtgattctcctgcctcagcctcctgagtagctgggattacaggcatgtgccaccatgcctaattttgtatttttagtagagatggggtttctccatgttagttaggctggtcttgaactcccgacctcaggtgatctgcccgtctcagcttcccaaagtgctgggattacaggcgtgagccatcgtgcccagcaattttttctatctgagtttcttccgtactaatcagcttgtgatagacacatggtttctgaaacagaaaagtgcaagggctttttatgagcagggtgtggaagactaccagtaacaaatgctttggcataagtgatgagtgagaaggggagtgagagtctctactgtcctacctactaattgtgctttgggaatttggattgaaaaaagccaccttaatggtgtttggttatcatttattctcccccacctggcaggaaataaggacagggtccccaaagctgctagggcacttagggtggatatgaaacattaaaatatgaaacattaaaacttcacttgcttgaaaccagagcagccaccaaactgctcaaaattactgccaatgatgtcttgcttcctggcattcagaaaccttctccttctctacccctgactcttccttccctctctatcccaatctcaatcaccttaaggaagagctgagtatcctgaaaaatttgaaaggaaaaaagagattcaaacttttgtagctctcttggtaagaggtgccccaatcaccttccgaggagaaatgctttgtaggagtgtctcaaaccaccaagacctgtgggaccaagcacatatggggcccataggaagaagccactgagcctcaggatcctccagatgctgggaggtacatggagcagcaggcagcattatgcttgtatcaagcacccaaggagaaaacaaggccactgagctgccccagccttccctgacatgattgtctcctatggccctgggtttgtttggagacctgcaacataactgtaattcctccttctcctttgtgagttcaaactaagggtaggtttgctaccagtcttttaaaaaagattggtgccactcttgcttacagggcagagaaggcacccagaatggtggccactggcaccccactcccaagccaataccacctctagtgtaaccatgcacacaatctccagaaggggaccccagcccctgacccagctgcattgtctctgccactgtggtgaacacttgcatggaggcaggtactctggcgccctctagcactctggctcttgaggagtcagaggaaaacactggggcccaatacaagtcccctaaagttagagcacacagtccagataagtgctggccccctaaaatcttccagaaatgaagccagtcagctgaatccaccttataccacaatccacaatcaaaccctcaaggtcatcaaatagttatgataaaagtaaaaaacaaaaacaaaaaacaatcctcatccaaaggtcagcaacctcaaagactgaaggtagataagcccaaaaagatgagaaagaatcagtgcaagaaccctggaaactcaaaaagctagagtgccttttttcttccaaacaactgcatcacctttccagcaaggtttctgcaccatgcagagatggcagaaataacagaaatagaactcaaaatgtggataaggacaaagttcattgagctatgggagtatgttgaaacccaatccaagaaagataacaaacacataaaacaatgggattatgtaaagaggccaaatctatgattcactggtgtccctgaaagagagtgaaaccaatttggaaaatatatttttgcatattatccatgagaacttccccaacctagctagagaggccaacattcaaattcaggaaatgcagagaaccccagtaagatacttcacaagaagatcatacccaagccacataatcatcagattctccaaggtcaaaatgaaagaaaaaatgttaaaggaagctagagagaaaggtcaggtcacctacaaaggaaagcccataagagcagacatctcagcagaaagcctacaagctagaagagattgagggccaatatttaacattcttaaagaaaagaaattccaacccacaatttcatagttggccaaagtaagcttcataagcgaaagagaaataagatccttttcagagaagcaaatgctgagggaattcattaccatcagacctgcagtacaagagctcctgaagaaagcattaaatatggaaagaccattaccaaccactacaaaaacacactaaaggacatagatcagttacactataccacctaacaccatgataacggatcaaatccacacatatcaatattaaccttaaatgtaaatgggcagccagctggatgcagtggctcatgcctgtaaccccagcactttgggaggtggaggtgggtggatcatgacattaggagtttcagaccagcctggccaacatggtgaaaccccatctctactaaaaacacaaaaattagctgggcatggtggtgcatgcctatagtcctagctactcaggaggctgaggcaggagaatcgcttcagccccagaggcggaggctgcagtcagctgagattatgccattgcactccagcctgggcaacagagcaagactctgtctcaggaaaaaaaaaaaaaaaagtaaatggcctaaatgccccaattaagagacagactggcaaggtgggtaaagaaccaaaacccactggtatgctgtctccaagagacccatctcacaagcagtgacacacataggcttaaaataaagaaatggacaaaaatccaagtctttgctattgtgaatagtgccacaataaatatacgtgtgcatgtgtctttagagcagcatgatttataatcctttgggtatatacccagtaataggatggctgggtcaaatggtatttctagttatagatccctgaggaatcgccacaccgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgattagcatttctctgatggccagtgatgatgagcattttttcatgtgtctgttggctgcataaatgtcttcttttgagaagtgtctgttcatatccttcgcccactttttgatggggttgtctttttcttgtaaatttgtttgagttcattgtagattctggatattagccctttatcagatgagtaggttgcaaaaattttctcccattctgtaggttgtctattcactctgatggtttcttttgctttgcagaagctccttagtttcattagatcccatttgtcaattttggcttttgttgccattgcttttggtgttttagtcatgaagtccttgcccatgcctatgtcctgaatggtattgcctaggttttcttctagggtttttatggttttaggtctagcatgtaagtctttaatccatcttgaattaatttttgtataaggtgtaaggaagggatccagtttcagctttctacatatggctagccagttttcccaacacaaatgtccaacaatgatagactcgattaagaaaacgtggcacatatacaccatggaatactatgcagccataaaaaatgatgagttcatgtcctttgtagggacatggatgaagctggaaaccatcattctcagcaaactattgcaaggacaaaaaaccaaacaccgcatgttctcactcataggtgggaattgaagaatgagaacacatgaacacaggaaggggaacatcacacacccggaactgttgtggggtggggggagggagggatagcattaggagatacacctaatgctaaatgatgagttgatgggtgcagcacaccaacatggcacatgtatacatatgtcacaaacctgcatgttgtgcacgtgtaccctaaaacttaaagtataataataaaaaaaagagaaaaaaaacctgcttattaggaaagcagagtaattatagaatgtaaaattagtgaaaaaatttatgaaattttgcctttataatgatatttaaaataaataccatcatgcctcttttgcaggtaaagaaaatgaaaaactagaatatttaggctcagggtggggtaactttaaaaaagaaggactggtcatgtctatacaatacaatatccttcctcccctaataaactaactcctaaaataaaaaaataaaaaataaataaatggacaaaaatctaccaagaaaatggaaaacagaaaaaaagcagggggccaggtgcaatggctcatggctataatcccaggactttgggagaccgaggcaggaggatcacttgaggccaggagttcaagaccagcttggccaacatggtgaaatgctgtctctactaaaaatacaaaaaattagctgggcatgggggcttgtgcctgtaatcccagctactagggaagctgatgcaggagaattacttgcacaccggaggtggaggttgcagtgaactgagattgcaccactggtctccagcctgggcaacagagcaagactccaactcaaaaagaaaaaaaggaaagaaaaagaaaaaaaaaagcaggggttgcaattctagtttctaacaaaacagactttaaaccaacaaagattctaaaaagacaaggaagggcattacataatggtaaagggttcaatttgacaagaagagctaactatcctgaatacatatgtacgcaacacaggagcaccctgtattcctaatgcaggaacttgctcaaaatgcaggttcttagagactttcaaagagacttacactcccacataataacagtgggagactttaacaccccactggcaatatcagacagatcattcacacagaaaattaacaaaaatattcaggacttgaattcagcactggatcaaatggacctgacagacatctacggaactctctactcaaaaacaatagtatatacattctccccattgtcacatggcacacactcctttttttttttttttttttttttttgagatggagtctcactctgtcccccaggctggagtgcagtggcacgatctcggctcactgcaacctccgcctcccaggtacaagcaattctctgcctcagcctccaaagtagctgggattacaggcacctgccatgatgcccggctaatttttgttatttttagtagagatggggtttcaccatcttggccaaactgctcttgaacttctgacctcatgattcacccacctcagcctcccaaagtgctgggattacaggcgtgagccacggcacctggccggcacacactcttaaatagatcacataattgaaagtaaaatactcctcagcaaatgcaaaataactgaaatcataacaacctctttgatcatagtgcaatcaagtcagaaatcaagactaagaaattcgttcaaaaccatatattacacagaaattgaatcacttgctccagaatgacttttacctctataattgacaattcttgtctcccatcttgctctttcttcttaaatttccttggctattccctccaagatgatgttggataagaggagactagaagctccttagtgtcatttctgactttagtgtgactttctgtaacatgtcccagatgtttgtcaatttgatgaagatatatcacttcctagttcactatttttaggtaacattatttcctgttaaatactgccaattttttttgcatttatgaatgtgggcaccttatttttctctcaacatagagagaccccatctctacaaaaaaatacaaaaatcagccaggcatggtggcacatgcctttggtcccagctattcaggagactgagatgagaggatcatgtgaacctgggagagggaggttgcagtgagtgagtcaagatcatgaacgctgcactccagcctgggtgacagaatgagaccctgcatgaaaaaaaaagactgcatggcattggtggggagtgatatatatatccatggaacagaatagagaatgcacaaatattttcctttcaactgatatttgataaagataccaaagcaggccaggtatggtggctcacgcctgtaatcccagcactttgggaggccgaggcaggcagatcacgaggtcaagaaattgagaccatcctggccaatgtggtgaaaccccgtctctactaaaaatacaaaaattagctgggtgtggtgacacgtgcctgcaatcccagttactcgggaggctgaggcaggagaatcacttgaacccaggagacggaggttgcagtgagccgagatcatgccactgcactccagccaggcggcagtgagactccatctcaaaaaaaaaattaaaaaaaaaaaagataccaaagcaattgaaagcaggactttcaaataatggtgctggaccaaatgaatatccacaatgaaaaaagatcaatctgcacctaaatttgacactcattcaaaaaggaccatgttgtgaaatgcaaaataaagaaaccatcaaatgttaatctatcaagaattagaaaaacatactgtaaactaattgggaacaagcacaccaaagagttcatagatatgacaccaaaagcatggaaaaaaatgataaatgaaacttcgtcaagttaaaacttctggtctgtgataccaatggaacagaacagagaacccagaaataaggccacaaacctgcaactatctgatcttcgatgaagctgacaaaaacaagcaatggagataacactctctacttaataaatgatgctgggataactggctagccacatgtagaagactgaagctggacctcttccttataccacacaaaaaattaagtcaagatgaatcaaagacttaaatgagaaatcccaaactataaaacacatggaagataatctaggcaataccatcctggacatacaaatggacaaagatttcataacgaagacaccaaaagcaattacaacaaaagcaaaaattgacaaatgggatctaattacaccaaagagcttccacatagcaaaagaaactatcgcaatgaatagaaaaccgtacagaatgtgagaaacttttgtgcaaactatgcacctgacgagtctaatatccagcatctatgaggaacttacacaaaattataagaataaaacaaccccattaaaaagtgggcaaaggacatgaacatttttcaaaagaagacatatggcccagctcaatggctcaaacctataatcccagcactttgggaggccaatcctggtggatcacctgaggtcaggagttccagaccagcttggccaacatggtgaaaccccgtctctactaaaaatacaaaaattagccacgcgtggtggctcacgcctgtaatcccagccactcgggaggaagaggcaggagaattgcttgaacccgagagaggcggtggttgcagtgagccaagatcgtgccactgcactccagcctgggcaacagagtgagactatgtctccaaaaaaaaaaaagacagaaaaaagaaacaacccagagcacaggaaaagggaagacgcctgtgtggctggaacagacggagtgagcgctcactagcaggagataaggtcagagatgtcctggggaagcagatcagatagggacaaggtcttcaaacaactctctcccacaccacaaaagaaattggaaatgatttatttcctcacctgttttaagtaaacatttaacttttttctttctcgtagaagagaaagtgatcaactgtaccacatactaccaaaaggaagagaaagatgaggacaggaagttaaatattgcatttaaaaatggggaggttctctgggcgcagtggctcacatctgtaatcccagctctcagggaggcagaggcgagaggatagctagagcccaggagttcgagacccgcctgggcaatatagcaagaccccgttgttctccacaaaaagcaaaaaaaaaaaaaagacaaaaaaaagtgtaggccaggtgtggcgactcacgcttgtaatcccagcactttgggaggccaaggcgggcagatcatgaggtcaagagatcgagaccgtcctggcaaacatggtgaaaccccacctctactgaaaatacaaaaattagttgggcgtggtgcgcgtgcctgtagttccagctactcaggaggctgaggcaggagaattgcttgaacctgggaggcggaggttgcagtgaaccgagatgcaccactgcactcccgcctgcgcgacagagcaactctcaaaaaacaaaaaaaaaaaagtgtaaaaatggggaggttggctgggctcagtgactcacacctgtaatcccagtactttgggaggccaaagtgggcaaatcacaatcaccttaggtcaggagtttgagaccagcctggctaacatggtgaagccccgcctctactaaaaatacaaaaattagctgggtgtggtggtgcatgcctgtaatcccagctactcaggaggctgacgctggagaattgcttgaatccgggaggcggagtttgcagtgagcagagatcatgccactgcactccagcctggatgacagagtgagactccgtctcaaaaaaaaaaaaaaaaaagaaagaaagaaatgggaagtcactgatgattgaaaaagaagggatcagttgaatgctggaagtgaatgtttgattcaagcaagaattcaagggttcaagtaaaagttggaggcaagacttgaagagaaagtaaaagcaagctttcagagtatgacattctttctttctttcttttcttttttttttttttttgagatggagttttactcttgttgcccaggctggagtgcaatggtgcaatctcagctcactgcaacctccacctcccaggttcaagcaattctcccgcctcagcctcccaatagctgtgattacaggcatgtgccaccacgcctggcaaatttttgtatttttagtagacacagggtttcaccatgttggccagtctggtttcaaactcctgatctcaggtgatccacccgccttagcctcccaaagtgctgagattacaggcgtaaaccactgtgcctggccacgagtatgacattctcaaaggggctcagaagaggggaattaccatagagggaaatatagttaccactaatttttgttttaaagatggtgaagggggcctgcccctccacacctgtgggtatttctcgcaaggtggagatgagagactgagaaaagaaataagacacggagccttgggcccaggggaccggcgctcagcatacgaaggacccgcaccggcactggtctctgagttccctcagtatttattgatcactatctctactatctcagcaagggggatgtggcaggactataaggtaatggtggggagagggtcagcaggaaaacatgtgagcaaaggactctgtgtcataaataagtttaaggaaaggtgctgtgcctcaatgtgcatgtagaccagatttatgtttgactttacacaagcatctcagtgcagtaaagagcagtattgcccccagcatgtctcacctccagccataaggcagttttctcctatctcagcaaatagaatgtatgatcaggttttacaccgagacattccattcccagggatgagcaggagacagatgctttcctcttatctcaactgcaaagaggccgtcctctttcactaatcctcctcagcacataccctttacgggtgttgggctgggggatggtcaggtctttcccttcccatgaggccatatctcaggctatgtcagtgggggggaaaccttggacaatgcccaggctttctcaggcagaggtccctgcggccttccgcagtgcattgtgtccccgggtactcgagactggagaatggtgatgacttttaccaagcatactgcctgcaaacacattttaacaaagcacatcctgcacagccctaaatccattaaatcttgagtcaacacagcatatgtttctgcgagcacagggttggagctagggttacagattaacagcatctcaaggcagaagaatttttcttagaacagatcaaaatggagtttcttatgttttcctttttctacatagacaaagtaacagtctgacctatctttcttcccccaacaagatgggcgagcagaagggaaaaaatggctttattctgtatgtgtgcatgtgtgtttatgtgtcttttaaaggagaagaccatcattggagtatgctgatgaaaataattcccttgagcctggcgcggtggctcatgcctgtaatcccagcactttgggaggccaaggcaggtggatcacgaggtcaggagttcgagaccaggctgaccaacatggtgaaactccatctctactaaaaatacaaaaattagccgggcttggtggcacgtgcctgtaatctcagctactcaggaggctggggcaggagaatcgcttgaacccgggaggtggaggttgcagtgagctgagatcgtgccactgcactccagcctgggcaactgagcaagactccatctcaaaaaaaaaaaaaaaatcagagcttagtcttcacttgtgaaatagatttgtgaagggagcacctgcatccttggagagctctgtgattgatcttctctgtatgccagatcttacaatgggaaccagtcactcaattgaaaaacttaaatgcagtgggaataactggatcttaaggaggtagggaccaactagcgagacttatggcccctcaatttccagacttgagccagtttacagacccaggatcccttgaatgaaagggaagctggatttccttaagaaaagatctcactgcacgacaatttatactgtcaatctttctcccatcctttgccaaggagaccgctggccttttaccagggtaaatatgcattgaggaaagtggaatgatcagaccttttggggactagtggacccggctctgagctaacattgattccaggggacccaaaacatcattttggtcctcagttacagtaggggtttatgggagatcagataattaatggagttttagctcaggtctgatttacagtgagtccagtgtgtccccagactcatcctgtggtcatttccccggtgccaaaatgcataaatggaatagacatacttagcagcaggcagaatccccgcattagcttgctgactagtagagtgagggctattatggtgggaaaggccaaacggaagccactagagctgcctccatctagaagaattgcaaataaaaaacatcacaggccaggtacagtggctcacacctataatcccatcactttgggaggttgaggctggtggatcacgaggtcaggagtttaagaccagcctgaccaatatggtgaaactccgtatctactaaaaatataaaaatacaggctgggcgcggtggctcacgcatgtaatcccagcactttgggaggccaaggtggtcagatcacgagatcaggagttggagaccagctccaacagtaaaaccccatctctactaaaaatacaaaaattagctgggcatggtgtcatgtgcctgtgatcccagctgctcaaaaggcagaggcaggagaatcgcttgaatctgggaggtcaaagttggagtgagctgagacggcgccaatgcattccagcctcggcgacagagcaagactccgtctcaaaaaaaaaaaaaaagacaaaaaaaccccacaaaagttagctgggcgtggtggcgcacacctgtagtcccaactacttgggaggctgaggcaggagaatcgcttgaacccaggaggtggaggttgcagtgagctgagatcgcgctgcactccagcctgggcgttaaagcaagactccatctcaaaaacgaacaaaaacaacaacatcatgtctctggacttgaaagatccaggggtggtgattcccaccacatctccactcagctctcttatttggcctgtgcagaaggcaggtggatcttggagaatgacagtggattatcataagctcaaccaagtggtgcctccaatggcagctgctgtaccagatgtggtttcactgctcgagcacattaccacatctcctggtaactggtatgcagccactgatttggctaactgcttttttttccttccattcctgtccataaggcccactagaaggaatctgccttcagctggcaagaccagcaatataccttccctgtcctgccttggaggaatacgggctctccagctttatgtcataatcttgctcacagagatcttgatcagttcgctttcataagatatcacactgctcctttacattgatgacgttatgctgagtgggcccagtgagcaacaagtagcaaccacactgaatttattggtgagacatttgtatgccaggggatgagaaataaatctgggtaaaattcaggattctttcgcctcagtgaaatttctaggggtccggtggtgtggggccggtcaagatatttttcttttctttttttttttttttaaatggagttttgctcttgttgcccaggctggagtgcaatgactcgatctcggctcactgcaacctctgcctcccaggttcaagcaattctcctgcctcagcctcctgagtagctgggattacaggcattcgccaccatacccggctaactttttgtatttttagtagagacggggtttcaccatgttggtcagactggccttgaactcctgacttcaggtgatccgcccgcctcggcctcccaaagtgctgggattacaggcatgagccactgcgtccggccaagatcttccttctaaggtgaacgataagttgctgcatttggcccttcctacaacaaagaaagaggcataacgcctagtgggcctgtttggatttggagacaacacatttctcatttgggtgtgttactccagcccatttatcaagtgatccaaaaggctgccaatgttgagtgtggtccagaacagaagactccacaacagctccaagctgttgtgcaagctgctctgccactgggccatatgacccagcagatccaatggtacttgaagtgtcagtggcagataggcatgctgtttggagcctttgtcaggcccctaaaggtgaatcatagtggggcctctgggattttggagcaagggcctaccatcctctgcagataactactcaccttttgaaagacagctcccagcctgttgctgggccttggtagaaactgaatatttgactatgggtcaccaagttacaatgagacctgatctgcctatcatgaactgggtattttctgattcatggagccataaagctgtgcatgcccagcagcattccatcatcaaatggaaatggtatatatgtgattgggctcaagcagttcctgaaggcacaaggaagttacatgagaaagtggctcaaatggccaggcatggtggctcacacctacaatcccagcactttgggaggccaaggtgggcggattgcttgaggtcaggggttcgagaccagcttggtcaacaaggcaaaaccccatctctactaaaaatacaaaaattagccgggtgtggtggtgcatgcctgtaatcccagctactcaggaggctgaggcaggagaatcgcttgaacccgggaggtggaggttgcagtgaactgagattgtgccactgcactccagcctgggtgacagaatgagactccatctcaaaaaaaaaaaaaaaaaaaaaagagaaagtggctcaaatgcctatggtctctactcctgccatcctgccttctctccctcagcctgcatcaacatcctcatggggagttccctatgatcagttaacagagcaaaagaagactagggcccagtttacagatggttctgcatgatatgcagttaccacctgaaagtagacagctgcagcaccttctaggacatccctgaagaatagtggtgaagggaaatcttcccagtgggcagaactttgagcagcacagctggttgtgcacttcggtttgaaggagaaatggccagatgtgtgattctatactgactcatgagttgtagctaatggtttggctggatggtcagggacttggaagaagcatgattggaaaattggtggcagaaaaatctggagaacttccatccaaatgttgatggacccgagtggtcaaaaacagtgaagatatttgtgtcccacatgaatgttcaccaaaggatgacctcagcagaggaggattttaataatgaaatggataggataactcattctgtggataccactcagcctctttccccagccactcctgtcatcacccaatgggctcatgaacaaagtggccatggtagcagggatggaggttacacatgggctcagcaatatggacttccattcaccaaggctgacctggctatggccaccgctgagtgcccaatttgccaggagcagagaccaacactgagccctcaatatggcaccattccttgggagtgatcagccaggtacttggtggcaggtcttccatcatggaaagggcagcagtttgtccttgctggaatagacacttaggccagatatggatttgcctttcctgtgattctcccacctcggtctcccaagtagtagctgagattataggcgtgcattaccacgcccagctaatttttgttttttctctgtttttttgagacggattctcgctctgtcacccaggctggagtgcagtggtgtgatctcagctcactgcaagctccacctcctgggatgacaccattctcctgcctcagcctcccgagtagctgggactacaggtgcccaccaccacgcctggctaattttttgtatttttagtagagatggggtttcaccgtgttagccagatggtctcgatctcctgatcttgtgatctgcccgcctcggcctcccaaagtgctgaatttttgtattttcagtagagatggggtttcaccatgttggcaaggctgatcttgaactcctgaccccaggtgatccgcccgcctcggccttccaaagtgctgggattacaggtgtgagccacagcgcccagctgactgctgaacttttttttttttttttttgaaatggagttcacctttgttgcccaggttggagtgcagtggcacgatctcggctcaccacaacctctgcctcccaggttcaagtgattctcctgcctcagcctcccaagtagctgggattacaggcatgcaccaccacacctggctaattttgtatttttagtagagaaggggtttctccatgttggtcaggctggtctcgaactcccgacctcaggtgatctgctcactttggcctcccaaagtgctgggaataatgagccaccaagcccagccccaagaaaaaaagttttttttttcaaagctgaagcctggaagaacatataggtgactaaaaattagacaaaaagaaaaaaaaaaaaacagaaaaaaagtcaatgtagtacaccgcactgacaaagtgaaggacaaaaatcacgtgatcagctcaattgatgcataaaaagtatttgagaaaatccaatactgttcatgattttaaaaaaccatttaaactagaaagagaagaaaataccagaacatgagatttagctgtgatttcttggatacaatatgaaaagcactggcagaaaagcaaaaacagatgaaaggaactacatctaaatgaaaaacttctgtgcatcaaaagagaatgctccagcaaggatgtagaagagcgagctcctgtttcccaacacaaaagtaaaatctcaaaacttgcaggttaaaatatcacaataaaacattcactgaaaaacatgttttaaatctcatatcgatgtataaatacgttactataaatcttgtgctgactcttgccatgaactgagaatggtggttctccactgagcacgaggaaggaagcggaacagaaaagacgatgtgttacatcttagtgcctaagctataagtttggagttttactataaaacattcaccatgtgatgttcaaaataaaatagaatatttaataattattgggttaaaaaaatggttcaattctctccaatggcaaagaagctgtgattcactgtatgagcacagtgataaccattctcacctaaaacacagttcacaggggttcctccaggaatacaacatctctgttctggtctgtctgaaaatagtttaatgtatctcctgctgtttgacatttatgttgacttcatatattaaaatgtgaggaatgaaaaaatcctatcactgatgtttccatctaaactttccattccattcccagtcattaagagtttgaactcagaaacacagtgactcacttgttcagttccaaatataataaaaacgaggcaggaaagatttccccatagtgttctcattttaaagcattcaacaggaacttgtgcatattaatacctgacgtcatgggcaacttcttgaatcctggtctacaaagaggtggcatacatccaaatgtggctcctaaacaatccctgctccccagaagcactgaaaccacaaggcccacaccccatctccaatccatgtctgggtgtcagcccttccaaggaccatgcccagcagagcctcttcagaagttcatgtcactaggtcatgcaggatggaatctaagtgagatgagagggactgagggaaggcatgcgtgagtgagcaaacatgtcaggcaggatgtttcaaagatttgcaatgacattttgttacagtaggtagcttacctggtatgagaaggagagggctccccctccccattcacacacatcaggaatgagccaggcaaccatcaggtgatggtcaggtggttgttaactgtctctctaaaataataattagtcacagccggcaccagggaaaggcatagatagaaaacacctgaaactggtgatcagcctcttcccatgagatctcaggagttgggcgagtggactaaagcatgtgcatgtggacagcccaccccaaggcaagaacagcccaccccaaggaagcaagaccccggaagtatgccaacgtataaaaccctaagtcaaaaggtcaaactgcacacttgcctttcaagtcgatcacttggccctcttccaagtgtactttccttcctttcagttctgctctaaagctttttctttttttttgagtcaaagtctcactttgtcgcccaggctggagtgcagtggtgtgatctcggctcaccacaacctccacctccagggttcaagtgattctcctgcctcagcctcccgagtagctgggactacaggcgtgcaccagtaggctcggctaatttttgtatttttagtagagacggggtttccccatcttagccaggctggtattgagctcctgacctcaggtgatccgcctgccccggcctccgaaagtgctgagattacaggcatgagccaccacacccagaaaaaaatttaaaatttaatatgtgttatattataaacagagaaatcaatatgtcacaatttaatcaactcatccaatcaacacccccaaccttgttcattattctgtgtttccctcccttattccgtacatatctctcattctcatcttctctaactcttgggttcttttctgtttccccctgggtttctgctcctcattttgagcctctctcctctcttgctgtttctccgcttcttcctgctattccatcttttccacctgttctgctccagtcttacaacttgtttcacctcctgtccctctttctccccaatcactggattgtccccagtgtccatacatttctgcctctgtctttccccatctctgcttcccctgttaaattccctcttccctgtttacacccccttgtcctcagtctctagcaccctcagatccctaggcttacactgaggtctatgatccattctgagttaatttatgcacaaaacgtgaggtttttgtctggatttttttcttttttgcatttggatgtccagttgttccagcaccaaaactcaaacagaaacacacaatctgaacaggcctatagcttttaatgaatttgaaccaataatccctgagcaccctgctgtggttcttcttctgctctccttgtcaccagttgccccttcttgctgtcccagcaccacgctgctgcctgccgtggctccaaatccctcctcctctccctcactctctgtctgaggagcctcccctctgctgcccctctccctaccttgctgtccttcacctttctggacatggagcttttctctacatttctccagttgtttccccatcctgttactttctcagcttcttctttgactcttcctgtctcttcgcgaatcccccacgcatcctccattttgccatctgtttatgggtttccctcattctctgtctcagtttgtctacttctctcgcagtccctgtttccagatccccttggcccacacattcacaggagggtttagggtaagacacctgcatcccgcaggagcacatttttccagggggtggagctgggaaggcaagaacaccaggtgtcacaggacaggccctgggcacctccctaacgcgggctcaggggaagcggggactgcaaacgagaggcctggggagcagcagggcccagcaagagttggagggaggtgggggcgaaggcgccttaggataggggtggggtctgcaggatcccgccaggcagaggacgcagcctccctgggactggggctgcggggccgacgagggcgaggctgggaggcgcccaggacgcgactccacctcgcgggtgaggacttgaaaaagtgcggggcaggatgaggggtcagtacagggtttcgaacggaaaaatttaaggaaagaacatgtctacatgacctgaaggcagaaacaccggcgacggaaccagcctcagaatgattttaccccaaatcactgaaacgaccccaagagtctcatagcgatgtgtgacttactagcagtgaggggagcggtatgagaattttcaggcgtgtacgaacctccaaatccggggtatggaggtgagaggactgcgaagcccaagtttaatcttaataatagacagagggaaatccacgcgccgccataccaggttcactccgcgcgatctgtttccgggtctgcaggaaactaagcgcagagcggaatcctgggcgggtcccgcgagcgacggcgtcgggagggaagaaggaagggggcggggcctccgcggagtgggggggcctatgctttcctcttctggctcccatggcatctctatttttcgggtttaggaggcaacatttaccagtgaggctgaagcaactcagcaggatctccctggggcagggcaaaccgttggtgattggatccaggaaaattcctgctattgaaaaagtttagcaacttaatttaaaagccccagaattgtctgtgaaggggatgcaaactggaacgtgaaaggcaaactctgcatggggggatggatcaatcccatgctgatgtcccacaaaacaaaatagaaatccttttattttttatttatttatttttttgagactgagtcttgctctgtcacccaggctggagtgcagtggtgcgatctcggctcactgcaagctctgcctcctgggttcacgccattttcctgcctcagcctcccaagtagctggaactacaggcgcccgccaccacacccggctaatgttttgtatttttagtagagatggggtttcaccgtgttagacaggatggtctcgatctcctgacctcgtgatctgcctgcctcagcctcccaaagtgctgggattacaggcgtgatccaccgcacctggccctagaaatccttttattttctaatctccatttactccagagagtcaaccttgtacttgtttccaaagactgactttgttttttttttttttttggaaacgtagtttcaaatctgtcagccttggcttcccaaagtgctgggattacaggcgtgagccactgggcctggcctccagagactttcatagacgcaacacctggggtgttaagcatggaaagctaggtctgtcatcaccctggattcatcttgtctctgcccagaagagacagtgcactgaaaacaggagagttttgcagcaaagagtttaattatcgcagggctagccaagtggaacaagttgggagagggggaagttagttctcaaatctgtcgcccgaaaagttgggagactagggttttgaggataattcggagagcaaggggctagggaattggtgtggctcattagttgtggagaaaatcataagagggttcaaaacaggcctcctggagctgagtcagtttctgggtgacggtcacaggaccgggcagtgccagttctctggtaccagtgaagaagacgtccaggtggcctgaatgactctgcccaattgtaaaagtctgaaaaatacctcaaagaccaatcttaggttttcacaatagtagtgttatctacaggagcaactgagaaattacaaatcactggttattgtttctgtctacattttagcagaattcagttacctcccataatcctaacatttagcctttcattagtcttagaaagttggtttcagtcacctgagagggtcactttgggagggactagtatcatcctttcttcaaagtcataactataaactgaattccacccatagttagctgggccaatgcccagtaatgagcaaacacagcttgtgaggttagaagcaacaattaggttagatttctctcactatcatgatttttgcaaaggtggtttcaggttcagtgatgttagatcaccgatttttgctttaaataataagcaatggccgggtgcagtggctcatgcctgtaatcccagcactttgggaggctgaggcaggtgggtcacctgaagtcaggagttcaagaccagcctggccaacatggcaaaaccctgtctctactaaaaatacaaaaagtagccgggtgtggtggtgcatgcctgtaatctcagctacttgggaggctgaggcagaagaatcacttgaacctgggaggcggaggttgcagtgagccaaggttgtgacattgtactccagccttggcgacaagatcgaaacttccttgaagaaaaacaaaacaaaacaaaaacctaaaacatctgatgggagaaagaacgcacaaataataacacaaaacccccaaacaatatgattactgagtgctctaatggtaaggagaaatttaaaccagctggttattaatcttaactttagccaagacagaaccccaaattcacctacatacctaggaatgggtataccatcctaggaggaggaaaaaaactgaaattcaccttcccaattggaagcgagcttaaactttagaaaggagttacctgccttctactgtcatggaagcaggaaaacgtgccttccttattggaagcaagtaaaactccagaaaaagatgtacagcaaaataaagttaagatctcaaccaaattttgatagatcagggattctctagagagggagctcccaggcctcagccaattgtcctactggtttgagccataaggatagctcaatctggtaccaagcaccaataggagatcgtcaaaggtcagggcccactctactcagagttacttccttgggtcaccaatttgtcaacgaagagtacctgagacaggtctcaatcaatttagaaagtttatattgccaaggttaacaacatgcctgtgacacagcctcaggaaatcctgatgacatgtgcccaaggtagtctaagtacagtttggttttacacattttagggagacatgagacattaatcaatatatgaaagatgtgggccaggcgcagtggctcatgcctgtgatcccaacaatttggaggccaaggtgggcggatcacaacgtcaggagttggagaccagcctggccaacatggtgaaagcctgtctgtactaaaaatacaaaaattagcctggtgtggtggcacgtgtctgtaatctcagctactcgggaggctgaggcaggagaattgcttgaacctgagaggtggaggttgcagtgagctgagatagggccattgcactccagcctgggcgacagagtgagactctgtctcaaatttaaaaaataaaataaaatagaaatatatgaaagatgtccatcgacttggtctggaaagtcacacaactcaatcagggaggaagcttctaggtcataggtagataacagacaaactgttgcattcttttggagtttcagattaggctttcactgaattcgtgatttacaggaatagtcacttatgccttagtctggcttagtgaaacaataggacaaaggaaaaaatcagatacgcatttgtctcatgtgagcagagggatgacactgagttctgtctgtcctttgtccacaaggaatttccttgtaggtaaattttgaggaaggtatgtagcttttaaaaatctttgtagctatcttatttaggaataaggaataaaatgggaggcatatttgcctgacagagttcccagcttgacttttcccttggctaagtgattttggggtctgagatttattttcctattacacctccttgtaatatcattataagagaaatgcaaattaatatggatttttttcaaataagttaaagtaggaactactttgtgtgtgtgtgtgtatgtgtgtgtgacagaatctcattctgtcacccagactggagtgcaatggcatgatcattgctcattgcagcctcaggtgatcctcccacctcagcctcctggtagctgagactacaggcatgtaccatcatgcctggctaatttttgtattgcttgtaaagacaggattttgccatgttgcccaggccagtcgcaaactcctggtctcaagtgatcctcccacctcagcctgccaaaatgccaggattacaggcatgaaccacttagcccatccaggaagtactttcatctcttgagtatatattatagcctgtgtcacacacaaaaaagagaatgtacatattctaacacagatggaacaatgaaaatgtttactactgtcaaagaacaaatttggacattggttagaagagattctattcaaaaagtatattgtggtagggagaatgctccaaccacaagatctgcaaatgtttgagtcacaagaaatgggcttttcttttctctaaagaaggaagcaaggctagaaagcaccaggtacagggcaggggatgagcatctgctgtgacctattcagggaattttttttttttttttttttttgagacagaatctcattctgttgcccaggctggagtgcagtggtgcaatctcggctcactgcaagctccgcctcctgggttcacgccatcctcctgcctcagcctcccgagtagctgggactacaggcgcatgccaccacgcccagctaattttttgtatttgtagtagagacagggtttcaccgtgttagccaggatggtttcgatctcctgacctcgtgatctgcccgcctcagcctcccaaagtgctgggattacaggcgtgagccaccacgcccggcccaaacaaagattttaaaaaataataaatacatgtgttctacttgaaaaacagaactaaaagtaataagaacaatagcaaactttgctccttacctcagtttttgaatgacattgaagggtcctcaatgtgcatttcggctgtgtggtattcatttcgatcacatgcaagacactgatcagttcttgttggaagatatggctctacatttctaacttcaagggtctctgtaactgtcgaattaagcagaaagctagggtcatattaagaaaaatagtgttcccttatacatttttctgctgatcatgggaaaacatattctcacagcttcatgaattatttggtcacaatttgacaataaaaacactaatttatatgtcagatccatgtcacattctcatattaatctaaattttcttttttttttttttgagacagagtcttgctgcattgcccaggctggagtgcagtggcgcgatctcggctcactgcaagctccgcctcccaggttcacgccattctcctgcctcagcctcccgagtagctgggactacaggcgcctgccacctcgcccggctaattttttgtatatttagtagagacagggtttcaccgtgttagccaggatggtctcgatctcctgacctcgtgatccacccacattggcctcccaaagtgctgggattacaggcatgcgcccgacctcaatctaaattttcttgacatcctttttggtaccagctgagccctgacaaaggaaggtaattcagagacattttctcttgtgatcagagaaataacctaatgagaataaacttatgttgattgggtttttttgttttttgtttgtttttgagacagggtctcactctgtcccctaggctggagtgcagtggcatgatcacagctcactgtaccctccacctcctgggctcaagccatcctcccagctcagcctcctcaatagctgggactagagggtcacgacactatgcccagctaatttttttgtattttttgtagacatagggttttgtcacgttgcccaggctggtcccaaacttctgaactcaagtgatccgcctgtgtcagcctcccagtgtgttgggattacaggtgtgcaccaccatgcccagctgaaaataaaattaaggtgaagaaagttgttctctgtgatctcaggggaaaaccttcaggtaaatttgcattcagattgaatagaagaaacatacaaatgtggatgaactagatactactttaaaagtctttctagcgccaggctcagtggctcatgcctgtaatcccatcactttaggaggctgaggcaggcagatcatgaggtcaggagatcaaggccatcctggccaaagtggtgaaaccccatctctactaaaaatacaaaaactagctgggcgtggtggcatgtggctataatcccagctactcgggagggtgaggcaggagaatcgcttgaaccagggagctggaggttgcagtgagccgagatcacgccactgcactccagcctgggtgacagagtgagacacctttacaaaaaataaataaataaagtatttctgtccacaaaccagcttggagtaggtaggtagccaggcatgagcagttaaaggagcccctgggaaaggaatcttaagaaacacagcccactgacaatccccttttgacagcaaaagcaggacagtggctacattgcctacacctgtccttgtggctggacttgtctggcccaggaagggagttatctggccctagccagaaataacccagctaggggattttccctattaaggagcgtgcacactcctctaataattcatcctagaatggccttttgctcattataatactaagaaacacatccccttttttcaaatatgattttagaaaaaaataaataagggctgggtgcggtggctcatgcctgtaatcccagcactttgggaggccgaggcaggtggatcacgaggtcaggagatccagaccatcctggctaacacggtgaaatcccgtctctactaaaaatacaaaaaaaaaattagctgggcgtggtggcaggcacctgtggtcccagctactcaggaggctgaggcaggagaatggcgtgaacccgggaggcggagcttgcagtgagccgagatagcgccaccgcactccagcctgggcgacagagtgagactccgtctcaaaaaaaaaaaaaaaaaagccacacccctgggtggagatttgagatgctaaggagatatgtgatgtgtgcatggacagtcacagcacattcctgcccaaatgacttcccagaacatgcttactaataatggctgtgcacggccccttcatgaataatcatgtcaggttctcattaaaagggtcaggccagcataagtaaggacagactccttcttttcaggagcccactcggttctgtcgttcagggtgtcgcttctttctgagctcctgtctctttaaatgaagggcatttaccctttaactctttctgcgcatctcttgactgaatccaagaagaccaagaaccagaggacttccacacccctctgggtaacatctggtgttttcacctggttacctggttacctcgcctggttatccaggtaagtaccaaaaagctggtgccagattctctggttgacgacctctgcttctttctgcactgaagaacctcctgccctaatgcagatctggcagctttaaggggaggggtttttcctctcaggctctgttcactaacgactgcccagtaccatttcccttcagccactgtcactctgctccctctggctgatttctcagctcaccctgaggggtgataagcagaggagggaggatttaaactccacagtgagtagatctgagacacatggtgacccttcttgcaggaggcttgtgaaggtggcagggaatacgcctggctgtgcagtgactggggagcttcatatttttttttgtgggggggaggacagagtctcactctgtcgcccaggctggagcgcagtggtgtgatctcggctcactgcaacctccacctcccgggttcaagcgattcttctgcctcagcctcccgagtagcagggactacaggcgtgtgccaccatgcccggctaatttttgtatttttagtagagacagagtttcaccatattggccaggctggtctcgaactcctgacctcgtgatccgcccacctcggcctcccaaactgctgggattacgggcgtgagccactgcgaccggcgcatatcttttaattaaaactacaatccggtgttaagtcagctcttatacttgccattcatggccgttcactcccctgaacaccatatgcccccaccgttgattaatctcccaggtcactctgcttactctttgctgtccctctcctcgccgcagggatttcatgaattcttcctgcgggtgcaagcctcttgcagggcctgtttatccaggacctgctgcgtttgcttcactcaggcgccagagtcctttgagggcctatgctgatgtttatacttttttcctcagaaatgagactcagctttgtcctttcccttgcctcctgtttcactggagggaccggcactgggaggatgcctgcttaaagaaatccctcattttggccgggcacggtggctcatgcctgtaatctcagcactctgagaggttgaggggggtggatcacctgagggcaggagttcaagaccagcctggccaacatggtgaaaccccatctctactaaatatacaaaaattagccgggcgtggtggcacacgcttgtaatcccagctacttgggaggctgaggcaggagaatcgcttgaacccgggagctggccattgcagtgggccgagatcgcaccattgcactccagcctgggcaacaagagcgaaactctgtctgaaaaaaaaaaagaaagaaagaaatccctcacttattattgggtccttctccgcctgcctactcttcaagaatgcctcattctgtgactcctcaatggaactgcctggctcttccagagggtcacctgtgaccacttccttactccctagtttctctgtacaaccagggtttccaatgggccacaggagactgctttctccacctcattaggccattgtaacagacccgtgaagtactcaggtcctttttgctttttgttgaataagctgatagaaaatgcttctcacattccccttgctgtttatgtgatcatataatggactaaaaaaccagaatcaacagcccagttcactaactctgagccccagggggtcttctatgcttttcaagcatttttttctgtataaaccccaaggaaccttttaagagtgggggaagatatcacatcttttccgttcctgtaatcattagtattagcccaatatcattatgtattaagaagacctaggctgggcgcattggctcacgtttgtaatcccagcactttcggaggccaaggcgggcgtgtcacccgaggttgtgagttcgagaccagcctgatcaacatggagaaaccccgtatcggctgggcacggtggctgatgcctataatcccagcactttgggaggctgaggcgggcagatcacgaggtcgggagtttgagaccagcctggccaatatggtggaaccctgtctctactaaaaaattagccgggcctggtggcatggatctgttatcccagctattcaggcggctgaggcagaagaatctcttgaaccctggacacagaggttgcagtgagctgagatcgtgccactgcactccagcctgggtgacaaagtgagactccatgtcaaaaaaaaaaagaaaccccgtctctactaaaaatacaaaaatagctgggcatggtggtggacaccagtaatcccagctactcaggaggctgaggcagaagaatcgcttgaacccaggaggcggaggttaccgtgagccaagatagcgccactgcactccagcctgggcaacaagagagaaactgtctcaaaaaaaaggactttagaagtcccttctctgcagaattcagcaggggcacaactactgggcttcctgcagaaccaaggtcactgggaacatgagagaagagaagagaactactctcatggcagacattcttccacccgtccttacccaacacggaagagtggaaggcatcactgctgggcatcaatcccaggaaatctaagaaatccttctgagcaaaacaataggaagaaatgcaaacagcagagcacacagtagggctaattccagagctccaaggtgaaggacacttcacccttgcagggagaggcatgagacacctcatttaggtcaaggattggaatgcctgaccttcatgagtcaccaaataggtaaagggacacttcctctatcctgcattctctcttgtcttgtctttcagatgggtaatcagatctttatatcccaggattcccctcctggatccccttggaatctgggaaaaggttgatccccagattgtaaaacaagagactgattttcctttgcaatatagtttggtcaaaggtggggagcttaaatgttaataccatattccagcttgacctttactgccaacaccaacacaaatggtcagaagtcccttatgtgaaaatcttcatgatctcgtgggaaaaccctgatttttgtaaaggctgcaaaacgggctcaaaagaaaaagaaaaggaaaggaaacagccaagggcggtggctcacgcctgtaatcctagcactttgggaggccaaggtgggctgatcacctgtcaggtaaccaggtggccaggtgaccaggctggtcaggagtttgagaccagcctggccaacatggtgaaaccccatctctactaaaaatacaaaaaaattagccgggcatggtggcggtcacctgtaatctcagctactcgagaggctgaggcaggagaatcacttgaaccccaggaggcggaggttgcagtgagctgagatcgcaccattgcactccagcctgggagacaagagcaatactacatctcaaaaaaacaaacaaaaaaaaggccagccacagtggctcatgcctgtaatcccagtactttgagaggctgaagcaggtagatcatctgaggtcaggagttcaagaccagcctgaccaatgtggagaaaccttgtctactaaaaatacaaaattagctgggcatgctggtacatgcctgtaatcccagctactcgggaggcttaggcaggtgaatcacttgaacctgggaggcggaggttgcggtgagccgagatcccgccattgcactccagcctgggcgacaagagcaaaattccatctcaaaaaaaaaaaaaaaaaaaaaaatacaagccattcaggagtttggacaaaaggtactgcctgctcttgaccctttcaggaatcaacacccattataccaaccagggtcaaaaaacctggagagatgggtcatctgggtctcaactcccttatggaaagacccctttactgtcttactttccaccccaacagctatcaacatttctggcatctccagttggatacatcagtctcaagtgaaactgtgggaaggtcccgaagaaccacagaaga

SEQ ID NO: 438 - DNA, 42690 bp, Homo sapiens
ataagttgatgagaataaactcaacgaaggtgaaaattctgtttttttctgtgacctgggggaaaaagcttaaggtgaatttacattcagattggttatacagagagaacatacagaagtggatgaactcggtgtaattaagtttttctatccacaaaccaggtgaaagtattgcaggaggcagatagcgaggcatgagcaggtaaggagattctgtgtcacccgcaaggggtcctgatccagaacctaagagagggttcttggatctcacgcaaggaagaattcaaggtgaatccatacagtaaagtgaaagcaagtttattaagagagtaaaggaataaagtatggctactccatagtcagagcagcctcctgtttcatcctatgactaagaatgccttcacttactgggaatgtaacccagcaggtctcaggcttattttctccagcccctattccagatggaattgctctggttcaaatgtctctgacactttggaaaggaatatttagaaatgcaactcactggccaggcacagtggctcatgcctgtaatcccagcactttgggaggccgagacaggtggatcacgaggtcaggagatcaagaccatcctggctaacacagtgaaactccatctctactaaaaatacaaaaacttagctggcctggtggtgggcgcatgtagtcccagctactcaggaggctgaggcaggagaatggcgtgaacccgggaggcggagcttgcaatgagccgagatcgggccactgcactccagcctgggtgacagagcgagactctgtctcaaaaaaaaaaaaaaaagaaaagaaaaaagaaaaaagaaatgcaactcactgagagtctccttaaagatgctgcccactgacagcaagaaaagatcagtggctacattgcctccacctggccttgtggctgcactcctctggcccagaaggggacttatcaggggctagctggacataatcgagatgggggattttccccattaacaaccatgtgtacttctgcaataacccaccctagaagagccttctgctcaaaatgatactgaaacacacatccctggctggagatttgagatgctaatgagatatgtgacgtgtgtaccagcacggaccgtcacagggctttcctgatcagaggacttcctggaacgtgcttactaggaacatccctgcacagccccttcatgaataatcatgtcagattctcacaaaaaggctctgcccaacactagtagggacaggctcattcttttgaggagcccaccctgctccactgttcagggtatctcttctttccgagctcctacgcctttagataaagggcacttacctgcttaactctttctgcgtgtctcttgactgaattcaaggagaccaagaaccagaggacttccacgcccctcctggtaacatctggtgttttcccctggtggcctgtgaactgttcttctgggtaagtgccaaaaagctggtgccagatcctctggttgacgacctctgcttctttctgcactgaagaacctcctgccctaatgcagatcttgcagccttaaggggaggggcttttcctctcgggctctgttcactatcaactgcccagtaccatttcccttcagccactgtcactctgctccctctggctgacttctcagctcaccctgaggggtgacaagcagaggagggaggatttaaactccacagtgagtagatctgagacacggtgaccctccctgcaggaggcttgtgaaggtggcagaaaatccaccctggctgtgcagtgactggggagcttcatatcttcaactaaaactactattccatgttgagtcggctcttctacttgctgttcatggcagttcattctcctggacacaatatgccgccaccggtgaataatcccccaggtcactctgcttactctttgctgtccctgtcctcgtcgccgggcttccttgaattcctccttcgtgtacaagtgccttgtctgtcctgcttgtctgggacctgctgcgtttgcttcactgccaatcgccggaggcctgcccgggcctgtgaggaagtttatacttattttttccctagagatgagacccagcttcgtcctttcagttgcctcctttctcactgcagggaccggcactggcaggatgctcgcttacaggcatccctcgtttactatcgggtccttctccgcccgactactcttcaagaatgcctcattctgtggctcctcaagcgagctgtctggttcctccggatggtcatttataggcctctttctcagaccccagtttctctttacaaccggggtttcctgtgggtcaatgggaagttcttcatccgcctcctcaagccattgttacagacctgtacggcagtcaggtgctttttgtattatgttgaaaaagctgacagaaaatgcccccggcactccccttgctgcttatgtgatcatatcagggacgtaaaaaaccagaatcaacagcccagtccactaactctgagccccaggggccttccatgcctgtttaagcattttttctgtatgatccccaaggaacctactatgaccaggggaagatatcaaatttacctccattcctctaaccatctgtatgcattaatccaatattatcatgcattaaggggaccttaccatggagtcccttctctgcagactttagcaggggcagaactactggacttcttgcagaaccaaggtcactgggaatatgagagacaagagaactactcccatgcccgacgttcttacatgcttcctggcccaacacagaggtgagaaaggcgtccctcctaggcatcaatcctaggaaatctaagaaaggcttctgagcaaaatgagatacagggagacaatggatggtgcaaatgctaaggctagctaattctggagccccagggtgaagaaccaatcatccctgtaaatagaggcatggacacttcacctaggccaaggtgtggaatgcctcaccttcctgaggcacccaataggtggagagatgccttctctatcctatattcattcctgtcttctctttcagatgggtaaccagagctccgtaccccaggattcccctctcggatgcatccttagaaactgggataagtttgatccccaggcattgaaacgaaaaagattggtttttctttgcaatacagtttggccaaaatatgaactagaagggcaggaagcctggccagtggggggaagcttaaatgttaataccatactccagcttgacgtctactgccgacagcagcgcaaatggtcagaggtcccttatgtgcaaaccttcatgatcttgagggaaaaccccgatttttgtaaaggctgcaagatagatcctgcccttttagctatcctcagtcgtccactccagagacctcaaccaggaggcttcaatgatttcctggtcaacccacctcaacctcctcttcctgagaccaaagagaaagagcaagcacccccagctccttcctccttgtatcgcactcttagccttcatgggtcagcctcaacctacactaggccctcaggcccccgctctggaatctgcctgctaccagtggtgagccgaccagtaggaccagtccaagtccaggtccccttttccatgcaggacttgtcccaagttaaggaaggcctgggaaaattctcagagaatccgggaaaattcctggagggcttccgtaaattaaccctcacttttgaactaacctggaaggatgtcgccatcctcctaggacaaaccctgtctctggaagaaagacagaccatctgggaggcagcacgtcaatgcggggatgagctacacttggcagatgccaactaccccgtgggagctacagctgtccccctgcaggaccccaactgggactacgataccccggcaggaatctgcgccagaaatcatatgctcctatgcctgatagagggaatgaaaaggagtcaagtcaagcctgtcaattataataagttagcaaccatcgaccaagggccacatgagaatcccacggcctttctcgaaaggctccaggaaactcttatcaaacataccaacctagacccgggatccccagaaggacaactagtcctaaaggatcacttcctcacacaagctgccccagacattaggagaaaactgcgaatgctggctttgggaactagagcccccatgtcagaaatcctcaaattcgcttcctcagtgttttataaccgagaccaggatgagagggacagggccgagaggaaggaaaaacagaaagaagagaggcaggctcaattactagctgctttgcaagttcaccagccccctccaggttgccctaaggataccttcccagggaactgctatcagtgcgggaagccgggccattggaaggcaaactgcccctacgggccaaggggggaaaagccctgcacggcctgtcccctctgccgtaagctcaggtactggaaagagaactgtcccgagagccaaaagggcccctgagccaatgatggctttgagctgagggtgccctctgccttggccagctcccagatgtgacatcatcatcaaagggatggagcccagggcaactctggatgtagcaggtaggacaatacattttctatttgatttgagagcagcctgctcggtgctgacccccttctctaggcaactttcctctgtcaggtaatcagggtaaatggcatctcttcctaagatttacaccttctttattgttaaaagaccaattaatcttttcccatgagttcctgatactgtctgaatgtcccatacgtctttagggcagggatatactctccaaactaggggcacgcttcacatttacctgaacttccctgaaaggctttctttttttttggaagactcacccatgacattgctgaattatcttgatctggaatcacaaataaccctgagatatgggctttgatacactaggaagggcaataactgcagtcccagtcaaaatccagctaagaaaaccttccacttctttcataagaaacaatactcgctatggccagaggcaacagaaggacttgagcctatcattaacccattccttagacatggcctgttaaagtctgtaactctccctgcaacacaggaaatctattctgctggtagaaaacatttaaagggttctccactactgaaccctgattaagtctggttttctgatggcggcagtttcatccaacatggagtgacacatgcagttatgcaatagtgtctctatttgacattatagaagccaaatcccttcctccaagaacattggcacagctagcagagctcatttccttaactagagccatagaaatagggaaaaacccaaaagctacaatttatacagattcaaaatatgccctctcaggactccatgctcatgtggccatctggaaggaacagggatttttaccagcaaaagatacccctaaggaatgtggaccacagatcctggccctgctctaagctgtacacctatcacaggaaatagctgtagtccatggccagggacaccaaaggaccagggagaaaatgcccagcaaaacaggagggtggatcaaacagccaggaccactaccctgtagggaactcctcatggcccttaacccatctttacccaacaccttacccacccacaaaaacccaagaggaaaaggaatgggctatcaaatatgaatctacccgagaacctgaggtgtggtatacagtgggaggaattctccactttcctaggccctccagtaaaaacttgtgagagcactccatgagtcatgtcactttgggagacatcatctccagcacatgtgcaaaaacctcttttccaggaaagggctctactagactatttgtcaggtctttaacacctgtgcatcctgtgcctgtaatagcccccagggccctacgctgccctgcttttttttttttttttttttttttttgagtcaaagtttcactcttagtacccaggctggagtgcaacggcgtgatctcagctcatcgcaatctctccctcccaagttcaagcgattctcctgcctcagcctcctgagtagctgggattacaggcaggtgccaccaaaaaaagaccaaaaaaaatttttttttttttttggtatttttagtagagatggggtttctccatgctggtcagactggtcttgaactcccaacctcaggtaatccgcctgcctcggcctcccaaagtgctgggattacaggcatgagccaccgtgcccagccaaatttttttttttgttcaatgttgcccaggttggcctcaaacgcgtagccttgcctccttgtgacccaggacaaccggccagagccaatgcagctccctgtcctgcttagttgagccagttcagcattgggaagcttacccagggaaagactgatggatgtatttcactcaattgccagcctgtagaggctataaatgccttctggtgtttgtggacacctttattgggtgggttaaagcctttcctacaagaacagaaaaggcccaggaagtagccaaggtacttcttaaaaaaaaaaaaaaaatcatcccggccgggcgtggtggctcacttctgtaatctcagcactttgggaggccgaggcaggcggatcacgaggtcagagaattgagaccatcctggctaacacagtgaaatcctgtctctactaaaaaagagaaaaaattaggtgggtgtggtagcgggcgcctatagtcccagctactcaggaggctgaggcagaagaatggtgtgaacccgggaggtggagcttgtggtgagctgagattgtgccactgcactccagcctggacaacagagcgagactccgtctcaaaaacaaaaagaaaaaaaaaatcacccctcagtgtgggtttagtttgtgtttacaaagtgacaacggcccagtttttatttcacgcaccctttaattagtgacaaaagccctagaaataaagtactcctagcactcctggagaacacattcctctggcaaggtagaaagcactaatcaaactattaaaaggaccctgaacaaagtgtgccaggaaacctcctcaccatggttagaactcctgtccgtagcactgttctgagcatgacccctaatattacttatgccttcctacatgcagacctaatgttagatccagaagttacccaattaatcaaatacataacatcactggcccaatttcaacaagccatccaggagtttgagcaaaaggtactgcctgccactgacccctccagtaatcaacccttatactagccagggtcacaagtcctcatcaaaacctggagagatgggtcacccaggtctcaactagcctgggtctctcctttatggaaaggcccctttattactttctaccccgacagctatcaaagtttctggaatctctagttggatacatcactcctgagtaaaactgtgagaaggtcccgaagaaccaacaacagaatcagcatctgagtagtctcatgagccagccactggagagcttccaattcctcttcaagtgaaaagataagtaaagccttctctcctttcacctcaaaaaaaggtctctcagtacggggaatcttggttgcggtggcatcggttcttctccttattttgacccacactggcatgccacctgaagtcccgataacagcctgatttctcactaaacactccatcgaaccatttcattatttgtctctcctattttcagcactttccttttgctttcacaaagcttaagggagaatcagctatgacagagaaattccttttcctttatctttccctccttcccatgcccctactctcacaggcacagtggaatgaaaattcccttgtcagtttttccaaaataattgcttcgggaaaccatctaagcaactgttggatctgccacaacttcatcaccaggtcctcatcttaccaatatattttggtaagaaatttttctttaaacctaacatttggttcaggaatccctgaaggccaacataaatctgttccgctccaggtttcgcttgctaactcagcgcaccaagtcccctgcctggatctcactccacctttcaatcaaagctctaaaacttctttctatttctacaactgctcttctctaaaccaaacctgttgtccatgccctgaaggacactgtgacaggaagaacacctctgaggagggattccccagtcccaccatccatcccatgagcttctccccagcaggctgccaccctaacttgactcactggtgtccagctaaacaaatgaacgattatcgagacaagtcaccccaaaaccgctgtgcagcttgggaaggaaaagagctaatcacatggagggttctatatttgcttcccaaggcacacactgtccccacatggccaaaatctactgttcccctgggagggcctctatcccctgcatgcaatcaaactattccagcagggtggaaatcgcagttacacaagtggttcgacagccacatcccccggtgggcctgtacccctcctggctatgtatttttatgtgggccacaaaaaaataaactgccctttgatggaagtcctaagataacttattcaaccccccctgtggcaaacctctacacttgcattaataacatccaacatacgggagaatgtgctgtgggacttttgggaccacgggggataggtgtgaccatttataacaccacccaacccagacagaaaagagctctgggtctaatactggcagggatgggtgcggccataggaatgatcgccccatggggagggttcacttatcatgatgtcaccctcagaaatctctccagacaaatagacaacatagctaagagtaccagagatagcatctctaaactcaaggcctccatagattctctagcaaatgtagtcatgaacaacagattggccttagattacctcttagcagagcagggtggagtctgtgcagtgatcagtaaatcctgttgcatttatgtcaataacagtggggcgatagaggaggatataaaaaagatctatgatgaggttacgtggctccataactttggaaaaggtgattcagcagggtccatttgggaggctgtgaagtctgccctcccctccctcacatggtttgtccctttactgggaccagctgcacttaatagcctgctttctcctctttggcccttgtctctataattcactaattaaatatgtctcttccaggatatggcaatttcacacagagcccctaaaaatggaaagagatcatccaatcttccttggaggtcccagcacctacaagtacatatctcccttggatgccagtgggcaaagattctgcaactacggaggggctccttccctgacagagagcaagagagggagaccctgatgacttcttcgtcccacgtcagcaggaagtagttacagaagacccacgacgtccttatgcccaaagcttttcagggtctccaactcttgagggggaatactgttagggtaggcaggtagccagacaagagcaggcaaggaagcccctgggaaaggaatctttagaaatgcagcccgctgatggcctccttggaaacgctgcacgctgagtcagcaaaaggaggagcgtggctacactggctacacctggccttgtggctgcattcctctgttccagaagggaacttatcaaggcccagccagaggttaccaaggtaggagctattccccactaagaagcatgtatacttctctaataattcaccctaatataccattttgttcattaaaataataaaaaaaaccacacacctgtgtggagattttattttttaaccagaaattccttgttagactttagatccaaatgacatggcacatgtgtgcccagaccagttcccaacacatgcttactagtaacgcccctgcatgaccccttcatgaataatcatgtaaaattctcataagaagcatctccccagccaggtgtggtggctcacgcctgtaatcccaacactttgggaggctgaggcaggcagatcacctgaggtcgggagcgcgagaccagcctgaccaacatggagaaaccccgtctctactaaaaatacaaaattagctgggcgtggtggcgcatgcctgtaatcccagctacttgggaggctgaggcaggagaatcgcttgaacccgggaggcagaggttgtgttgagccaagatcgtgccattccactccagcctgggcaacgagaggggaactccatctcaaaaaacgaacaaacaaaaagaagcgtctccccagcattggtgagacagactcattcatttgagcagcccagcctgttctgtctttcagggtgtactgtttatttaaaagcccccataaaaattcctcccaggccaggcatggtggctcaggcctgtaatccctgcacttccttgggcggatcctcagacagatcacagctcaggagtttgagaccagcctgacaaacatggcgaaaccccgtctctactaaaaatacaaaaaaattagccgggcctggtggcacgcacctgtaatcccagctactcaggaggctgagggaggagaatcacttgaaaccaggaggcggaggttgcagtgagccaagattgcgccactgcactccagcctgggctacaggagactccatctggggagggcggcggggaattcctcctaagtcactagcagctgactcactctctgcagcagccagttctgtctcttcttgacctcctgtctttaaataaaggttacttaacgatttaactctttctgtgtgcctcctagatgaattctttccttcaggaagataaactgaaggacctccacacccctcctggtaacaaaggtctttgtgcaatccctcctgaagaagcaatggaggatttagtatatctaaactagtaaatacaaactgtactcaattatccaagaaatcattgaagaaacactctttactccattttttatatcttgggaaaaatataattaaagacaaaataatatttgccaaacccagaaatcctcaccaaaaaggaaaaaaataaataaacaatcccagttggtggctggtgaatgcttctaccttaatcaatacatgttttgaagctgtcagcttctttttgctcataagtgactccacagaatctagtctttgctttgccctctagacaaggaatacagaatttttaaatcttatcagaaacatataaattgtttggttttgcacaatatttactaattttctccactcatccactgtggagtcatagcacaaaatgaggcaccaccctctcgtattgcaactaaaacagactgagcttctgctccataaccataaacagtaatagcaatactaattgaaagatgaagtaattttacgtaagtaggtataaaactgataattcattgttattttcagttttacaataagtgggaattacatagaataaatctttctctctctctctttctatttctgacagtcccgctctgtcgcacaggccaaagtgccatggggtgacctcagcttactgcaacctccgcttcctgggttcaagtaactcttgtgcctcagtctcctgagtagctgggattgcaggtgtacaccaccttgcttggctaatttttgtatttttcatagagatgaaatttcactatgttggccagagtggtctcaaactcccaacctcagatgatcagcctgccttggtctcccaaggtgctgggattacaggcatgagccaccacacccaacggagttttcactcatttactttaatcatcatgggttagagatatagcttttaaaaatgtaattgaatatacccttacagttaggatctaaaaagagcatttcctctattaatgtttattaaataatatggtggaactcagacttgctctgttgcccaagttggagtgcagtggcatgatcttggctcaatgcaatctctacctcatgggtttaagtgattctcgtgcctcagcctcctgagtagctgggattgcaggcatacaccaccatgcctggctaaattttgtatttttactagagacagggtttcaccatgttgctcaggttagtctcgaactcctggccacaagtgatccacccaccttggcctcccaaagtgctgggattgcaggtgtgagccaccacaccagcttaattttttttctttttcttttcttttcttttcttttttttttgagatggagtttcactcttgttgtccaggctggagtgcagtggcacaatctcagctcactacaacctgcacctcctgggttcaagtgattctcctgcctcagcctcctgagtagctgggattacaggcatgtgccaccatgcctaattttgtatttttagtagagatggggtttctccatgttagttaggctggtcttgaactcccgacctcaggtgatctgcccgtctcagcttcccaaagtgctgggattacaggcgtgagccatcgtgcccagcaattttttctatctgagtttcttccgtactaatcagcttgtgatagacacatggtttctgaaacagaaaagtgcaagggctttttatgagcagggtgtggaagactaccagtaacaaatgctttggcataagtgatgagtgagaaggggagtgagagtctctactgtcctacctactaattgtgctttgggaatttggattgaaaaaagccaccttaatggtgtttggttatcatttattctcccccacctggcaggaaataaggacagggtccccaaagctgctagggcacttagggtggatatgaaacattaaaatatgaaacattaaaacttcacttgcttgaaaccagagcagccaccaaactgctcaaaattactgccaatgatgtcttgcttcctggcattcagaaaccttctccttctctacccctgactcttccttccctctctatcccaatctcaatcaccttaaggaagagctgagtatcctgaaaaatttgaaaggaaaaaagagattcaaacttttgtagctctcttggtaagaggtgccccaatcaccttccgaggagaaatgctttgtaggagtgtctcaaaccaccaagacctgtgggaccaagcacatatggggcccataggaagaagccactgagcctcaggatcctccagatgctgggaggtacatggagcagcaggcagcattatgcttgtatcaagcacccaaggagaaaacaaggccactgagctgccccagccttccctgacatgattgtctcctatggccctgggtttgtttggagacctgcaacataactgtaattcctccttctcctttgtgagttcaaactaagggtaggtttgctaccagtcttttaaaaaagattggtgccactcttgcttacagggcagagaaggcacccagaatggtggccactggcaccccactcccaagccaataccacctctagtgtaaccatgcacacaatctccagaaggggaccccagcccctgacccagctgcattgtctctgccactgtggtgaacacttgcatggaggcaggtactctggcgccctctagcactctggctcttgaggagtcagaggaaaacactggggcccaatacaagtcccctaaagttagagcacacagtccagataagtgctggccccctaaaatcttccagaaatgaagccagtcagctgaatccaccttataccacaatccacaatcaaaccctcaaggtcatcaaatagttatgataaaagtaaaaaacaaaaacaaaaaacaatcctcatccaaaggtcagcaacctcaaagactgaaggtagataagcccaaaaagatgagaaagaatcagtgcaagaaccctggaaactcaaaaagctagagtgccttttttcttccaaacaactgcatcacctttccagcaaggtttctgcaccatgcagagatggcagaaataacagaaatagaactcaaaatgtggataaggacaaagttcattgagctatgggagtatgttgaaacccaatccaagaaagataacaaacacataaaacaatgggattatgtaaagaggccaaatctatgattcactggtgtccctgaaagagagtgaaaccaatttggaaaatatatttttgcatattatccatgagaacttccccaacctagctagagaggccaacattcaaattcaggaaatgcagagaaccccagtaagatacttcacaagaagatcatacccaagccacataatcatcagattctccaaggtcaaaatgaaagaaaaaatgttaaaggaagctagagagaaaggtcaggtcacctacaaaggaaagcccataagagcagacatctcagcagaaagcctacaagctagaagagattgagggccaatatttaacattcttaaagaaaagaaattccaacccacaatttcatagttggccaaagtaagcttcataagcgaaagagaaataagatccttttcagagaagcaaatgctgagggaattcattaccatcagacctgcagtacaagagctcctgaagaaagcattaaatatggaaagaccattaccaaccactacaaaaacacactaaaggacatagatcagttacactataccacctaacaccatgataacggatcaaatccacacatatcaatattaaccttaaatgtaaatgggcagccagctggatgcagtggctcatgcctgtaaccccagcactttgggaggtggaggtgggtggatcatgacattaggagtttcagaccagcctggccaacatggtgaaaccccatctctactaaaaacacaaaaattagctgggcatggtggtgcatgcctatagtcctagctactcaggaggctgaggcaggagaatcgcttcagccccagaggcggaggctgcagtcagctgagattatgccattgcactccagcctgggcaacagagcaagactctgtctcaggaaaaaaaaaaaaaaaagtaaatggcctaaatgccccaattaagagacagactggcaaggtgggtaaagaaccaaaacccactggtatgctgtctccaagagacccatctcacaagcagtgacacacataggcttaaaataaagaaatggacaaaaatccaagtctttgctattgtgaatagtgccacaataaatatacgtgtgcatgtgtctttagagcagcatgatttataatcctttgggtatatacccagtaataggatggctgggtcaaatggtatttctagttatagatccctgaggaatcgccacaccgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgattagcatttctctgatggccagtgatgatgagcattttttcatgtgtctgttggctgcataaatgtcttcttttgagaagtgtctgttcatatccttcgcccactttttgatggggttgtctttttcttgtaaatttgtttgagttcattgtagattctggatattagccctttatcagatgagtaggttgcaaaaattttctcccattctgtaggttgtctattcactctgatggtttcttttgctttgcagaagctccttagtttcattagatcccatttgtcaattttggcttttgttgccattgcttttggtgttttagtcatgaagtccttgcccatgcctatgtcctgaatggtattgcctaggttttcttctagggtttttatggttttaggtctagcatgtaagtctttaatccatcttgaattaatttttgtataaggtgtaaggaagggatccagtttcagctttctacatatggctagccagttttcccaacacaaatgtccaacaatgatagactcgattaagaaaacgtggcacatatacaccatggaatactatgcagccataaaaaatgatgagttcatgtcctttgtagggacatggatgaagctggaaaccatcattctcagcaaactattgcaaggacaaaaaaccaaacaccgcatgttctcactcataggtgggaattgaagaatgagaacacatgaacacaggaaggggaacatcacacacccggaactgttgtggggtggggggagggagggatagcattaggagatacacctaatgctaaatgatgagttgatgggtgcagcacaccaacatggcacatgtatacatatgtcacaaacctgcatgttgtgcacgtgtaccctaaaacttaaagtataataataaaaaaaagagaaaaaaaacctgcttattaggaaagcagagtaattatagaatgtaaaattagtgaaaaaatttatgaaattttgcctttataatgatatttaaaataaataccatcatgcctcttttgcaggtaaagaaaatgaaaaactagaatatttaggctcagggtggggtaactttaaaaaagaaggactggtcatgtctatacaatacaatatccttcctcccctaataaactaactcctaaaataaaaaaataaaaaataaataaatggacaaaaatctaccaagaaaatggaaaacagaaaaaaagcagggggccaggtgcaatggctcatggctataatcccaggactttgggagaccgaggcaggaggatcacttgaggccaggagttcaagaccagcttggccaacatggtgaaatgctgtctctactaaaaatacaaaaaattagctgggcatgggggcttgtgcctgtaatcccagctactagggaagctgatgcaggagaattacttgcacaccggaggtggaggttgcagtgaactgagattgcaccactggtctccagcctgggcaacagagcaagactccaactcaaaaagaaaaaaaggaaagaaaaagaaaaaaaaaagcaggggttgcaattctagtttctaacaaaacagactttaaaccaacaaagattctaaaaagacaaggaagggcattacataatggtaaagggttcaatttgacaagaagagctaactatcctgaatacatatgtacgcaacacaggagcaccctgtattcctaatgcaggaacttgctcaaaatgcaggttcttagagactttcaaagagacttacactcccacataataacagtgggagactttaacaccccactggcaatatcagacagatcattcacacagaaaattaacaaaaatattcaggacttgaattcagcactggatcaaatggacctgacagacatctacggaactctctactcaaaaacaatagtatatacattctccccattgtcacatggcacacactcctttttttttttttttttttttttttgagatggagtctcactctgtcccccaggctggagtgcagtggcacgatctcggctcactgcaacctccgcctcccaggtacaagcaattctctgcctcagcctccaaagtagctgggattacaggcacctgccatgatgcccggctaatttttgttatttttagtagagatggggtttcaccatcttggccaaactgctcttgaacttctgacctcatgattcacccacctcagcctcccaaagtgctgggattacaggcgtgagccacggcacctggccggcacacactcttaaatagatcacataattgaaagtaaaatactcctcagcaaatgcaaaataactgaaatcataacaacctctttgatcatagtgcaatcaagtcagaaatcaagactaagaaattcgttcaaaaccatatattacacagaaattgaatcacttgctccagaatgacttttacctctataattgacaattcttgtctcccatcttgctctttcttcttaaatttccttggctattccctccaagatgatgttggataagaggagactagaagctccttagtgtcatttctgactttagtgtgactttctgtaacatgtcccagatgtttgtcaatttgatgaagatatatcacttcctagttcactatttttaggtaacattatttcctgttaaatactgccaattttttttgcatttatgaatgtgggcaccttatttttctctcaacatagagagaccccatctctacaaaaaaatacaaaaatcagccaggcatggtggcacatgcctttggtcccagctattcaggagactgagatgagaggatcatgtgaacctgggagagggaggttgcagtgagtgagtcaagatcatgaacgctgcactccagcctgggtgacagaatgagaccctgcatgaaaaaaaaagactgcatggcattggtggggagtgatatatatatccatggaacagaatagagaatgcacaaatattttcctttcaactgatatttgataaagataccaaagcaggccaggtatggtggctcacgcctgtaatcccagcactttgggaggccgaggcaggcagatcacgaggtcaagaaattgagaccatcctggccaatgtggtgaaaccccgtctctactaaaaatacaaaaattagctgggtgtggtgacacgtgcctgcaatcccagttactcgggaggctgaggcaggagaatcacttgaacccaggagacggaggttgcagtgagccgagatcatgccactgcactccagccaggcggcagtgagactccatctcaaaaaaaaaattaaaaaaaaaaaagataccaaagcaattgaaagcaggactttcaaataatggtgctggaccaaatgaatatccacaatgaaaaaagatcaatctgcacctaaatttgacactcattcaaaaaggaccatgttgtgaaatgcaaaataaagaaaccatcaaatgttaatctatcaagaattagaaaaacatactgtaaactaattgggaacaagcacaccaaagagttcatagatatgacaccaaaagcatggaaaaaaatgataaatgaaacttcgtcaagttaaaacttctggtctgtgataccaatggaacagaacagagaacccagaaataaggccacaaacctgcaactatctgatcttcgatgaagctgacaaaaacaagcaatggagataacactctctacttaataaatgatgctgggataactggctagccacatgtagaagactgaagctggacctcttccttataccacacaaaaaattaagtcaagatgaatcaaagacttaaatgagaaatcccaaactataaaacacatggaagataatctaggcaataccatcctggacatacaaatggacaaagatttcataacgaagacaccaaaagcaattacaacaaaagcaaaaattgacaaatgggatctaattacaccaaagagcttccacatagcaaaagaaactatcgcaatgaatagaaaaccgtacagaatgtgagaaacttttgtgcaaactatgcacctgacgagtctaatatccagcatctatgaggaacttacacaaaattataagaataaaacaaccccattaaaaagtgggcaaaggacatgaacatttttcaaaagaagacatatggcccagctcaatggctcaaacctataatcccagcactttgggaggccaatcctggtggatcacctgaggtcaggagttccagaccagcttggccaacatggtgaaaccccgtctctactaaaaatacaaaaattagccacgcgtggtggctcacgcctgtaatcccagccactcgggaggaagaggcaggagaattgcttgaacccgagagaggcggtggttgcagtgagccaagatcgtgccactgcactccagcctgggcaacagagtgagactatgtctccaaaaaaaaaaaagacagaaaaaagaaacaacccagagcacaggaaaagggaagacgcctgtgtggctggaacagacggagtgagcgctcactagcaggagataaggtcagagatgtcctggggaagcagatcagatagggacaaggtcttcaaacaactctctcccacaccacaaaagaaattggaaatgatttatttcctcacctgttttaagtaaacatttaacttttttctttctcgtagaagagaaagtgatcaactgtaccacatactaccaaaaggaagagaaagatgaggacaggaagttaaatattgcatttaaaaatggggaggttctctgggcgcagtggctcacatctgtaatcccagctctcagggaggcagaggcgagaggatagctagagcccaggagttcgagacccgcctgggcaatatagcaagaccccgttgttctccacaaaaagcaaaaaaaaaaaaaagacaaaaaaaagtgtaggccaggtgtggcgactcacgcttgtaatcccagcactttgggaggccaaggcgggcagatcatgaggtcaagagatcgagaccgtcctggcaaacatggtgaaaccccacctctactgaaaatacaaaaattagttgggcgtggtgcgcgtgcctgtagttccagctactcaggaggctgaggcaggagaattgcttgaacctgggaggcggaggttgcagtgaaccgagatgcaccactgcactcccgcctgcgcgacagagcaactctcaaaaaacaaaaaaaaaaaagtgtaaaaatggggaggttggctgggctcagtgactcacacctgtaatcccagtactttgggaggccaaagtgggcaaatcacaatcaccttaggtcaggagtttgagaccagcctggctaacatggtgaagccccgcctctactaaaaatacaaaaattagctgggtgtggtggtgcatgcctgtaatcccagctactcaggaggctgacgctggagaattgcttgaatccgggaggcggagtttgcagtgagcagagatcatgccactgcactccagcctggatgacagagtgagactccgtctcaaaaaaaaaaaaaaaaaagaaagaaagaaatgggaagtcactgatgattgaaaaagaagggatcagttgaatgctggaagtgaatgtttgattcaagcaagaattcaagggttcaagtaaaagttggaggcaagacttgaagagaaagtaaaagcaagctttcagagtatgacattctttctttctttcttttcttttttttttttttttgagatggagttttactcttgttgcccaggctggagtgcaatggtgcaatctcagctcactgcaacctccacctcccaggttcaagcaattctcccgcctcagcctcccaatagctgtgattacaggcatgtgccaccacgcctggcaaatttttgtatttttagtagacacagggtttcaccatgttggccagtctggtttcaaactcctgatctcaggtgatccacccgccttagcctcccaaagtgctgagattacaggcgtaaaccactgtgcctggccacgagtatgacattctcaaaggggctcagaagaggggaattaccatagagggaaatatagttaccactaatttttgttttaaagatggtgaagggggcctgcccctccacacctgtgggtatttctcgcaaggtggagatgagagactgagaaaagaaataagacacggagccttgggcccaggggaccggcgctcagcatacgaaggacccgcaccggcactggtctctgagttccctcagtatttattgatcactatctctactatctcagcaagggggatgtggcaggactataaggtaatggtggggagagggtcagcaggaaaacatgtgagcaaaggactctgtgtcataaataagtttaaggaaaggtgctgtgcctcaatgtgcatgtagaccagatttatgtttgactttacacaagcatctcagtgcagtaaagagcagtattgcccccagcatgtctcacctccagccataaggcagttttctcctatctcagcaaatagaatgtatgatcaggttttacaccgagacattccattcccagggatgagcaggagacagatgctttcctcttatctcaactgcaaagaggccgtcctctttcactaatcctcctcagcacataccctttacgggtgttgggctgggggatggtcaggtctttcccttcccatgaggccatatctcaggctatgtcagtgggggggaaaccttggacaatgcccaggctttctcaggcagaggtccctgcggccttccgcagtgcattgtgtccccgggtactcgagactggagaatggtgatgacttttaccaagcatactgcctgcaaacacattttaacaaagcacatcctgcacagccctaaatccattaaatcttgagtcaacacagcatatgtttctgcgagcacagggttggagctagggttacagattaacagcatctcaaggcagaagaatttttcttagaacagatcaaaatggagtttcttatgttttcctttttctacatagacaaagtaacagtctgacctatctttcttcccccaacaagatgggcgagcagaagggaaaaaatggctttattctgtatgtgtgcatgtgtgtttatgtgtcttttaaaggagaagaccatcattggagtatgctgatgaaaataattcccttgagcctggcgcggtggctcatgcctgtaatcccagcactttgggaggccaaggcaggtggatcacgaggtcaggagttcgagaccaggctgaccaacatggtgaaactccatctctactaaaaatacaaaaattagccgggcttggtggcacgtgcctgtaatctcagctactcaggaggctggggcaggagaatcgcttgaacccgggaggtggaggttgcagtgagctgagatcgtgccactgcactccagcctgggcaactgagcaagactccatctcaaaaaaaaaaaaaaaatcagagcttagtcttcacttgtgaaatagatttgtgaagggagcacctgcatccttggagagctctgtgattgatcttctctgtatgccagatcttacaatgggaaccagtcactcaattgaaaaacttaaatgcagtgggaataactggatcttaaggaggtagggaccaactagcgagacttatggcccctcaatttccagacttgagccagtttacagacccaggatcccttgaatgaaagggaagctggatttccttaagaaaagatctcactgcacgacaatttatactgtcaatctttctcccatcctttgccaaggagaccgctggccttttaccagggtaaatatgcattgaggaaagtggaatgatcagaccttttggggactagtggacccggctctgagctaacattgattccaggggacccaaaacatcattttggtcctcagttacagtaggggtttatgggagatcagataattaatggagttttagctcaggtctgatttacagtgagtccagtgtgtccccagactcatcctgtggtcatttccccggtgccaaaatgcataaatggaatagacatacttagcagcaggcagaatccccgcattagcttgctgactagtagagtgagggctattatggtgggaaaggccaaacggaagccactagagctgcctccatctagaagaattgcaaataaaaaacatcacaggccaggtacagtggctcacacctataatcccatcactttgggaggttgaggctggtggatcacgaggtcaggagtttaagaccagcctgaccaatatggtgaaactccgtatctactaaaaatataaaaatacaggctgggcgcggtggctcacgcatgtaatcccagcactttgggaggccaaggtggtcagatcacgagatcaggagttggagaccagctccaacagtaaaaccccatctctactaaaaatacaaaaattagctgggcatggtgtcatgtgcctgtgatcccagctgctcaaaaggcagaggcaggagaatcgcttgaatctgggaggtcaaagttggagtgagctgagacggcgccaatgcattccagcctcggcgacagagcaagactccgtctcaaaaaaaaaaaaaaagacaaaaaaaccccacaaaagttagctgggcgtggtggcgcacacctgtagtcccaactacttgggaggctgaggcaggagaatcgcttgaacccaggaggtggaggttgcagtgagctgagatcgcgctgcactccagcctgggcgttaaagcaagactccatctcaaaaacgaacaaaaacaacaacatcatgtctctggacttgaaagatccaggggtggtgattcccaccacatctccactcagctctcttatttggcctgtgcagaaggcaggtggatcttggagaatgacagtggattatcataagctcaaccaagtggtgcctccaatggcagctgctgtaccagatgtggtttcactgctcgagcacattaccacatctcctggtaactggtatgcagccactgatttggctaactgcttttttttccttccattcctgtccataaggcccactagaaggaatctgccttcagctggcaagaccagcaatataccttccctgtcctgccttggaggaatacgggctctccagctttatgtcataatcttgctcacagagatcttgatcagttcgctttcataagatatcacactgctcctttacattgatgacgttatgctgagtgggcccagtgagcaacaagtagcaaccacactgaatttattggtgagacatttgtatgccaggggatgagaaataaatctgggtaaaattcaggattctttcgcctcagtgaaatttctaggggtccggtggtgtggggccggtcaagatatttttcttttctttttttttttttttaaatggagttttgctcttgttgcccaggctggagtgcaatgactcgatctcggctcactgcaacctctgcctcccaggttcaagcaattctcctgcctcagcctcctgagtagctgggattacaggcattcgccaccatacccggctaactttttgtatttttagtagagacggggtttcaccatgttggtcagactggccttgaactcctgacttcaggtgatccgcccgcctcggcctcccaaagtgctgggattacaggcatgagccactgcgtccggccaagatcttccttctaaggtgaacgataagttgctgcatttggcccttcctacaacaaagaaagaggcataacgcctagtgggcctgtttggatttggagacaacacatttctcatttgggtgtgttactccagcccatttatcaagtgatccaaaaggctgccaatgttgagtgtggtccagaacagaagactccacaacagctccaagctgttgtgcaagctgctctgccactgggccatatgacccagcagatccaatggtacttgaagtgtcagtggcagataggcatgctgtttggagcctttgtcaggcccctaaaggtgaatcatagtggggcctctgggattttggagcaagggcctaccatcctctgcagataactactcaccttttgaaagacagctcccagcctgttgctgggccttggtagaaactgaatatttgactatgggtcaccaagttacaatgagacctgatctgcctatcatgaactgggtattttctgattcatggagccataaagctgtgcatgcccagcagcattccatcatcaaatggaaatggtatatatgtgattgggctcaagcagttcctgaaggcacaaggaagttacatgagaaagtggctcaaatggccaggcatggtggctcacacctacaatcccagcactttgggaggccaaggtgggcggattgcttgaggtcaggggttcgagaccagcttggtcaacaaggcaaaaccccatctctactaaaaatacaaaaattagccgggtgtggtggtgcatgcctgtaatcccagctactcaggaggctgaggcaggagaatcgcttgaacccgggaggtggaggttgcagtgaactgagattgtgccactgcactccagcctgggtgacagaatgagactccatctcaaaaaaaaaaaaaaaaaaaaaagagaaagtggctcaaatgcctatggtctctactcctgccatcctgccttctctccctcagcctgcatcaacatcctcatggggagttccctatgatcagttaacagagcaaaagaagactagggcccagtttacagatggttctgcatgatatgcagttaccacctgaaagtagacagctgcagcaccttctaggacatccctgaagaatagtggtgaagggaaatcttcccagtgggcagaactttgagcagcacagctggttgtgcacttcggtttgaaggagaaatggccagatgtgtgattctatactgactcatgagttgtagctaatggtttggctggatggtcagggacttggaagaagcatgattggaaaattggtggcagaaaaatctggagaacttccatccaaatgttgatggacccgagtggtcaaaaacagtgaagatatttgtgtcccacatgaatgttcaccaaaggatgacctcagcagaggaggattttaataatgaaatggataggataactcattctgtggataccactcagcctctttccccagccactcctgtcatcacccaatgggctcatgaacaaagtggccatggtagcagggatggaggttacacatgggctcagcaatatggacttccattcaccaaggctgacctggctatggccaccgctgagtgcccaatttgccaggagcagagaccaacactgagccctcaatatggcaccattccttgggagtgatcagccaggtacttggtggcaggtcttccatcatggaaagggcagcagtttgtccttgctggaatagacacttaggccagatatggatttgcctttcctgtgattctcccacctcggtctcccaagtagtagctgagattataggcgtgcattaccacgcccagctaatttttgttttttctctgtttttttgagacggattctcgctctgtcacccaggctggagtgcagtggtgtgatctcagctcactgcaagctccacctcctgggatgacaccattctcctgcctcagcctcccgagtagctgggactacaggtgcccaccaccacgcctggctaattttttgtatttttagtagagatggggtttcaccgtgttagccagatggtctcgatctcctgatcttgtgatctgcccgcctcggcctcccaaagtgctgaatttttgtattttcagtagagatggggtttcaccatgttggcaaggctgatcttgaactcctgaccccaggtgatccgcccgcctcggccttccaaagtgctgggattacaggtgtgagccacagcgcccagctgactgctgaacttttttttttttttttttgaaatggagttcacctttgttgcccaggttggagtgcagtggcacgatctcggctcaccacaacctctgcctcccaggttcaagtgattctcctgcctcagcctcccaagtagctgggattacaggcatgcaccaccacacctggctaattttgtatttttagtagagaaggggtttctccatgttggtcaggctggtctcgaactcccgacctcaggtgatctgctcactttggcctcccaaagtgctgggaataatgagccaccaagcccagccccaagaaaaaaagttttttttttcaaagctgaagcctggaagaacatataggtgactaaaaattagacaaaaagaaaaaaaaaaaaacagaaaaaaagtcaatgtagtacaccgcactgacaaagtgaaggacaaaaatcacgtgatcagctcaattgatgcataaaaagtatttgagaaaatccaatactgttcatgattttaaaaaaccatttaaactagaaagagaagaaaataccagaacatgagatttagctgtgatttcttggatacaatatgaaaagcactggcagaaaagcaaaaacagatgaaaggaactacatctaaatgaaaaacttctgtgcatcaaaagagaatgctccagcaaggatgtagaagagcgagctcctgtttcccaacacaaaagtaaaatctcaaaacttgcaggttaaaatatcacaataaaacattcactgaaaaacatgttttaaatctcatatcgatgtataaatacgttactataaatcttgtgctgactcttgccatgaactgagaatggtggttctccactgagcacgaggaaggaagcggaacagaaaagacgatgtgttacatcttagtgcctaagctataagtttggagttttactataaaacattcaccatgtgatgttcaaaataaaatagaatatttaataattattgggttaaaaaaatggttcaattctctccaatggcaaagaagctgtgattcactgtatgagcacagtgataaccattctcacctaaaacacagttcacaggggttcctccaggaatacaacatctctgttctggtctgtctgaaaatagtttaatgtatctcctgctgtttgacatttatgttgacttcatatattaaaatgtgaggaatgaaaaaatcctatcactgatgtttccatctaaactttccattccattcccagtcattaagagtttgaactcagaaacacagtgactcacttgttcagttccaaatataataaaaacgaggcaggaaagatttccccatagtgttctcattttaaagcattcaacaggaacttgtgcatattaatacctgacgtcatgggcaacttcttgaatcctggtctacaaagaggtggcatacatccaaatgtggctcctaaacaatccctgctccccagaagcactgaaaccacaaggcccacaccccatctccaatccatgtctgggtgtcagcccttccaaggaccatgcccagcagagcctcttcagaagttcatgtcactaggtcatgcaggatggaatctaagtgagatgagagggactgagggaaggcatgcgtgagtgagcaaacatgtcaggcaggatgtttcaaagatttgcaatgacattttgttacagtaggtagcttacctggtatgagaaggagagggctccccctccccattcacacacatcaggaatgagccaggcaaccatcaggtgatggtcaggtggttgttaactgtctctctaaaataataattagtcacagccggcaccagggaaaggcatagatagaaaacacctgaaactggtgatcagcctcttcccatgagatctcaggagttgggcgagtggactaaagcatgtgcatgtggacagcccaccccaaggcaagaacagcccaccccaaggaagcaagaccccggaagtatgccaacgtataaaaccctaagtcaaaaggtcaaactgcacacttgcctttcaagtcgatcacttggccctcttccaagtgtactttccttcctttcagttctgctctaaagctttttctttttttttgagtcaaagtctcactttgtcgcccaggctggagtgcagtggtgtgatctcggctcaccacaacctccacctccagggttcaagtgattctcctgcctcagcctcccgagtagctgggactacaggcgtgcaccagtaggctcggctaatttttgtatttttagtagagacggggtttccccatcttagccaggctggtattgagctcctgacctcaggtgatccgcctgccccggcctccgaaagtgctgagattacaggcatgagccaccacacccagaaaaaaatttaaaatttaatatgtgttatattataaacagagaaatcaatatgtcacaatttaatcaactcatccaatcaacacccccaaccttgttcattattctgtgtttccctcccttattccgtacatatctctcattctcatcttctctaactcttgggttcttttctgtttccccctgggtttctgctcctcattttgagcctctctcctctcttgctgtttctccgcttcttcctgctattccatcttttccacctgttctgctccagtcttacaacttgtttcacctcctgtccctctttctccccaatcactggattgtccccagtgtccatacatttctgcctctgtctttccccatctctgcttcccctgttaaattccctcttccctgtttacacccccttgtcctcagtctctagcaccctcagatccctaggcttacactgaggtctatgatccattctgagttaatttatgcacaaaacgtgaggtttttgtctggatttttttcttttttgcatttggatgtccagttgttccagcaccaaaactcaaacagaaacacacaatctgaacaggcctatagcttttaatgaatttgaaccaataatccctgagcaccctgctgtggttcttcttctgctctccttgtcaccagttgccccttcttgctgtcccagcaccacgctgctgcctgccgtggctccaaatccctcctcctctccctcactctctgtctgaggagcctcccctctgctgcccctctccctaccttgctgtccttcacctttctggacatggagcttttctctacatttctccagttgtttccccatcctgttactttctcagcttcttctttgactcttcctgtctcttcgcgaatcccccacgcatcctccattttgccatctgtttatgggtttccctcattctctgtctcagtttgtctacttctctcgcagtccctgtttccagatccccttggcccacacattcacaggagggtttagggtaagacacctgcatcccgcaggagcacatttttccagggggtggagctgggaaggcaagaacaccaggtgtcacaggacaggccctgggcacctccctaacgcgggctcaggggaagcggggactgcaaacgagaggcctggggagcagcagggcccagcaagagttggagggaggtgggggcgaaggcgccttaggataggggtggggtctgcaggatcccgccaggcagaggacgcagcctccctgggactggggctgcggggccgacgagggcgaggctgggaggcgcccaggacgcgactccacctcgcgggtgaggacttgaaaaagtgcggggcaggatgaggggtcagtacagggtttcgaacggaaaaatttaaggaaagaacatgtctacatgacctgaaggcagaaacaccggcgacggaaccagcctcagaatgattttaccccaaatcactgaaacgaccccaagagtctcatagcgatgtgtgacttactagcagtgaggggagcggtatgagaattttcaggcgtgtacgaacctccaaatccggggtatggaggtgagaggactgcgaagcccaagtttaatcttaataatagacagagggaaatccacgcgccgccataccaggttcactccgcgcgatctgtttccgggtctgcaggaaactaagcgcagagcggaatcctgggcgggtcccgcgagcgacggcgtcgggagggaagaaggaagggggcggggcctccgcggagtgggggggcctatgctttcctcttctggctcccatggcatctctatttttcgggtttaggaggcaacatttaccagtgaggctgaagcaactcagcaggatctccctggggcagggcaaaccgttggtgattggatccaggaaaattcctgctattgaaaaagtttagcaacttaatttaaaagccccagaattgtctgtgaaggggatgcaaactggaacgtgaaaggcaaactctgcatggggggatggatcaatcccatgctgatgtcccacaaaacaaaatagaaatccttttattttttatttatttatttttttgagactgagtcttgctctgtcacccaggctggagtgcagtggtgcgatctcggctcactgcaagctctgcctcctgggttcacgccattttcctgcctcagcctcccaagtagctggaactacaggcgcccgccaccacacccggctaatgttttgtatttttagtagagatggggtttcaccgtgttagacaggatggtctcgatctcctgacctcgtgatctgcctgcctcagcctcccaaagtgctgggattacaggcgtgatccaccgcacctggccctagaaatccttttattttctaatctccatttactccagagagtcaaccttgtacttgtttccaaagactgactttgttttttttttttttttggaaacgtagtttcaaatctgtcagccttggcttcccaaagtgctgggattacaggcgtgagccactgggcctggcctccagagactttcatagacgcaacacctggggtgttaagcatggaaagctaggtctgtcatcaccctggattcatcttgtctctgcccagaagagacagtgcactgaaaacaggagagttttgcagcaaagagtttaattatcgcagggctagccaagtggaacaagttgggagagggggaagttagttctcaaatctgtcgcccgaaaagttgggagactagggttttgaggataattcggagagcaaggggctagggaattggtgtggctcattagttgtggagaaaatcataagagggttcaaaacaggcctcctggagctgagtcagtttctgggtgacggtcacaggaccgggcagtgccagttctctggtaccagtgaagaagacgtccaggtggcctgaatgactctgcccaattgtaaaagtctgaaaaatacctcaaagaccaatcttaggttttcacaatagtagtgttatctacaggagcaactgagaaattacaaatcactggttattgtttctgtctacattttagcagaattcagttacctcccataatcctaacatttagcctttcattagtcttagaaagttggtttcagtcacctgagagggtcactttgggagggactagtatcatcctttcttcaaagtcataactataaactgaattccacccatagttagctgggccaatgcccagtaatgagcaaacacagcttgtgaggttagaagcaacaattaggttagatttctctcactatcatgatttttgcaaaggtggtttcaggttcagtgatgttagatcaccgatttttgctttaaataataagcaatggccgggtgcagtggctcatgcctgtaatcccagcactttgggaggctgaggcaggtgggtcacctgaagtcaggagttcaagaccagcctggccaacatggcaaaaccctgtctctactaaaaatacaaaaagtagccgggtgtggtggtgcatgcctgtaatctcagctacttgggaggctgaggcagaagaatcacttgaacctgggaggcggaggttgcagtgagccaaggttgtgacattgtactccagccttggcgacaagatcgaaacttccttgaagaaaaacaaaacaaaacaaaaacctaaaacatctgatgggagaaagaacgcacaaataataacacaaaacccccaaacaatatgattactgagtgctctaatggtaaggagaaatttaaaccagctggttattaatcttaactttagccaagacagaaccccaaattcacctacatacctaggaatgggtataccatcctaggaggaggaaaaaaactgaaattcaccttcccaattggaagcgagcttaaactttagaaaggagttacctgccttctactgtcatggaagcaggaaaacgtgccttccttattggaagcaagtaaaactccagaaaaagatgtacagcaaaataaagttaagatctcaaccaaattttgatagatcagggattctctagagagggagctcccaggcctcagccaattgtcctactggtttgagccataaggatagctcaatctggtaccaagcaccaataggagatcgtcaaaggtcagggcccactctactcagagttacttccttgggtcaccaatttgtcaacgaagagtacctgagacaggtctcaatcaatttagaaagtttatattgccaaggttaacaacatgcctgtgacacagcctcaggaaatcctgatgacatgtgcccaaggtagtctaagtacagtttggttttacacattttagggagacatgagacattaatcaatatatgaaagatgtgggccaggcgcagtggctcatgcctgtgatcccaacaatttggaggccaaggtgggcggatcacaacgtcaggagttggagaccagcctggccaacatggtgaaagcctgtctgtactaaaaatacaaaaattagcctggtgtggtggcacgtgtctgtaatctcagctactcgggaggctgaggcaggagaattgcttgaacctgagaggtggaggttgcagtgagctgagatagggccattgcactccagcctgggcgacagagtgagactctgtctcaaatttaaaaaataaaataaaatagaaatatatgaaagatgtccatcgacttggtctggaaagtcacacaactcaatcagggaggaagcttctaggtcataggtagataacagacaaactgttgcattcttttggagtttcagattaggctttcactgaattcgtgatttacaggaatagtcacttatgccttagtctggcttagtgaaacaataggacaaaggaaaaaatcagatacgcatttgtctcatgtgagcagagggatgacactgagttctgtctgtcctttgtccacaaggaatttccttgtaggtaaattttgaggaaggtatgtagcttttaaaaatctttgtagctatcttatttaggaataaggaataaaatgggaggcatatttgcctgacagagttcccagcttgacttttcccttggctaagtgattttggggtctgagatttattttcctattacacctccttgtaatatcattataagagaaatgcaaattaatatggatttttttcaaataagttaaagtaggaactactttgtgtgtgtgtgtgtatgtgtgtgtgacagaatctcattctgtcacccagactggagtgcaatggcatgatcattgctcattgcagcctcaggtgatcctcccacctcagcctcctggtagctgagactacaggcatgtaccatcatgcctggctaatttttgtattgcttgtaaagacaggattttgccatgttgcccaggccagtcgcaaactcctggtctcaagtgatcctcccacctcagcctgccaaaatgccaggattacaggcatgaaccacttagcccatccaggaagtactttcatctcttgagtatatattatagcctgtgtcacacacaaaaaagagaatgtacatattctaacacagatggaacaatgaaaatgtttactactgtcaaagaacaaatttggacattggttagaagagattctattcaaaaagtatattgtggtagggagaatgctccaaccacaagatctgcaaatgtttgagtcacaagaaatgggcttttcttttctctaaagaaggaagcaaggctagaaagcaccaggtacagggcaggggatgagcatctgctgtgacctattcagggaattttttttttttttttttttttgagacagaatctcattctgttgcccaggctggagtgcagtggtgcaatctcggctcactgcaagctccgcctcctgggttcacgccatcctcctgcctcagcctcccgagtagctgggactacaggcgcatgccaccacgcccagctaattttttgtatttgtagtagagacagggtttcaccgtgttagccaggatggtttcgatctcctgacctcgtgatctgcccgcctcagcctcccaaagtgctgggattacaggcgtgagccaccacgcccggcccaaacaaagattttaaaaaataataaatacatgtgttctacttgaaaaacagaactaaaagtaataagaacaatagcaaactttgctccttacctcagtttttgaatgacattgaagggtcctcaatgtgcatttcggctgtgtggtattcatttcgatcacatgcaagacactgatcagttcttgttggaagatatggctctacatttctaacttcaagggtctctgtaactgtcgaattaagcagaaagctagggtcatattaagaaaaatagtgttcccttatacatttttctgctgatcatgggaaaacatattctcacagcttcatgaattatttggtcacaatttgacaataaaaacactaatttatatgtcagatccatgtcacattctcatattaatctaaattttcttttttttttttttgagacagagtcttgctgcattgcccaggctggagtgcagtggcgcgatctcggctcactgcaagctccgcctcccaggttcacgccattctcctgcctcagcctcccgagtagctgggactacaggcgcctgccacctcgcccggctaattttttgtatatttagtagagacagggtttcaccgtgttagccaggatggtctcgatctcctgacctcgtgatccacccacattggcctcccaaagtgctgggattacaggcatgcgcccgacctcaatctaaattttcttgacatcctttttggtaccagctgagccctgacaaaggaaggtaattcagagacattttctcttgtgatcagagaaataacctaatgagaataaacttatgttgattgggtttttttgttttttgtttgtttttgagacagggtctcactctgtcccctaggctggagtgcagtggcatgatcacagctcactgtaccctccacctcctgggctcaagccatcctcccagctcagcctcctcaatagctgggactagagggtcacgacactatgcccagctaatttttttgtattttttgtagacatagggttttgtcacgttgcccaggctggtcccaaacttctgaactcaagtgatccgcctgtgtcagcctcccagtgtgttgggattacaggtgtgcaccaccatgcccagctgaaaataaaattaaggtgaagaaagttgttctctgtgatctcaggggaaaaccttcaggtaaatttgcattcagattgaatagaagaaacatacaaatgtggatgaactagatactactttaaaagtctttctagcgccaggctcagtggctcatgcctgtaatcccatcactttaggaggctgaggcaggcagatcatgaggtcaggagatcaaggccatcctggccaaagtggtgaaaccccatctctactaaaaatacaaaaactagctgggcgtggtggcatgtggctataatcccagctactcgggagggtgaggcaggagaatcgcttgaaccagggagctggaggttgcagtgagccgagatcacgccactgcactccagcctgggtgacagagtgagacacctttacaaaaaataaataaataaagtatttctgtccacaaaccagcttggagtaggtaggtagccaggcatgagcagttaaaggagcccctgggaaaggaatcttaagaaacacagcccactgacaatccccttttgacagcaaaagcaggacagtggctacattgcctacacctgtccttgtggctggacttgtctggcccaggaagggagttatctggccctagccagaaataacccagctaggggattttccctattaaggagcgtgcacactcctctaataattcatcctagaatggccttttgctcattataatactaagaaacacatccccttttttcaaatatgattttagaaaaaaataaataagggctgggtgcggtggctcatgcctgtaatcccagcactttgggaggccgaggcaggtggatcacgaggtcaggagatccagaccatcctggctaacacggtgaaatcccgtctctactaaaaatacaaaaaaaaaattagctgggcgtggtggcaggcacctgtggtcccagctactcaggaggctgaggcaggagaatggcgtgaacccgggaggcggagcttgcagtgagccgagatagcgccaccgcactccagcctgggcgacagagtgagactccgtctcaaaaaaaaaaaaaaaaaagccacacccctgggtggagatttgagatgctaaggagatatgtgatgtgtgcatggacagtcacagcacattcctgcccaaatgacttcccagaacatgcttactaataatggctgtgcacggccccttcatgaataatcatgtcaggttctcattaaaagggtcaggccagcataagtaaggacagactccttcttttcaggagcccactcggttctgtcgttcagggtgtcgcttctttctgagctcctgtctctttaaatgaagggcatttaccctttaactctttctgcgcatctcttgactgaatccaagaagaccaagaaccagaggacttccacacccctctgggtaacatctggtgttttcacctggttacctggttacctcgcctggttatccaggtaagtaccaaaaagctggtgccagattctctggttgacgacctctgcttctttctgcactgaagaacctcctgccctaatgcagatctggcagctttaaggggaggggtttttcctctcaggctctgttcactaacgactgcccagtaccatttcccttcagccactgtcactctgctccctctggctgatttctcagctcaccctgaggggtgataagcagaggagggaggatttaaactccacagtgagtagatctgagacacatggtgacccttcttgcaggaggcttgtgaaggtggcagggaatacgcctggctgtgcagtgactggggagcttcatatttttttttgtgggggggaggacagagtctcactctgtcgcccaggctggagcgcagtggtgtgatctcggctcactgcaacctccacctcccgggttcaagcgattcttctgcctcagcctcccgagtagcagggactacaggcgtgtgccaccatgcccggctaatttttgtatttttagtagagacagagtttcaccatattggccaggctggtctcgaactcctgacctcgtgatccgcccacctcggcctcccaaactgctgggattacgggcgtgagccactgcgaccggcgcatatcttttaattaaaactacaatccggtgttaagtcagctcttatacttgccattcatggccgttcactcccctgaacaccatatgcccccaccgttgattaatctcccaggtcactctgcttactctttgctgtccctctcctcgccgcagggatttcatgaattcttcctgcgggtgcaagcctcttgcagggcctgtttatccaggacctgctgcgtttgcttcactcaggcgccagagtcctttgagggcctatgctgatgtttatacttttttcctcagaaatgagactcagctttgtcctttcccttgcctcctgtttcactggagggaccggcactgggaggatgcctgcttaaagaaatccctcattttggccgggcacggtggctcatgcctgtaatctcagcactctgagaggttgaggggggtggatcacctgagggcaggagttcaagaccagcctggccaacatggtgaaaccccatctctactaaatatacaaaaattagccgggcgtggtggcacacgcttgtaatcccagctacttgggaggctgaggcaggagaatcgcttgaacccgggagctggccattgcagtgggccgagatcgcaccattgcactccagcctgggcaacaagagcgaaactctgtctgaaaaaaaaaaagaaagaaagaaatccctcacttattattgggtccttctccgcctgcctactcttcaagaatgcctcattctgtgactcctcaatggaactgcctggctcttccagagggtcacctgtgaccacttccttactccctagtttctctgtacaaccagggtttccaatgggccacaggagactgctttctccacctcattaggccattgtaacagacccgtgaagtactcaggtcctttttgctttttgttgaataagctgatagaaaatgcttctcacattccccttgctgtttatgtgatcatataatggactaaaaaaccagaatcaacagcccagttcactaactctgagccccagggggtcttctatgcttttcaagcatttttttctgtataaaccccaaggaaccttttaagagtgggggaagatatcacatcttttccgttcctgtaatcattagtattagcccaatatcattatgtattaagaagacctaggctgggcgcattggctcacgtttgtaatcccagcactttcggaggccaaggcgggcgtgtcacccgaggttgtgagttcgagaccagcctgatcaacatggagaaaccccgtatcggctgggcacggtggctgatgcctataatcccagcactttgggaggctgaggcgggcagatcacgaggtcgggagtttgagaccagcctggccaatatggtggaaccctgtctctactaaaaaattagccgggcctggtggcatggatctgttatcccagctattcaggcggctgaggcagaagaatctcttgaaccctggacacagaggttgcagtgagctgagatcgtgccactgcactccagcctgggtgacaaagtgagactccatgtcaaaaaaaaaaagaaaccccgtctctactaaaaatacaaaaatagctgggcatggtggtggacaccagtaatcccagctactcaggaggctgaggcagaagaatcgcttgaacccaggaggcggaggttaccgtgagccaagatagcgccactgcactccagcctgggcaacaagagagaaactgtctcaaaaaaaaggactttagaagtcccttctctgcagaattcagcaggggcacaactactgggcttcctgcagaaccaaggtcactgggaacatgagagaagagaagagaactactctcatggcagacattcttccacccgtccttacccaacacggaagagtggaaggcatcactgctgggcatcaatcccaggaaatctaagaaatccttctgagcaaaacaataggaagaaatgcaaacagcagagcacacagtagggctaattccagagctccaaggtgaaggacacttcacccttgcagggagaggcatgagacacctcatttaggtcaaggattggaatgcctgaccttcatgagtcaccaaataggtaaagggacacttcctctatcctgcattctctcttgtcttgtctttcagatgggtaatcagatctttatatcccaggattcccctcctggatccccttggaatctgggaaaaggttgatccccagattgtaaaacaagagactgattttcctttgcaatatagtttggtcaaaggtggggagcttaaatgttaataccatattccagcttgacctttactgccaacaccaacacaaatggtcagaagtcccttatgtgaaaatcttcatgatctcgtgggaaaaccctgatttttgtaaaggctgcaaaacgggctcaaaagaaaaagaaaaggaaaggaaacagccaagggcggtggctcacgcctgtaatcctagcactttgggaggccaaggtgggctgatcacctgtcaggtaaccaggtggccaggtgaccaggctggtcaggagtttgagaccagcctggccaacatggtgaaaccccatctctactaaaaatacaaaaaaattagccgggcatggtggcggtcacctgtaatctcagctactcgagaggctgaggcaggagaatcacttgaaccccaggaggcggaggttgcagtgagctgagatcgcaccattgcactccagcctgggagacaagagcaatactacatctcaaaaaaacaaacaaaaaaaaggccagccacagtggctcatgcctgtaatcccagtactttgagaggctgaagcaggtagatcatctgaggtcaggagttcaagaccagcctgaccaatgtggagaaaccttgtctactaaaaatacaaaattagctgggcatgctggtacatgcctgtaatcccagctactcgggaggcttaggcaggtgaatcacttgaacctgggaggcggaggttgcggtgagccgagatcccgccattgcactccagcctgggcgacaagagcaaaattccatctcaaaaaaaaaaaaaaaaaaaaaaatacaagccattcaggagtttggacaaaaggtactgcctgctcttgaccctttcaggaatcaacacccattataccaaccagggtcaaaaaacctggagagatgggtcatctgggtctcaactcccttatggaaagacccctttactgtcttactttccaccccaacagctatcaacatttctggcatctccagttggatacatcagtctcaagtgaaactgtgggaaggtcccgaagaaccacagaaga

SEQ ID NO: 439 - DNA, 219477 bp, Homo sapiens
tttgtttaatatattagatttgaccttcagcaaggtcaaagggagtccgaactagtctcaggcttcaacatcgaatacgccgcaggccccttcgccctattcttcatagccgaatacacaaacattattataataaacaccctcaccactacaatcttcctaggaacaacatataacgcactctcccctgaactctacacaacatattttgtcaccaagaccctacttctgacctccctgttcttatgaattcgaacagcatacccccgattccgctacgaccaactcatacacctcctatgaaaaaacttcctaccactcaccctagcattacttatatgatatgtctccatacccattacaatctccagcattccccctcaaacctaagaaatatgtctgataaaagagttactttgatagagtaaataataggagtttaaatccccttatttctaggactatgagaatcgaacccatccctgagaatccaaaattctccgtgccacctatcacaccccatcctaaagtaaggtcagctaaataagctatcgggcccataccccgaaaatgttggttatatccttcccgtactaattaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaataccaccaatcaatactcatcattaataatcataatggctatagcaataaaactaggaatagccccctttcacttctgagtcccagaggttacccaaggcacccctctgacatccggcctgctccttctcacatgacaaaaactagcccccatctcaatcatataccaaatttctccctcattaaacgtaagccttctcctcactctttcaatcttatccatcatggcaggcagttgaggtggattaaaccaaacccaactacgcaaaatcttagcatactcctcaattacccacataggatgaataacagcagttctaccgtacaaccctaacataaccattcttaatttaactatttatattatcctaactactaccgcattcctactactcaacttaaactccagcaccacaaccctactactatctcgcacctgaaacaagctaacatgactaacacccttaattccatccaccctcctctccctaggaggcctgcccccgctaaccggctttttgcccaaatgggccattatcgaagaattcacaaaaaacaatagcctcatcatccccaccatcatagccatcatcaccctccttaacctctacttctacctgcgcctaatctactccacctcaatcacactactccctatatctaacaacgtaaaaataaaatgacagtttgaacacacaaaacccaccccattcctccccacactcatcgcccttaccacactgctcctacctatctccccttttatgctaataatcttatagaaatttaggttaaatacagaccaagagccttcaaagccctcagtaagttgcaatacttaatttctgcaacagctaaggactgcaaaaccccactctgcatcaactgaacgcaaatcagccactttaattaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttgcaattcaatatgaaaatcacctcagagctggtaaaaagaggcttaacccctgtctttagatttacagtccaatgcttcactcagccattttacctcacccccactgatgttcgccgaccgttgactattctctacaaaccacaaagacattggaacactatacctattattcggcgcatgagctggagtcctaggcacagctctaagcctccttattcgagccgaactgggccagccaggcaaccttctaggtaacgaccacatctacaacgttatcgtcacagcccatgcatttgtaataatcttcttcatagtaatacccatcataatcggaggctttggcaactgactagttcccctaataatcggtgcccccgatatggcgtttccccgcataaacaacataagcttctgactcttacccccctctctcctactcctgcttgcatctgctatagtggaggccggcgcaggaacaggttgaacagtctaccctcccttggcagggaactactcccaccctggagcctccgtagacctaaccatcttctccttacacctagcaggtatctcctctatcttaggagccatcaatttcatcacaacaattattaatataaaaccccctgccataacccaataccaaacgccccttttcgtctgatccgtcctaatcacagcagtcttacttctcctatctctcccagtcctagccgctggcatcactatactactaacagaccgtaacctcaacaccaccttcttcgacccagccggaggaggagaccccattctataccaacacctattctgatttttcggtcaccctgaagtttatattctcatcctaccaggcttcggaataatctcccatattgtaacttactactccgggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggatttatttttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcgctatcatattcatcggcgtaaatctaactttcttcccacaacactttctcggcctatccggaatgccccgacgttactcggactatcccgatgcatacaccacatgaaatatcctatcatctgtaggctcattcatttctctaacagcagtaatattaataattttcataatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaaaaagatattagaaaaaccatttcataactttgtcaaagttaaattataggctaaatcctatatatcttaatggcacatgcagcgcaagtaggtctacaagacgctacttcccctatcatagaagagcttatcatctttcatgatcacgccctcataatcattttccttatctgcttcctagtcctgtacgcccttttcctaacactcacaacaaaactaactaatactaacatctcagacgctcaggaaatagaaaccgtctgaactatcctgcccgccatcatcctagtccttatcgccctcccatccctacgcatcctttacataacagacgaggtcaacgatccctcctttaccatcaaatcaattggccatcaatggtactgaacctacgaatacaccgactacggcggactaatcttcaactcctacatacttcccccattattcctagaaccaggcgacctgcgactccttgacgttgacaatcgagtagtactcccggttgaagcccccattcgtataataattacatcacaagacgtcttacactcatgagctgtccccacattaggcttaaaaacagatgcaattcccggacgtctaaaccaaaccactttcactgctacacgaccaggggtatactacggccaatgctctgaaatctgtggagcaaaccagttttatgcccatcgtcctagaattaattcccctaaaaatctttgaaatagggcccgtatttaccctatagcaccccctctaccccctctagagcccactgtaaagctaacttagcattaaccttttaagttaaagattaagagaaccaacacctctttacagtgaaatgccccaactaaatactaccgtatgacccaccataattacccccatactccttacactattcctcatcacccaactaaaaatattaaatacaaattaccacctacctccctcaccaaagcccataaaaataaaaaactataacaaaccctgagaaccaaaatgaacgaaaatctgttcacttcattcattgcccccacaatcctaggcctacccgccgcagtactgatcattctatttccccctctattgatccccacctccaaatatctcatcaacaaccgactaattaccacccaacaatgactaatccaactaacctcaaaacaaatgatagccatacacaacactaagggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccctatactagttattatcgaaaccatcagcctactcattcaaccaatagccctggccgtacgcctaaccgctaacattactgcaggccacctactcatgcacctaattggaagcgccacactagcaatatcaactattaaccttccctctacacttatcatcttcacaattctaattctactgactatcctagaaatcgctgtcgccttaatccaagcctacgtttttacacttctagtaagcctctacctgcacgacaacacataatgacccaccaatcacatgcctatcatatagtaaaacccagcccatggcccctaacaggggccctctcagccctcctaatgacctccggcctagccatgtgatttcacttccactccacaaccctcctcatactaggcctactaaccaacacactaaccatataccaatgatggcgcgatgtaacacgagaaagcacataccaaggccaccacacaccacctgtccagaaaggccttcgatacgggataatcctatttattacctcagaagtttttttcttcgcaggatttttctgagccttttaccactccagcctagctcccaccccccaactagggggacactggcccccaacaggcatcaccccgctaaatcccctagaagtcccactcctaaacacatccgtattactcgcatcaggggtatcaatcacctgagctcaccatagtctaatagaaaacaaccgaaaccaaataattcaagcactgcttattacaattttactgggtctctattttaccctcctacaagcctcagagtacttcgaggttaaaatattagatatttcccctgatacagggctcaatctttttctttttaaagcaatatttctcaaagtacttttcacagaacttaagtttcattaagcacttcactaaaagaaaagtctgtgatctaataaatttggaaaatattgagaattagagccccctcttagatatgtactgtagctactcagcttgttacagatgaagtaaacattgtaatattcacccagcttttgagtgatgtctattaacatcacccaaatgagtattccatggaatgcactttgcaaaaacctattattcaagaaaattctggagcatgaaagctattaatgataaacccattcacaaaatcacaccaaatatctaaaatcatgtttaaaatctcctagaaatgggttgaattgcccacttcagagacaaagtgattcttttgtaataacgagttttgtttagtgagtacttattatctcattgaatcctgaggactacctcacaaggtaagtatagctcttttcattacacatgacaaacaaggctcagagaggttaagtaacttgctcaagatcacaaaactgcagagtgacaaaactagaattttgaatctaagctcaaaaggtcaccaaaccaaatttgggtccacccacccagcctatcaaagtcaagcactgatatcggcattgctgagacagaagttgaggaatttattgcaggcagcaagcaaggagtatcaggcagctaatccttaaggcctaatctccctgatggcttatgtgtaagggtttttaaaggtgggaaggcagaggttgcaggcaaggtcatacaatacatggaggctacatattggtttggccaaaaaaggcaaaatatctcaaagtgagggcccacaggataggtgaccattagatgaattcaaagattttctgatttgagaccaggtgcagtggttcacacctgtaatctcagcgctttgggaggccaaggtgggtggataacttgaggccaggagtttgagaccagccagaccaacatggcaaaacaccatctctactaaaaatacaaaaattatctgggcatggtggtgtgcacctgtaatcccagctactcaggaggctgaagcatgagaatcgtttgaacgtgggaggcagagggttcagtgagctgagatcgtgccactgcactccagcctgggcagcagagtgagactctgtctcaaacaaacaaacaaaaacccaaagattttctgatttgtgattggttaagttttggctacaaacttggggtcagcagaaaggaatgttctgctctggcctgtgggtgtgacttcctccaggtccctcaggaagaaatttagaacaaagaacagttgtgagtgttcagtcctcagttcctccttatctgagatctacgagccaacaggtggtattttccatttagcggggtctgggtttctacaaaacaactcagggacatatgttaagatgttatctctagtttctatagggaaacaaacattttgtggctctaattttctttttttttttaattatactttaagttttagggtacatgtgcacaacgtgcaggtctgttacgtatgtatacatgtaccatgttggtgtgctgcacccattaactcgtcatttaagattagtttgtggctctaattttcttgactattgttttaagctattattaccttcttacttatcagggtgctcatctacttcttgaggctagccaggtggctggaattttccttggagggactcaagagtttcctttatttttcatgccttaaatgggtctgttctccctcttcaaagctcaagctcttaaggactatgctattgttagatttttcgtattggagcagtccttccctcctactcaagaacaccccttcttcagacagcctggctgggtcttcatcctgggagagctcatgaaacacaaaccagatcttggccctcacgtgtgtctaggcagagctgagcctgggcaacaccaagcgtgcccccaattttgcatgccccagccaattcagagtcaagatccacgctcagctccttccctgcaaagtgctaatgatgaaggatggggatcaagtcagcaaactccagaaatggtcttagactaggagtcaagccttgagatcctattacacaccagattcattccctgattagagctgctgaattcttttactctcactgcactcatgctaaagtttctttcctccagcctcataaccccagaggaggctgagccatgatacccattgtctagcaataaatatttaaggagcccctgagatatgtcaggcaccatcgcaggtgctgggacaagtgaatgtgaccaggaaagtccctcccctctcagaggttcttttcaagttggaggacagcaaatacagaaatatagagtctaacataacaacagggagtaataaacactttgaagaaaaataaagtggaataagagggtagggttgccatagggttctctgggcagtcttctatggaaaggccacttgttggggcagagaaaaaaaagatgtctgaaaggaggactaccggccccccataagtgcgctccggtccatgcacagggcaatgggcatgtaatttcctatgattaagacctacagtatgtacaatattactgcaacagacactgagactgacttagcattgtttcatagcatccgagttgctctgttggaggaaagtgcatgtgatgggcattcatttgcttccgccatcagacagattctctacctttgtctttcctacaagattccctaggaaggcagggctcagtggctcatgcctgtaagcccagcaatttgggagtctgaggcagtcagatcacaaggtcaggagttcaagaccagcttggccaacatggcgaaaccccgtctctactaaaaatacaaaaattagctgggcatgggggcacgtgcctgtaatcccagctactcaggaggctgaggcaggagaattgcttgaacagagacccgggaggcagaggttgcagtgagccaagatcgcaccactgcactccagcctgggctacagagtgagactctgataaataaataataaataaataaatgattccctaggaagctgactcccactgaatgtgccactcaggagtccctgctctctagattacagttgagtttgctcaatgcaaggccccagcagaaatgttgaaagtaagagcaaatagatagttaaccactctttaagacaacaatggatgtatacttctctggcctcagctcctgtggggaagctccagtgccagtccctgggtgcttcaccattttccgttagttcctgaaccttgtaaactgacccttcactaaattcttcctagttaaccctttgagaatgaaaccatttcctgccaggactctgacagatacaaagaacccacagccgactgctgggtgcgcggcagacctagtgcatggctccacactgccatcttgggggctggcacaggctggcactgagtctggggaagggagctggggctggaggtgtggaggggaagaccgtgcatagttgcttcctgatcagctctttattcgattgagagtgaggcagggaagattagagggaagcttacagtggaattcagggctgaggctgctattcttttgctccttgtaacttcctacagtgttgtcagcatccacatacttctctgtggggttggtctcagagccaggttaccttgtcttaggtccagtggcagcctgactggcttggtgtccttgaacaagttacctaacctctccatacctcagtccctcagctgtaaaatttttttaaaaaaaaagaagaagagtacctactgtatagcattgatttgaagattgaatgagctggtattatacaacgtttagaagcagtgcctgacatgcaaaaggctctcaacaaatactatcctttactaatatcctgtgtgtctgtatcagagctggtggggtggagggacagaaagaagtaggagaaggtaaagagatgggaaaatgatctctaaagtctctctggcactaacacaattctttattatgtgttttgtctggctctttatattgatagctgttccagaagcaatcaatagctattagtcggttttattcttatttttctgtctgatcttacaggggagcaaactgtggcaaagcatgaacttacttctcagaaaattaaccattatgttggcaatcactgtgattatttgaacttcagcatctggacaaatttagtcacatgaaatacagaagagagatttctcatggttaaaatgaagctctctttatttgcttctgctaattaaaaaatcagagctaaagatacttaaacactacagttaaaatgccatggttgtctattggcttaatgaattctcttatgaaatcaactctaaaatgttatccatcataaatcatgaaacacaatttttcttattctctttagagctttacaattcatcttaaagaccagtgtttacactctcttccgtaggttgtacaataacctttggcgagaaaaaataaatgtctggctttctgactcataggtgtgttccctttaacagaaaaagaaaatatgtcctctttaaaactgatgatcattggtcacctcaattttattgaagttcacttctgacctctttagatgtagttctctacataaaactgcccaacagaattctctgtctgaatgcctcctccacaaacaaaattttaagaactaaaatcatcatctttccttccaaatgtgctctccctatgtccccagggctctccatgtgtagagctgagaccatttgccactcagtttcctcacccaattaattacaagtcccaacaattttccgttgtttttttttttttagacggagtcttgctctgtcaccaggctggtgtgcggtggtgcaatctcagctcactgcaacctccactgcctgggttcaagcgattctcctgcctcagcttcccaagtagctgggattataggtgtgtgccactacatccagataatttttgtatttttagtagagaggggatttcaccatattggcccagatgatctcaatctcttgacctcatgatctgcccaccttggcctcccaaagtgctgggattacaggcgtgagccaccatccctggcccagttttgcctttttaacatccctcagctcttcaaatccattttctcttctctaacacctccccattccccagctcgtaatgaactcttaagtagattactacgatcacctcccaaatggtcttcctggctccatcagccttgtgaccttcaagttcattctccacatggatgtcagagtaactttctaaaatgaaaatctgaccacgttactctcttgcctaaatccgcctatggccgctgttaggatcaagtctaaactcccgaccctggaacatcaggtctttgtgctctgttcagtgcttctctacctcacctgcaaccaacaccactcccacatccatattctgctcaccgtgtatcaacatgaacaggaggtgggtgcttcagtccccaggaagacactgggccttttcaatcatctactgctgtgtaataaccaccctgcaaactgaccacatgatttcattttgcaagggttccttccttgggctgtgttcagcaaaagggtttactgagctggcaggtccaagatggcctcactcacaggactggctgttgatgggagccttgatgctcttgggctcaccccttatcctccagtaggttagagcttcttacagtggtttcaggcagcatctgaagacagtaaatgcagaagctccaaggcttcttacattctagcctggaaaatcacatcacattgcttccttcatatttttttggcaaatcaggttgcaaggcttgcccagattagggtaaagaggcaaagaggctccttttcttttctttttcttttttttttttttgagtcagaatcttgctctgttgcccaggctggagtgcagtggcgcgatctaggctcactgcaagctctgcctcctgggttcacgccattcccctgcctcaggctcccaagtagctgagactacaggcacctaccaccacgcctggctaatttttttttttttttgtattttttggtagagactgtgtttcactgtgttaggcaggatggtctccatctcctgacctcgtgatctgcctgccttggcctcccaaagtgctgggattacaggcgtgagccaccgtgcctgaccaagaggctccttttcttgatgaaaggagtagtgaagtcacattgcatgtccttgcaaagggacatgcagaccacattagtgagaatatgtgcctgtattttgcaatctgtaacatgggcataaactaaatgttttccaaagggaatagggcaaaacaaaaaggaccttgaccactcctttggccctgaataaatctaggaagcctaagagtatgactatcctgaggtagaaagagggtcacatgctggataagaggtacctgggctctccacttacaagaagagagcatggttacatttataatcaccattcccaacacgctgtgagtgcaggcagctaccaggaggagaacaaaggaaataaccaggacacccatctctaaacctgttaatttaatcacacggaacacttctatttaaaattcccgagggttaagatgtaagaatgcttatcaaggtaaatgctgttcacactgcttggagtgtcaggcctagatctctatccatcagaaacaacaatatcaataacaacaacagcaacatgatgatggggcaatttctgaaaagcaccatgtattttatcgatacatgtccgttgcagaaaatccaggtgaatccaaagaagaaataaatgtcttccacaatcccatagcccagagctaactaaccactataaagaacccagcgtggttttaactaatggatcaaaagatgctcatcaaaggctctgagctttcctgagtgctaacaggaaacatccagcatcactggtctctccaaggctgcaggtgtctttgcccatagtgcctgttttgtgtcagggaaagaatcaacctgggagccaagcccaggaatcaggatgaccaagacatactggacaaggagggaacaaacccatccaaggacactcaaggacaaatcaagcaaatgaatttaagggagacctgctcatggtctgctttgctgctcagcatggctgggaggcacagtggaagatcatgcatccttcccctgggactcctctgccagagcctgagagctttctcctgcacacaggctaggggtagggcagttggaattgatccatgccttctagctagactgtgggtcccctcagtcttgggcatggtgacagcccagcatcagacagaggtcagtatcaaactagaaaatttaataaatgctgtcagatttgtagacccaagaaaatataaactgccaatcacggaggaaaaaaatctctcaatgatcttatctttatatgattcccttgctgcctggagattgacatttccttggggataatctggtcataggattggtgaaggtggaagggaggcaacctccgaaggtggggccctctgctcacctgggacagggagggcctgaggtaggtgtctgtgtgggctggggaggaggatgggagcagtgcttctagatgtttccactttctcctcattagataataatgaatgggtgatttccctagtcactgcagtgtgaggaaatctacaaaattaatttcacaatacactttacaggataggtggagaaacacatgaagcacaactgcagtgggttataaaaaatggcctttcgagttgagcagtaaattcgttcaagcagccattctgaaggacaaactggctctgtatttaacaggggcattccagcacttctctagctactgggttgacaatgactcaccaaagcctctggtagccaccacaggacgcccagagcacgttttaaagctgaacaccaaactgcggacttcgggagtaagtgaactgactggtttttattttgttttactgcttttaacattacagtaactgttacaggttccagcaggataactgggtggaaatgagtttggtttcacttagtctctctaaagagaaagcaagttggtagactaatacctaataaaagcaaagctgccaacaattgaaattgcctggactgctctgtgtgtcccacatgcatgggtgtgggtgccagtgtgtgtgcgtgtgtgcatgcatgtgcatgtgtgttgggatagagtggtaagaaaatgggaaataataagaatgttcagtccatagcccttcattataaaaaggtgagctgtaataaatactagtgccacatttagccaaaactttactccagccaaaggtgatattttcatgataacatcctgtgattgctttgttcttcgtcttttatgttcttcctagatgggctcagaacatacaagaattaagtacacatcttattttccagtgataatgctaccggcaaattctgttgtttgtataaacatcagccatgtttatataactaaactagtgttttgttttgtcaattcagcaagaaattagaccacatggtggcttaatgctgcattgatttggctatcaatttgttttcacttttctgcaaaatatttaatacattattaaattgaattatgctgatgccacagttgttcttatctcaattgtcttaaaattcatttaatttttttttcctttggtttcattattcaaattttaacttcagttctcaacattttatctgatggaagagatggagtccattactaaggactccattgtgctccatcatgccagagttgtaaaatagatcttttaaaggaaatttactgtgatttttttctatttaagagcttcctctccagttgagcatgtaagaaaattataccaggagaatacagtaaactctatgaggcaagctataaacatgtagcattgtgattagggctggttctccttctagagacatggtaggattgcaatttcataccatccttgaagttagagagagccacgtgactcatttagccaatgaactgtgagcagaatgacatgtcacttccagcagaagctttaagaatctgagagacattcatacgttttccatgtgctgtagccttatacccaaagcctgggtcccaagtgaccatgacaggcagagctccctgttgagccacagagatttagagaatggctgttaacacagcataatccagcccatcctgactaatctgatattaacatgtataataaagaattctatcaatgctgagggaagatgattagttaaggtcctaggttgcaagtctcaaaacctcttctaaggattgtagacaggaaattaaatgacttctagtccctagagttcccaatctcctaccatcccatcctaatatgacagaagtaattcctgagttgcttctgaaaccagagcttccctcagaacccttagcctgccagatggcttcttggagagccctcactcacttttctccttctgctattgctgctcattcattccagcttttaaaaattcatctttatccaggaacctcgcttctagaaaagtcatacaggtgcttccaggaggctacatgggcacccatatttttctagccactttcattagaccaatgcagcagagaagaaaagcctcaataattattatgacatggcatgttaggataccaggtaaattgcatttgtaaaatgtgattttctgttggtgttcacttcggctctactgacatttggtaagtattattgactgactgactaactaatgtggtcattagtcttcataaagaaaggctctctacaaaaacggagggatgccctttttctggcatttaatacgtaagaaattgcctccgatagaaaccagagttgcctgattactatcagcacaggagaaatgtattaatgtgcctttctagtaacaggtttttagaaagtcaaatataaacaaatctgtctatttgtgtgtgtgcatgtggtagtggggagggaagaaaaaaggagggggagagaaagagaaataagaaccaagtttattatactgtattcagggggaaaacattttcccaaggttctaacagaagagcaaagtgccactgtcaatagcctcagtagtgtgagggttgcttttatgtatttatttatttacttatttatttatttttcctttttttttcctttctctttttttcttctttttttttttttggacagagtctcacactgtcgcctgggctggagtgcattagcgcaatcttgactcactgcaacttctgcctcccaggttcaagtgattctcctgcctcagccgcccaagtagctgggattacaggtgtctgccaccgtgcctagataatttttttatatttttagtagagatgaggtttcactatgttggccacgctggtctcaaactcctgacctcatgatccacccacgttggcctcccaaagtgctgggattacaggcgtgagccaccgcccctggccaggattgcttttatagccagtcttcaggtgcccactgtaggaacaatgtcatttagccctcgggattattctgtgccaaatatggataatgactaatattcaacacagatattctcagctcagaagagcaattagcaaattcataaattaagtgcttgcttcctttttagtcaaatacaaacatttgttaaaagatattattttgctttacactttgtctctcagaaataaacagatgcttgaattcccacagtgctgcttgagcctcacaccatgtcatcctgccaggcacccagatccagttctagagtttcacatgatcatgagtgttggttaataagtcactgtgaactgggaggggagatttttcaggagtgccacagggctctccctttaatcacatacactccctgctttcattggaaagtgtataatgatgtcagagtgccccagaatggagctagttggaagactgccgtcatagggatgccttagtgaatcaatcaggttttaatttctggctctcaactttgtagatgtaaaagttgatttatcaatatgtgagaaaggatgaatctttctgaaggttatgtcatcacactcactaagcacacagagaataatgtctagaatctgagtgccatgttatcaaattatactgagactcttgcagtcacacgggctgacatgtaagcattgccatgcctagtacagactctccctgcagatgaaattatatgggatgctaaattataatcagaacaatgtttggtgagccaaaactacaacaagggaagctaattggatgaatttataaaaatatacctcagccaaaatagcttaattcagtctcccttatcataaggatactcttgcctaaagggacagtaatattaaagacactgggaataacctctgtactttggacagtagacctgcatagcccattaggcctcaatgaagtcttatgcaagaccagaagccaatttgccattttaaggtgattctccatgtttctgctctaactgtgcttcacaatactcaagacactgaatcaggatgtttcctggagtgcagggagctgtccgtgttactgagcagttctcagcaacacaaagatcctactgactcctcatcagacttctttctcactggaattttacacctgggctgttaacaccaggccaggtcaaattcaaaggagagaaaaaagctcattatgaagggtaaaatccaaaacactgtgcataaagatatgtgtgcacaatttttatacataaagatttcataaagccaaagcatcaggaaatgaaaagagatacagaaagaaaaatgatggtaaatgagacattaatttacccttctaatctctatcacagcaaaaaggtaattaaaaaatctatatgaggaccaaaaaatacacaaagattatgtagcaaagcctatagcctaaaaaagtaaacattgaaatttgtatgtccataaaatgtttacaaaattcagtacatattacacaccccaccctaaaaacatctaagcaaagtagagaatgtagaaatgctacagattatattctctgattatgacacgacaaaactagaaattacagcatggaaatttaaaagctttctcttaaataattctatgtcaaaaagaaatccaggccgggtacagtggctcatgcctgtaattccagtactttgggaggccaaggtgggcaggtcacttgaggtcaggagttcaagaccagcctcgtcaacatggcgacaccctgtctctactaaaaatacaaaaattagctgggcctggtggcgcatgcctgtaatcccagctacttaggaggctgaggcaggagaattccttgaacccagaaggtggaggttgcagtgagctgagattgcaccactgcactccagcctaggtgacacagcaagactctgtcaaaaaaaaaaaaaaaaaagaaatccaaataaaatttccagaatatgtggaaaatagtgacaataaaaatattacacatgtgtaatcccagcattttgagatgccaaggtggcaggatcacttgagaccaggagttcgcaaccagcctggacaacatagggagactccatctccacacacgccaaaaaaaaattttaaatagccaggtatagtggtacttcttgtaatcccatctacttgggaggctaaggtgggagaatcacccaacctcaggagttcagggcttcagcaagccatgatcatatcactgcactccagcctcagcaacagagcaagatcctatctcaaaaaaaaaaaaaaaaaatcacatgtgggaaatagctatagcacaataaaaataaatgtattaagtatgaacaacaaaaaagctagtaaaggttgaacaacaactatccttaggaaagtggaaataatgtgttaataaatatgaaagcaggctaggcacggtgactcacatctgtaatcccagcactttgggaggctgaggcaggcagatcacctgaggtcaggagttccagaccagcctggccaacatggtgaaatcttgtctctcctacaaatacaaaaactagccaggcttggttgcgcactcctgtaattccagctacttgggaggctgaggcaggagaatctcttgaacctgagaggcagaggttgcagtgagccaagatcatgccactgcactccaactggggcaacagagtgacactccatctcaaaataaataaataagaaagcagaaactaataaattagaaaacagaaacatagaactaatttataaatcaaagcactatgccttgaaaagagggagaaaaattgtgaattaaggaagggaagagatggttggagaggaggtgggagaaggcagagataattgaaggagcaaaagcatctggagaagcaaagccactgaaagatgaacagggctctgaaagaaatgcttgattgctatcttttcaaatgactgcagttcccagtgacatcatttttctcctccctggaagtctgaggggcagttcacttatctcctcccctcccctactcctcaccccacactcaaaacctgtctatgctcctttcattctcatatgacagatttcagatggcattcttatttccctgatttctttttgagatagcttgcatttccctactctatataaagccaccgtttatcaaatgcctacatggaccaagcagtccacaagggcttcacagacagttttactaaactcatgccaaaactttcaggttttatagataaagatctataccttatagataaaggtatctataaggtatagataaaggtaaggtatctataccttatagataaagaaattgaagcttatagagtttaagtaatgttcccaaagcctcgtggctagtaattcaaacctaatttctgcctactccaaagtctatttttcctcatgatactatactgcctctccatggataaagacagagatcacatattaataaaatttgcacaaagtcggcaaattgttgaaagggaaggctaagatgattaataaaatcaagagccagatgatctcaacaacctgaaataactggctgacaaccaatttgaataactccctgcgggtgaagttcaaagtactatttggggtttttttttaagtttggctgggtgcagcggctcacgcctgtaatccaagcacttagggaagccaaggtgggtggatcatgaagtcaggagttgaagaccagcccggtcaacatggtgaaaccccatctctactaaaaataaaaaattagccgggcctgctggtggatgcctgtagtcccagctactcgggaggctaaggcaggagaatcgcttgaacccaggaggtggaggttgcagggagccgagatcgcaccactgcactccagcctgggtgacagggcgagattccgtctcaaaaaataaaataaaataaaataaaaaataaaagtttgatatattcagaatcagggaggtctgttgggtgcagttcatttgaaaaattcctcagcattttagtgatctgtatggtccctctatccgtcagggtcctagcaggaaattgttgcactctcaaaggattaagcagaaagagtttaatgaagggtctctttccagggttaagggaactgctagggtttggatatttgaccactccaaactcatgttgaaatgtgatccccattgttggaggtggggcctaatgggaggtgttttggtcctgagtgtggacctctcacgaatgtcttggtgccatccaagtgagttcttgctcgctctttttttctttttgagatgtagtttcactcttgctgcccaggttggaatgtagtggtgcgatcttggctcactgcaacatccacctcacgggttcaacccattctcctgtgtcagcctccagagtagctaggattacaggtacccaccactatgcccagctaatttttggtatttttagtagagacggggtttcaccatgttggccaggctggtctcaaactcctgacctcaggtgatccacctgcctcggcctcccaaagtgctgggattacaggcgtaagccaccgtgcctacctagttctagctctcttaattcccacaagagctggttgttaacaagagcctggtacaaacccctctctcttgccacgtgatctctgcacatgccagcttcccttccccttctgccatgagtggaaacagactaaagccctcaccagaagcaaatggtggcaccatgcttcttgcacaccttcagaactgtgaaccaaataaacctctcttctttaaaattattcagcctctggtattcctttataacaacacacacacacacacacacacacacacacacacacacacgcaaaagcagactaaaacaggaactaattagaaatggtaatgcaccgagggattggcaccgaggctccccaacaggaactgaggccatggatagaaggacacattcatgttatttttttctaatggttaagtaattatttgctcttactctcaaaatttctgccaaggcctcccatggaccaaactcaactaggatctaggaagcagagaacctgagtgttgcattcagcagaagtcagcttcctagggaatattgcaggaagggtgaaggtagagaatctggtggggaagcaagcaaatgcccatcacatgcactttcctccaacagagcgactcagatgctataaaacttgctaacgcagtctcagggtctgatcacagtaacatacaagccaggttttagtcatcagaaatcgcagtcctattgtcttctgcacagacccaaacacacttggaggtcatgttcaatatgaatacctcacagagaaggaaatttacacacgagaagtacatctgcagaaagccagctggcatgtcaaccattcgaaaactcagggtgttcgggataaagaagactcaggaagacaagtatgaagcataatctgtgacattattgatatcttcctgatatcaatattattgatatcttcctgaagaacataattcctgcctaccatcaacaagcatcaatactttctaccagctattctcaaccctcatcatcggaagagacagacactgactgtgtcaaagtattagtcccatcattcagcaattaactttagctcaatgcttcaaaaattcttcaggccctgtgtaatttcagctatgtacattaatgatgagtacccatacaaccattctgtttcttattttcagtaccatatttaataaatatcagttattcaatactttatttagacattttgttagattattttgaccaatgaagtctaatctaaatgttctgagcatgttcaaagtaagctaggctaacctataatttttggtgtgctaaatgcatttttaacttatgatattttcagtttacgggggtttgttgggacataacttcatcatacatcaaggagcatctgtatatgggatatagttaaagcagtgatcagaggaaaatctatagccttaacacatttattaataaaagtgtaggaattaaattatcagctgaaaaatgtaaaaagtatctaaaagagtaagcagaaagtacaagaaagaacccatagtagaaaaaagtgaaaattaataaaataagaagccaaaaaacagatcaaatcagtaaaccaaaaatcttgttctttaaacaaatcaacaaagttgacaaaaaattagatcttttaatcatgaataaaaaaagagaaagcacaaaaatgaataaggaatggtgagagaaataactattgataatcagcaaataaaaaatcattaaaaacaatgttgttcacatctatgaaaaacattgaaagctagagggaatgggtaattttccagaaaaatacaattcaccacaattgacttcaaaaaaaaaaaaaaaaagaagtacagcacttatgtgagcaatttccatagagaaatacagttgtcatggaattataacacacacacaaacactaggtttagatgttttcacagagaattccaccaaacctttagaaatcagatcatccaaaggcaaattaacaaccctcagccatttgaggcaaaatattacaattgaggcaagatatactgtactgaaaacttgaggaaaaagcaggagagaaagttcctttgggaaattcgaatactcaaaagtgcttacatacaatgaaaaatttggaaatccataagcatggccaaggtgggacacatgctcagaaaaggcctgagaagacactaataactcacctttagtaattcctaggctcacagcaagaaaaaatgaaggctaaggcagaattatatatggctccgctaagtgttgagggagccccaatacagagtcagtaagcaaagtctgggagatgtttttcatatttttttcttttttggctccttgcagtcaaggaaatcatttttaaatcactaaatgctaaatgaacacaagctaaaggaaccgagccgccttcaaacatcaaacataaaaaagaatgcagatattacaaaaccagtttacaaaagttactaaacaaataaaaactacatcccacagtgggtaacaaaaataaccttgaagaagggaaaaatttggtttccagaataaacacattataatatccaaaatgtccagttttcaacaaaaattaagaagcatgcaaataaacacaaaactatggcccatttacagaagaaataaatgagactctccctgagtaagcagatattggaaatattagacaaaaactttatataactgtcttaaataaacttaaagagctaaagaaacccaagagaatgacatataaataaataagaaatatgaattttttaaaaggtacaaaaaaattctgaggctgaaaagtacaataactaattaaaaagttactttttacttagggttccaatagaagatttgagcagctggaaaaaagaatcagtgaacttgatagatcaagtgaaatgattcagtctgaagagcaggaaaatgaaagaatgacaacaaaaaagaatagagcctaaagacctgtgtaacaacatcaagaatgcctacatacagaatcctggtggggagtgaggggcaggaagactatttgaagaaatgtgtttgaaagcttcccaaatttcactaaaaacaaatatatacattcaaaaagctcagtgcacttcatcaaggaaatatacaaagatattcacaccaagacacactatgtttcaaattgtcaaaaggcaaagcgaatgtttgaaagcagcaagagaaaggcaacgcgtcatttacaaaggatcctcaataagtttgacagcagatagtgcattataatccatggatgccagaagagcttaggaaaaaggcaatgcatcatttacaaaggattctcagtaagtttgacagcagagagctcattataaaccatgggtgccagaagagcttagaatgacattttaaagttctgaaagaaaaaaacactgtcaaccaaaaattctgtaacttggaagatgccccttcaagtattaaggataaattacacattcccagattaaaaaaaaaagagagagagaaagagaaagaaagaaagaagagagagaaagaaagggagagaaagaaaaagaaagaaagaaagaaagagaaagaaagaaagaaagaaagaaagaaagaaagaaagaaagaaagaaagaaagaaagaaagaaaaagaaagaaaagaaagaaagaaaagcaagcaagctttaaaagttcatgtttggtaggctgtacttcaagatacacttttaaaaaaaaagactccttcagatacaaactaaaaaacactagaaagtaactcaaaaccacataaagaaataactccagtaaagataactacataggtaaatataaaagcaattatcatattttttgtaagtctttttaaatattctatatgttttaaaacaaatgtgtaaaataatgactataaatctatgttaatgaagcatgatgtataaagatgtggtttgtgaaattaccaacataaagaaattcataggaaactaaataataatagagattttgtatactattgaagttgtttcaatttactctaaattgttccaaattaagaatgttaattgtaaatccccatggtaaccactaagttaatatcttttgaaaatacagaaaaggaaagcagagggtaaacacagtgatatgctacaaaatagcaactaaacacaaaagaaggcgataattgaggaaattaggaacaaaggaggtataagacatacagaaaacaaaagcaaaatggtaggagtaagcccctctttatcagtaattacattaaatacaaatgaattaaactctccaatccaaagaaagagattgacagaatggatttttaaaaaatgatccaactatattgtccacaagatactcactttagatcaaaatacacaatgagttgaaatgaaaggatgggagaaaatattccatgtaagtaataaccaaaggagatctgaggcaaatatacttatatcagacaaaatagactttaagtcaaaaactgttacaaaatacaaagaacagtatatattgatttcaaaattaaacaagaagatataacaattataaatatatgtacaccaactaacagggctccaaaatatataatgtaaccattgagagaattaaagggagagacagacaattccacgaaaattgttgggcattttaaaacccaactttaataaaggacaaaacacccagagcaaatatcaagggaggaattagaggatttgaataaaactataagcaataactatagataacacttctctcaaaaactgcagaatacacattcttctcaagtgaacatggaacattctccagcacagatgatatgttaggccataagataagctcaataaacttaaaaagattgaaatcatgcaaagtatcttcactgaccacaatggaatgaaataagatatcaataacaaaagaaaaactagaaaatttacaaatatttggaaattaaacaacacagtatttaccaaccaatgaatcaaagaacaaatcatgagggaaattagaaaatgtttagagacgattgaaaacaaagatataacaagatgggtgtgatatatcaaaagcagtgctcagagttgtaacacctacattttaaaaaagaaacatgtcaaatcaataaccaaactttactcaataaaccataaaaggaagagcaaacaaaatccagagctagcagaaggaaggaaataaagattagagcagagataaatgaaattgagaattaaaaaattatacagagatcaacaaaactaaaagttggttcttttaaaatatcaataaaattaatatacttttacatagactaagcaaaacatctctattcagctgacttttttttacaagggagccaacattattcagtggggaataatagctttttcaacaaaaagtgctgggaatactgaatattcatatgcaaaaaaaatgaagctggacccctacctcacattatatacaaaatctagattggatcaataatgtaaatatacgagtgaaaaccatacatgcttagaagaaaacatggaaataaaacattgctgtggattggcaatgcattcttagataatacaacaaaaatacaagcatgaaacaaacaaatgtagccaaaatgtaccagaatctgaaaacatgtattatctataaagaattagaggggaatttggtgaaagaaatatgggagaatgggatattgctctgtgaatgcttttgtgcataattgtacatttttaattaagttaatcttttacactctcaaagtgtgatattaagcaagcaaagataagttattacaagactctaaaaccgaatgcaatgagaaacaagtgaatccaaatatatttcaaatgaatgaatgacataatcaaacttaaggggaaaataataattaatctgattaatttttgactgttctcttatttcaaattgacttttgaacatactttgactacatactattgcttgaaaaaataaaatatctgcaaaaaattattaaatcttcatgataggattttttctttttatattagtataaatataacaattctgaaacaaatgtatgtgcattgtaagattaagccaatgagtaaatattaatatatttgtattgctagaaccccagattctcactgtgaaaggacagagatacagatatggaataagacaaggaaagaagcagcccactgagttacattagaatcagtattatcaacataaatatacaatgtgctctctcacatgctctttccttctcttaaaaaatatataatatgtacatattatatattatatgcatagacacacgtgtgtctatacatatcctacatgtacatattgaggattaacaggtgctagtagaaaatattaactttctttgtattaacaggtgttagtagaaagtagtagtaggtgctaagataaaagccataattaaacctcctggtgaatgaacacaccatcacctacaatcttaccaaaaatagaaccaagcacgtgtcctagtcaaacctctggattcaactgtcatttggataaaacgcaaaggatagtgaaaatgtcgatcttcactgagagtctaaccagcaaaattcacagtgtggacaccaagtgacaaaaatcccaaatttttcaacaaatatattgtatgggaaagaaaactttgaaaagaaacctgtatgttagaagggattttaaaaacacgacaaatgaaaacaaatgggcaagactaaatcatagtgtcttggaatgcatgcaggaaggacacagccgtgaaaatgcaaggacgcctctactggaacagtcacgtttatcgtcacttttcaggagaaaggtggctgcaactgaggagagtcacatgcttcagggctggcaaagtcctatatcttgacttatgtgatgattacagggatgtttacaaaaatcaaactataagtttgttttgtgccatgttttgtattgtgtgtgtgtgtgttttgtttttcaacttaaaaataaataaaatcaaaaccaaggcttcattatcaagtagcacaaagtctccaatctataacctcctttgtctggatatctgcatttaactaccattgccagagctaatcctgacaatgcattcatatttttaacactgaaacacagtaaacagggaaaattttgctcctctaaaacagggcatcttcaggcaatcagaacaactcagaaagtttctgtctgttgcataaaactcccctgtgcaaagagttacacaaaatgctgtcatagtaaaggtagttaactaacggcactaattgttcttgggcagtggccaagtggaacttcagagacctggcattgccagccagaaatcacttgtcatgggaattgtctcctggaatcactttggttgtcccagggtaacgcagggaaagtggttaatgggtcacttgggggtggcatcttcatcagtaaatcacatttactttctcctactaagaattttatttttggccatgaagccaaaagtcagctcttaaataacaagggaagcaaataatcattgaataaaaatagcaggaagaaaaagctgtgcaaagaaatttatgtttttaatttgttatatatgtatatttttatcatactttaagttctagggtacatgtgcacaatgtgcaggaataaaatttatgtttttaaaatttattctacattatgaattctacattagaaaaataaaccatagcctcatcacaggcacttaaatacactgaagctgccaaaacaatctatcgttttgcctacgtacttatcaacttcctcatagcaaactgggagaaaaaagcaatggaatgaataaaatgatagccacaaaaatcaaggtgggagaaatacttattatatgtccataaaaaattttaattaatgcaaagtattaacaccaatgattgcagtaatacagatcttacaaatgatagttttagtctgaacaggactatccaaaagttaattttctatagtaacagtttttaaataaaatatcaattcctgaaacacataaaatggtccatgagtatacaacgagtgaaaaaaaacaaattcagagcaaagataaattaagaagtatctaatattcaaacatagtcaaagagagggagatttctggataatcacttaaacccatggttaaacataaatgcacatatgttaatgtttactgaataacttatctgtgccaagtggtgtattaatgattcatttttatttttcactaaatcttttctctaaagttggtgtagcctgcaactaaatgcaagaaatctgacctaggacctgcacttcttaccattttgctcatatttattccctgtgcatttttgtaacatgtatatgttatatatatagaaagagagagaggcagagatggaaagtaatttatggagtttgatgttatgtcagggtaattacatgattatataattaacaggtttctttttaaatcagctatatcaatagaaaaataaatgtaggaatcaagagactcattctgtccatctgtgatagttccatcatgatactgcattgtcaagtcattgctccaaaaatatggtttagctcaacactgagtgactataggaaaccagaaaccaggctgggcgctaaagatgcaaagatgaatgagacatcatctctgccgtccaaaagcttactgtctagtgggagagttacacacgtaaggacagtaatctaataagagctaataagtgaaaactaagataaattaataatacaagattacagggaaggtttccaaagtcaatgaggcctcaaatgaatcttgaaagtgtgcaaggattaaccaaatgaagaaatgtgtaagtttttcaaacaaaaaggaacagcatgagcaaatgcaaggaggcctaaaataaagagatgtgtaaagaggtgtaagcagctttgtactgctgcctgataattagaagaatatcgggagtaacaagagctatagaagagagtcacaattacggaaaaatatttattaaattataagaaatttatagcataaggaatagtaggaccgttaaatgttttaataaagatgatgcttctttttttaatatttatttttattatactttaagttctagggtacatgtgcacaacgtgcaggttacatatgtatacatgtgccgtgttggtgtgctgcacccattaactcatcatttacattaggtatatctcctaatgctatccctcccctctccccccaccccacaacaggccgcggtgtgtgatgttccccttcctgtgtccaagtgttctcattgttcaagtcccacctatgagtgaaaacatgcggtgtttggttttttgttcttgagatagatgatgctttaaattgaccactctagctgcattgtgggaggaaaaaagattttagaacaagactagaaacagaataattagaaaaatgcaactacaatgcagatgagtgattatcaaggtctgaactgaatagtggaaatagagataaggaggcaaattcaagatatgtgcgtgacagtaaaattaacatgacctggtgtttgattgactctgtaaagtgaaaggaaaggatgaataatcaacaaataatatttattctaccaaatgcctccatgccgctttgatgacaggataatatgtaagcttttctatatttcagaaactatatgacatgacgaaaagtaaaaaggggatgggggtaaggaggtatcctgaattgactgagaaataaggaggtattccacagagaatataaaaaaacatatacttagtgttcaaggaataataaaaaagagaacatctatgtgtccaccatacaggatatgaaatagaacatttgccggccatggtggctcacacctgtaatcccagtactttgggaggccgaggtgggaggatcacttaagcccaggacacaggttgcagtgagccaagatcacactattgtactccagcctgggccaccatgtctcagaaaaataaaaaaactagatgtcttggaggattggaaacaaaatagaactttactagtgccttagacgcccattgggtgctccttgccaattgtgttctcctttatttcctgctggatatgaccactgtccttccattgcattgtatgtgttttttaatagactttaatggttctcaagtgatgcattatttagtttggttctttgaaacttatataaatgaaattattttgtagaagttctttcacctttatcagaaggtactttcaccttgattcaataataagtttgcatattacaaccttgttgaatgttggtgtaattcatccattcgtattgctatatgatattccactacatgaatatgtcggacttcattcctcagatctattgttgatgaacacttgaaatttttccagtttttaactattacaaacaatgctgctatgaacattcttttgtaaatcacctggttcatatgtgcaagatatcctctggggtatatatttaaaagtaaaattattgagttattcaacattaccatgaaatgctacactattttttttaacaatcctaccaatttacacttctaccacgaacagataagcattaccattggtcttcatttgtaggaaccatatttgtcttttgctctgggggctttgttttgttttgctttgttttttgcttagaagtgctttggctattagggatctttttttggctccatgtgaactttaggatttttttttaattttgtgagaaataacgttggtaatttgatgggaattgcattaactctatagattgtatgggtgatatggtcactttagctattgatttttctaatccgtgagcatgggatgtttttccatttgtttatgtcatctataatttctttcattagtattttgtagttctccttgtagagatctttcatttatatagttatgcattcctaggtatttttcatggctattgtaaattcagttgagttcttaatttggttctcaacaaattaatctcaacaaacattcaaacagcttgaatgtatttggtgtatagaaatacaactgatttttgtggcttgtttatcccaagactttactgaagtcgtgtatcaagtctaggagtcttctgaagactttagggttttctaggcctacagtcatgtcatcagtgagcagagatcatttgacttcttttctaatttgtataccttttatttctttctcctttctgatagttctggctagcacttccagtactgtattgaataggaatgatgaaggtgaacatccttgcttttttccagtttctagaagcaacacttctaacttttgcccatccaggatgatgttggctgtggctttgtcatagatgactcattttttgaggtatactccatctatacctatattgttgagggtttttatcataaacagatgttggattttatcaaatgcttattctgcatctaatgagatgatcatagggtttttgttctcagttccatttatgtggtgaatcatgtttattgatttgtctattttgaaccattcaagcacccctggaataaagcccacttgatcatgatgaattatctttttgatgtgttgttagcttcagtttgctagaattttgttgagtatttttacatctgtgttgatcagggataaggatttgtagttttcttttgtgttctttttaaaattttccttgttaattttactgcacagtattattttaatgatgaataaagtgttgagctggacatgtgtaccttgttcctcatgttacaatgaaactgtttaatatgtcatgattatttataatgttgagagtagtttttgtgtatatattaagatatttacatcagttctcttctattcctagtttgttattattacaaatagtttcaaatgtgaacaagtgcttttcccacagctattgaaataaccatattttgttcttttattcagttaatgtggttaatttcattgtttggttttctaattttaaaccatacattcttgaaattactgcacttagtcacgatgtatttttctttggagtatattgttggattatatttgcaaacatttttgtttagaattattatgtagtatattagtctgtaatttcatttcttttaatatccctgtatggttttactatcatggaggtaccaccatataaaacaagttggaaagtgttatgtcttcccaattctctaaaaatattcatgtaacattggcattatttctttattaaatatttggtaatatttctttattaaatattgcatccacctagccctggagttctttctacaggaaaaaaaaattttctaaataaaatttctacaatgaaaaaaaaactactcagtttttctagtttttttctgatcatttcataaaagtaggtatttttcataggaacttgaccattccttatgattgtcaaatttattaatataaagtttcatattttatatttattttatcagataaataaaattatatgttttgaaatatatattcattgtaaaatagccatgttaagctaacatatgcattaccttacatgcttatctttttttatgagaacacttaaaaatctactcttagcaattttgaagaatacaagtacatcccctatggagaacagtttgaaggctcctcaaaaaagtaaaaatagagctaccatgtggtccagcaatcccactgctgcatatataccccccaaaaaagaaatcagtatatcgaagagatatctgcactcccgtatttgttgcagcactatttacaatagcgaagttatggagtcaacctaagtgtccatcaacagatgaatgaataaagaaaatgtggtacttatatacaatgaagtattattcagccataaaaaggaatgagaccctgtcatttgcaacaacatagatgaaactggaggtcattatgttaagtgaaataagccaggcacaaaaagacaaatactatgtgttatcacttatatgtggaatccaaaaagcaaacaactgaactcatggagatagagagtagaaggaagtataccagaggctgtgaagggtagtgggggttgggagaggtgggggatggttaatgggtacaaaaaaagaaagatttaataagacctagtatttgatagcacaacagggggattgcagtctaaaattcaattatacatttaaaaataactgaaagagtataattggattgtttataacacaaataataaatgcttgaggggatgaatatccaattttccattatgtacttattgtacattgcatgcctgtaccaaaatatttcatgtacctcataaatgtatacacctgctatgtacccacaaaaattaaatttaaaaacaatacattgttatccactatagtcaccatattgcacaatagatctgttgaattcattcctcctgtacaatgcaattttgtaccctttgaccaacatctacccaatcctcctggtaaccatcattctactctgtacttctatgtgttcagccttcttagacctccacatacaagtgagattatgcagtatctggctttctgtgcctggattattttactcagtataatgtcctcccggttcattcatgttgtcacaaatgatactttttttattttttaaggttgtatactattctattgtgtatgtgtaccacattttcttcatccactcatgtgtcgatggatacttaagttaattccacatcttggctgttgtgaataatgctacaataaatatgggagtacagataactcattgacacactgatttgatatctttttaatatatgcccagaaatagcattactgaatcatatggtaattctatttttacagaatcatttatactgtcttttacaatggctgaaatagtttacattctcaacaattacaaggttttccttttctccacatcctctccaacacttggtatcgtctgccttttctgtaacagccattctaacggatgtgaaatggcattttattgtagttttaatatgcatttctctgatgatcagtgataattagcatttttatatatctgttggccatttgtatgtcttcttttgagaaatgtctatttagatcctttgtcaatttttcattagggttccttgttttcttattattgtgttgtttgagttcctaagatattttggacattagcctcttatcaaatgtatagtttgcagataatttctcccattttgtaggttatcacttcactctgttgactttcttttgctgtgcagaagctttttaggttgatgctattccatttgtgttttgttgcttttcttgcctgtgctttagagtcatatcataaaatattattgcccagaccaatgtcttggagttattcccctgttttcttctaggagttctatagtgctaggtcttacatttaagtctaacttattttgagtttatatttttatatggtatgaaataagggcctaatatcaatcttgtggacattcagttttctcaacaccattttttgaagagactgttctttccccatgtgtgttcctggcacctttgttgaaagtcaattgactataatatgtagatttatttatgggctctttattctgtgtaattggtctatgtgtctgcgtttatgccagtaccatggtgtttcgattgctatagctatgtagtataatttgaagtcaggtaatgtgatatctcctgccttgctttttttgatcaagattattttggcttttcagagttttttgtgattccatacagatttgagagttgtttttctatttctgtgggaaaatgtcataggaattttgatagagattgcattcaatatgtacatcactttggatagtatggacatttcaaacatattactttttccaatccatgaacatgagatatctttccatttatttgtggcttcttcaatcgctttcatcaatgttttgtagttttcagtgtaaagatcattcacctctttgtttaaatttacatctaagtattttttgttgctattataaataggattgttttcttgatttctttttttgtatagtttgttgttgatgtgtagaaatgctactgaattttgtatgttcacattgtatcctgcaactttactaaattcatttatgaattctaaattttttggcagagttattggtgttttctatatataagatcatgtcaactgcaaacagaaacaatttaacttcttcctttccaattttcatgccttttatttctttcttttgcctaattgctctggctaggacatccagtactatgttgaatagaagttctgagagtgggcacccttgtatgaagtttcccacaacatctcttatctttttattagctatatattaatacggatgtttcttcttcatcaggagtttgaaaaatatgtcttttctctatattgttcttaatcagtcttcctagaagtatttcaatttcaaaaagtagcaacaactgtgggagttcagtcaggctggtgggaaaaattttaaagatagttttaagaaatcgacacaaaccttcatggaaggctgggggtgttgtatagcttcagtaatagatctgaatgaaggcggcctaatccttccttgagtaaacagcttaaagtaggtgcaaaggaatgtaagggagtttatctaaataacttgtttactcatgtggtcctgaagccaacctttgatcattcacaggcaggatggctctctctcgggggagggtgaccaggttaattaccctctatttgtgttgactaaaagcccctgtcatttaatgttttttcaataaatgctggcagggctagctagtcagggctcgtggctgccagaactctttctgtgcacggcccagccccctagcggctctttcactgaataattggtgtctgagtacattattcatccctcgtgcagctggggtctgcaggacagacccccacaaacaacaatttgcaaaagcaaacttccctgttttgttttttttcccgagatgataaattagaggcttttagtgtgcctcggccacttagaaatagcaagagagtgcacaaaggtcaactctgtgagctctacgtcaagaaggaaaatgggaatccaccagaatcatgaaggacatcatagatcccaagaaggagaatgtgagcaaacagtcaacatgacagcaaccagcttataaaagtgagcgaagtcctagtatgtgagagaggcagagagcctccctctgtaactgacattttcactgtgaatctgagcaaccccagccaagttgttgcattttgtttctcccaaggcctggagtcaacatggggagaggcttggagatgctgtgaagcaaagacactgggaacagctgcagacattttcccagaccaggaagtaagagcaagatgccattttcaatctggatgcatgcaaagtcagctttttttttttctttttgtgacccagcagaatgcctgcacaggcattttagtctcaggccaaagattggaacaactgctttggggcttggtagggaccttcacagccatattgtgggaaacacctcagcagtatgtgctggaattgtgctttcccccatcgcagcctcggggcaacagaaaagctgctacagctgtaatttctcccaggtgatgaaacttgcagccagggccagcttggagacctacaaccagtctgcaggtgtcattgctgggtgccccagcctgttcccctgagaatgtgatacagcagggctttctctgcttcacccccaggcagaaattcaggcattggagcacctgtctacctggaccagcatcctgagctaccccaccgtttgtaaacataggttgtggtgcagtggggccctctccagtctatggccaggcagatttccaggtatgtggagtacccacttgactggatcagcagcctgagcttccccaaccttcctgtgctgagattatagtgcagtgaggccctctcatctccacacataggcagacctccaagcaattagagcacctgctcctatggagaacttaaatttacaagaaaaaaaaaaccatcaaaaattggccaaaggacatgaacagacaatcctcaaaagaagacatggatgtggccaacaaacatatgaaaaaaagctcaaatcactgatcattagagaaatgcaactcaaaaccacaatgagatactatctcaaaccagtcttaatggtgattatcaaaaactccagaaacaacagttgctggtaaggctgtggagaaataggaatgtttctacactgtttgtgggaatgtaaattagttcattcactgtggaaggcagtgtgaaaattcctcaaagatctagaaccagaaatgccatttgccccagcaatccctttactggatatatgcccaaaggaatataaatcactctattataaagatacatgcacagggctgggtgcagtggctcacacctgtaatcccagcactttgggaggccaaggcgggtggatcacctgaggacaggagtttgagaccagcctagccaacatggggaaactccatctctactaaaaatacaaaaattagccaggtatagtggtgcacacctgtaataccagctactttggaggctgaggcaggagaatcgctggaacccaggaggcagaggtcaaagtgagccaagatcataccattgcactccagcctgggcaacaagagcaaaactccatctcaaaaaaatatatatatacatatacatacatatatatacatatatatacacatatatatatacatatatacatatattatataggtaaatgtatatatatgtgtatatatatacacacatatatatacacatatatatacatattataactacatatatatacacacacacatacatatacatgcacacatatgtttattgcagcactatttatgatagaaaatacatggaatcaacccaaatgcccatcaatgatatattggataaagaaaatgtgatatatattcaccatggaatactatgcagccgttaaaataaatgagatcacgttctttgcagggacatggatgaagctggaagccatcaccctcagcaaactaacacaggaacagaaaaccaaacaccacatgttctcagtcgtaagagggagttgaacaatgagagcaaacacgtggatacatggaggggaacaacacacaccagggcctctcagggggacaggggtaggagaccatcaggacaaacacgtggatacatggaggggaacaacacacaccagggcctctcagggggacaggggtaggagaccatcaggacaaacacatggatacatggaggggaacaacacacaccagggcctctcagggggacaggggtaggagaccatcaggacaaacacgtggatacatggaggggaacaacacacaccagggcctctcagggggacagggggtaggagaccatcaggacaaacacgtggatacatggaggggaacaccacacaccaggacctctcagcgggacagggggtaggagaccatcaggacaaacacgtggatacatggaggggaacaacacacaccagggcctctcagggggacagggggtaggagaccatcaggacaaacacgtgggtacatggaggggaacaacacacaccagggcctctcagggggacaggggtaggagaccatcaggacaaacacgtggatacatggaggggaacaacacacaccaggacctctcagcgggacagggggtaggagaccatcaggacaaacacgtgggtacatggaggggagcaacacacaccagggcctctcagggggacggggggtaggagaccatcaggacaaacacgtggatacatggaggggaacaacacacaccagggcctctcagggggacggggggtaggagaccatcaggacaaacacgtgggtacatggaggggaacaacacacaccagggcctctcagggggacggggggtaggagaccatcaggacaaacacgtgagtacatggaggggaacaacacacaccagggcctctcagggggacggggggtaggagaccatcaggacaaacacgtgggtacatggaggggaacaacacacaccagggcctctcagggggacggggggtaggagaccatcaggacaaacacgtggatacatggaggggaacaacacacaccagggcctctcagcgggacagggggtaggagaccatcaggacaaacacgtgagtacatggaggggaacaacacataccagggcctctcagggggacggggggtaggagaccatcaggacaaacacgtgggtacatggaggggaacaacacacaccagggcctctcagggggacggggggtaggagaccatcaggacaaacacgtggatacatggaggggaacaacacacaccagggcctctcagggggacagggggtaggagaccatcaggacaaacacgtggatacatggaggggaacaacacacaccagggcctctcagggggacagggggtaggagaccatcaggacaaacacgtggatacatggaggggaacaacacacaccagggcctctcagggggacggggggtaggagaccatcaggacaaacacgtgggtacatggaggggaacaacacacaccagggcctctcagggggacggggggtaggagaccatcaagacaaacacgtgggtacatggaggggaacaacacacaccagggcctctcagggggacaggggtaggagaccatcaggacaaatagctaatgcatgcagggcctcatacctaggtgatgggttgatgggtgcagcaaaccaccatggcacacatttacctatgtatcaaacctacactttctgcacgtgtatcccagaacataaaataaaatttaaaaaatatatacactgattcatgatctcctttctctccttctgaaacactctttaaaactttttagcatttccccctctgtcttccatgtctcctaactacatgtttcttattttccatttccttattcctgtgttcattttggatagccccttctgacctatattacagtttactagttcactcttcaactgcttctaacatactaatattctgttaaaaccattcatttgggtttaaatttcaattatgttattctctatggacattctatttgttttcttttaatcttcttggccattctctagagtttcctgttccattatgatatttttaattttttgttttactttaaacatactaaatatagttattttattttctgtatctgatactttcaataactgcagtcttcgctagtcttttttctgtgctcttgctcatagtttttttcgtttgttttcatgattagaaaaacagagagagaagaaggagagtaaagggaggaggaggaggaggagaaaagaagaaagcagagaagaagggacagagaaaaaaaggaagttggttctaacgtttctctaacaactgtcttcagtgaaacgctcccaccttgtggatttttaggttattgaaattaaccagtcttctgggtgcagcacaccaacatggcacatgtatacatatgtaacaaacctgcactttgtgcacatgtaccctaaaacttaaagtataataaaaaataaaataaaaagctacacaaattaaaaaaaaaagaaatcaacctaattcctagattaccacctcttgattcaaatgctttaaatctaggcttttcatctgagtctttctttttagttattctgtttatcttcaaaacactcctgctttgaatcattcaaaatctacctccctccctctgtttgactaccatcaatttttttgctcattcctaatgcattaatctattagctgtgaatatccaaaaaccctcatttcactgaatctttgacagacccctttgcatcctcttgttcttctaattatttcctcagacactttatgttctcttttctttacaagcatgccatagtttatatacaatgtgtgtattgtttttatatatacctatatatagcctctttttaaaagcactgtacaccatgctttgaaatatattctaaaatcaggtagcatgaaaatggaaacataacatactaaaacatatgggatgcaacaaaagcagttataagagggacacttatagcaataaatgcctacatcaaaaaagaaaaaaagatctcaaataagcaacctaatattatgcctaaaggagcgagaaaattagagaacaatacaagcccaaagatagcagaaggaaacaaataacaaagatcagagcagaaataatataatagaaactgaaaatttcaataaaaataagaattgttttttgaaaagataaacaaaattaacaaattcttacatagactaagaaaaaagaaaacaaactcagaaatgaaagaagagacattaaaactgataccacagaagttaaaaaatcataacatactactataattaattattcaccagcaaattagataacctagaagaaattgataaactcgtaccaaaactgaatcatgaagaattcaaaatttagaacaaatcgtgaataaggaaattaaatcaccaatgaaaggtctctcataaaagaaagacccaggattgaatggctcagtggctggattctaacaaacacttagataactaacaccaatccttctcaaacgcttccagaaacatgaagaagaggaatacttccaaattcatttttcaaaaccagcattaccctgataccaaaaccagagaaggacactataataaaaataaattgcagaccaatactcctgatgaacttagatggaaaaaccctcagccaaatattagcaaatattatttttaagaaaacacagcaaaaaaattcaccatgcttaagtgggattcatccctgggaagcttattagtcttatttgattcgtgtaatcagaaaatttctatgtctagtgaagagaaatgagagcaatagagactcatagcacctcaacaaatttccaggcttgagccagttaacaaatacaagtccttcaaatacaaaaagactgtgaaagaaaatagaacagatcaatgaaactaagaatttgttctttgaaaagataaacaaaactgacaaaccattagctagactagaaaaacgagagaatactcaaagcaataaaatcagaaatgaaagaggaaatattgcaactaataccacagaaatatagaggatcataagaggccactataaacaattacaagccaacaaattggataacctagaaaaagcagataaatttctagaaaaatgcaacttacctagagaaagtcaagaagaaagataaaatctgaacagaacaatactgagtatggagagtatatcaataataaaacatctcccatcaaagaacatcccaggaccagaaaacttcattgctgaattctaacattttaaaaaataataatacaatccttctgaaattcttccaaaaacttgaaggagaaagagtatttccaaactcattttaaaagatcagcattattgttttttttttaaagtgatgttccccttcctgtgtccatgtgttctcattgtccaattcccacctatgagtgagaacatgcactgtttggttttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacatttggattggttccaagtctttgctattgtgaatagtgctgcaataaacatacgtgtgcatgtgtctttatagcagcatgatttataatcctttgggtatatacccagtaatgggatggctgggtcaaatggtatttctagttctagatccctaagaaatcgccacactgacttccacaatggttgaactagtttacagtcccaccaacagtgtaaaaatgttcctatttctccacatcctctccagcacctgttgtttcctgactttttaatgatggccattctaactggtgtgagatggtatctcattgtggttttgatttgcacttctctgatggccagtgatgatgagcattttttcatgtgttttttggctgcatagatgtcttcttttgagaagtgtctgttcatatcctttgcccactttttgatggggttgtttgtttttttcttgtaaatttgtttgggttcattgtagattccagatattagcactggggcctgttgtggggtggggggaggggggagggatagcattaggagatacacctaatgttaaatgatgagttaatgggtgcagcacaccagcatggcacatgtatacatatgtaactaacctgcacgttgtgcacatgtaccctaaaacttaaagtataatttaaaaaataaataaataaaaataaaaataaaaaggcaaacaaggacactataagaaaagtatgggccaaccaatatccctgatgaacatagatacaaaagtcctcaaaataagtactagcaaacagaatttaacaacatattaggagaacatttaccatgataaagtggatttatcctccagatgtttcagcaaacacaaatcaaatgtgataaaccacattaacagaatgaaggataaaaaaatagctatctctatatatgcagaaaaagcatttgactaaattcaaaatcctctcatgacaaaacctctcaacaaattgggcgtagaaggcatgtaccttaacacaaaacaggacatatataacaagctcacagctcacatcatacccaacaatgaaaaagtgaaatcttttctgctaagatcaagaacaagacaaggatatttattctcactacttctattcaacttatttctggaagtcctagccagagcaattaagccaaataaagaaataaaagatattcaaattgaaaaggaagaagtaaaattgtctctgtttgatgacatattatatataggaaaccctaaaaactccaccaaaaagctattagaaatgataaatgaattcaataaaattgcagaattcaaaatcaatgtacaaaactcagtagtttctttacactcacaacaaactatatgacaaaaataaagaaatcaatctcattcacagtagcatcaaaaaaactgtattttttttgtttaggagcacatttaggattgtacttaggagtacatttaaccaaggaggtgaaagatctgtattctgaacactataaaacattgatgaaaaattgtagatgacacaaatacatggaaagatattttatgttcatgggtaggaagaattaatattcttaaaatgtccttactgcccaaagcgatttataggtttaatgcaacatttatcaaaatttcaatgtcattcttcacagaaatagaaaaaacaatttgaaaatttatatggaaccacaaaggaccctgaataactaaagcactcttgagcaataagaacaaagctgaaggcctcacaatctgacttcaaaacgtattacaggaaaagaacaaaagaaggaagaagagggtagaggagaagtgcagcaagggtggagggaggtgcccgcgctgggtcggaggagcaggagtatggagggaagactcctgggtggcatggagctcttgcacctctaggcactgcccagccctgtgtcagccagggctgaacccccacaggataaggaagcctgtgtgtgtaccaacaatcaaagctacatctgtgacacaacaggacactgctatgggcagtctcagtgttgtaactactactatgaacattggtggttctggctcgcgtggaccatcaccatcatcctgagctgctgctgtgtctgccaccacagccaagccagccctcaagtccagcagtagcaacatgaaatcaacctgcctgcctatccagaagcccgcaattactcagtgctaccattttatttcaccaaactatttattaccttcttatgaggaagtggtgaactaacctccacctgtttccctccctgtctgtccattgtggatgagctctgagccctgttttcctgtgaagattctttgaattgcggccattctattcacatgaactctcacatctggagcacagatggccctctcaaggtaatttattgtatgcattgactgtttaccaaacaaatgtcttactatgtactcaggtatattcagcagcattgtcgactgcagtcccctatgcttgccagaagatactgtattcaaagtagaagtttcacagtgatgagtaatcactgcaattttcccattgctccatggactctcagaggccggtgttctgttccctgtaaatagagatgtactctgaacctttctgcctccctcagctgttcctagtccttggtatcagcccctggagatgtccacaaccacttaggacaaaaggcaaaagtggaatttcagacaaaactttgataggatcttcagtgataaacttggactaactgtggcccaggtatcagcactcccaagaattgccaggaggaagctttggcagacaccacaggtatggcaaggcctatctccctctgctgaatccaacaggggcaagcaagctggcatgtggcttgaggtgacccgaatatgtcagcacccctcagatgtctttctttgcacttttaaaaaaaatctcagaatttgctggcaacatggccaaataggaacagctccagtctgcagctcccagtgagatcaatgcagaatgcaggtgatttctgcatttccaactgaggtacctggttcatctcactgggactggttggacagtgggtgcagcgcacggagggtgagccaaagcagaatggggtgtcgcctcacccgggaagtgcaaggggttgggggaattccctcccctagccaagggaagccccgagggactgtaccatgaggaacggtgcactccacccagaaactatgcttttctcacggtcttcacaatccacagaccaggagattccctccagtgcctctgccaccaaggccctaggtttcaagcacaaaactaggcagctgtttgggcagacaccgagctagctgcaggagtttttttttttttttcatgccacaatggcaactggaatgccaacaagacagaaccattctctctcctggaaagggggctgaagccagggagccaagtggtctggctcggcgggtcccacccatacagagcccagcaagctaagatccactggcttgaaattcttgcacagcagtctgaggttgacctaggacactcgagcttggtggcgggaggggcttccacattgccaaggcttgagtaggcagttttacccccacagtgtaaacaaagccaccagaaagtttgaactgggtggagcccaccacaactcagcaaggccacagcagccagactgcctctctagatttctcctctctgggcaaggcatctctgaaaaaagggcagcagccccagtcagagacctatagataaaacccccatctccctggaacagaccacctaggggaaagggcgcctgtgggcacagcttcagcagacttaaagcatctttgaaaagcctgatggctctgaagagagcagcagatctccctgcacagtattcgagctctgataagggtcagactgcctcctcaagtgggtccctaacccccgtgtatcctgactgggagacacctcccagtaggtgccaacaggcacctcatacaggagagctctggctggcatctggtgggtgcccctcttggacaaaacttccagaggaagaaacaggcagcaatctttgctgttctccagcctccgctggtgatgcccaggcaaacagggtctagagtagacctagggcaaacaccaacagacctgcagcagaggggcctgactgttagaaggaaaactaacaaacaaaaaggaatagcatcaacatcaacaaaaaggacagccactcagtgacctcatcagaaggttaccaacatcagaaaccacaggtagataaatccatgaagatggagagaaaccagagcaaaaaggctgaaaattccaaaaaccagaacgcctcttctcctccaaaggatcacaactcctcaccagcaagggaacaaaagaaaactggatggagaatgagtttgatgaattgagagaagtaggtttcagaaggtaggtaataacaaactcctccaagctaaaggagcatgtcctaacccaatgtaaggaagctaaggacctggaaaaaaggctagaccaattgctaactagaataaccagtttagagaagaacataaatgacctgatggagctgaaaaacatgccatgagaacttcatgcagcatgcacaaggatcaagcactgattcgatcaagcggaagaaagatatcagagactgaatatcaacttaatgaaataaatcaagaagacaagattagagaaaaaagaatgaaaagaaatgaacaaagcctccaagaaatatgggactatgtgaaacgaccaaatctacatttgattgctgtacctgaaagtgatggggagaatggaaccaagttagaaaacactcttcaggatattatccaggagaacttccctaacctagcaaggcaggccaatattcaaattcagaaatacggagaacatcacaaagacactcctcaagaaaagcaaccccaagacacatagtcatcagattgagcaaggttgaaatgaaggaaaaaatgttaagggcagccagagagaaaggtcaggttacccacaaagggaagcccatcagactaacagcagatctatcagcagaaattctacaagccagaagagaatgggggccaatattcaacattcttaaagaaaagaattttccacccaggatttcatatccagccaaactaagcttcataagtgaaggagaaataaaatctttacagacaagcaaatgctgagagattttgtcaccaccaggcctgccttaaaggagctcctgaaggaagcactaaacatggaaaggaacaactggtatcagccactgcaaaaacataccaaattgtaaagacaattgacactatgaagaaactgcattaactaacagcaaaataaccagctagcatcgtaatgacaggatcaaattcacacataacaatatcaaccttaaatgtaaatgggctaaatgctccaattaaaaaacacagactggcaaattggctaaagagtcaagacccatcagtgttctgtattcaggagacccatctcacgtgcaaagacacaaataggctcaaaataaagggatggaggaatacttaccaagcaaatggaaggcaaaaaaaagcaggggtcgcaatcctagtctctgataaaacagactttaaaccaacaaagatcaaaagagacaaataagggcattgcataatggtaaaaggatcaatgcaacaagaagagctaattatcctaaatatatatgcacccaatacaggagcacccagatgcataaagtaagctcttagagacttaaaaagagacttagaccctcacacaataatagtgggagactttaacatcccactgtcaatactagacagatcaacgaaacagaaagttaacaaggatatccaggacttgaactcagctctggaccaagtggatccaatagacagctacagaactctccaccccaaatcaacagaatatacattcttctcagcaccacattgcacttattctaaaattgaccacatatttggaagtaaaacactcctcagcaaatgcaaaaaaaaatgggaatcataacagtctctcagatcgcagtgcaattaaattagaactcaggattaagaaactgactcaaacccacacaactacatgtaaactgaacaacctgctcctgaacaactactgggtaaataaagatattaaggcagaaataaataagttatttgaaaccaatgagaacaaagacataacataccagaatctctggtacacaattatagcagtgtgtagagggaaatttatagcactaaatgcccacaagagaaagcaggaaagatctaaaattgacaccctaacatctcaattagaagaactcaagaggcaggagcatacaaaaagctagcagaggacaataaataactaagatcagagcagaactgaaggagatagagacacaaaaaaaccttcaaaaaaaatcaatgaatccaggagctggttttttgaaaatatcaataaaatagatagaccactagccagactcataaagaagaaaacagagaagaatcaaacagatgcaataaaaaatgataaaggagataccaccactgatcccacagaaatacaaactactatcagagaatactataaacacctctacacaaactagaaaatctagaagaaatggacaaattcctggacacatacaccctcccaagactaaaccaggaagaagttgaatccctgaatagaccaataacaaggtctgaaattgtggcagaattaatagcctaccaaccaaaaaacagtccaggaccagatggattcacagccgaattctaccagaggtacaaagaggagctggtaccattccttctgaaactattccaaacaacagaaaaagagggaatcctccctaactcattttatgaggccagaataattctggtaccaaaatttggcagagacacaacaaaaaaaaagaaaatttcaagccaatatccctgatgaacatcgatgcaaaaatcctcaataaaatactggcaaaccaaatccagcagcatatcaaaagcttgtccaccacaatcaagtcagcttcatccctgggatacaaggctagttcaacatacgcaaatcaataaacataattcatcatataaatagaaccaatggcaaaaaccacatgcttctctcaatagatgcagaaaaggccttcgaaaaaattcaacagcccttcatgctaaaaactctcaataaactaggtactgatggaacatatctcaaaataataatacctatttatgaaaaacccacagccaatactgaatggtgaaaaactggaagcattccctttgaaaaccagcacaagacaaggatgccctatctcaccactcctattcaacgtagtattggaagttctggccagggcaatcaggcaagagaaagaaattgtctctgtttgcagatgacatgattgtgtatttagaaaaccccatggtctcagcccaaaatcttcttaagctaataagcaacttcagaaaagtctcaggatacaaaatcaatgtgcaaaaatcaagcattcctatatgcaaaaaacagacaaacagagagccaaatcatgagtgaactctcccattcacaattgctactaagagaataaaatacctaggaatccaacttacaagggatgtgaaggacctcttcaaggagaactacaaaccactgctcaaggaaataagagaggacacaaacaaatggaaaaacattccatgctcatggataggaagaatcaatatcatgaaaatggacatactgcccaaagtttttatagactcaatgctatccccatcaagctaccactgactttgttcacagaattggaaaaaactactttaaatttcatatggaaccaaaaatgagcccgcagagctaggacagtcctaagcaagtagaacaaatctggaggcatcacgctgtctgacttcgaactatactacaagtcttcagtaaccaaaacagcatggtactggtaccaaaacagatatgtagaccaatggaacagaacagaggcctcagaaataacaccacacatctacaactatctgatctttgacaaacctgacaaaaacaagcaatggggaaacgattccctttttaataaatggtgttgggaaaaccggctagccatatgcagaaaactgaaactggatccctttcttacactttacacaaaaattaactcacgatgtattaaagacttaaacataagatctaaaaccataaaaaaccctagaagaaaacctaggcaataccattcagtacataggcatggacaaaaacttcatgactaaaacaccaaaagcaatggcaacaaaagccaaaattgacaaatgggatctaattaaactaaagagctcctgcacagcaaaagaaactatcatcagagtgaacaggcaacctacagaatgggtgaaaatttttgcaatctatccatctgacaaagggctaatatccagaatctacaaagaacttaaacaatttacaagaaaataacaaacaaacccatcagtgggtgaaggatatgaactgacatttctctaaagaagacatttatgcagccaacaaacatatgaaaaaaagctcatcatcactggtcatcagagaaatgcatatcaataccacaatgagataccatctcacgccagatagaatggcgatcattaaaaagtcaggaaacaacagatgctggaaaggatgtggagaaataagaatgcttttacactgttggtgggagtgtaaattagttcaaccattgtggaagacagtgtggtgattcctcaaggttctagaactagaaatatgatttgacccagtaattgcattactgggtatatatccaaaggattataaatcattctactataaagacacatgcacacatatgtttattgtggcactgttcacaatagcaaagacttggaaccaaccaaaatgcccattcagtgatagactgcataaagaaaatgtggcatatatacaccatggaatactatgcagccataaagaaggatgagttcatatccttttcagggacatggattaagctggaaaccatcattctcagcaaactaatccaagaacagaaaaccaaacacccgatgttctcactcataaatgagagttgaacaatgagaacacatggacagagggaggggaacacaacacaccggggcctgtctgggggtaggggctgggggaaggttagcattgggttaaatacctaatgtagatgatgggttgatgggtgcagcaaaccaccatggcacgtgtatacctatgtaacaatcctgcatgttctgcatatgtaccccagaacttaaaatataatttaaaaaaaaatctcaaacaactcactgaagtgtctcaaagctgaacaagttttaccaaaatgaatccttctcagttaactgatcaaatggatgaatcctgaccctctgaagtctctttcctgagttagagcagggaactgctctgagtgttaactgttggattcactgcagtgtcctacaatattttacaagaagatgaacaggcaacctgcagacctaagcttgattcccaagtcacagtctgacccctgctacaggaggttaccctcctcaggaagagatagaaatagggaatttgaaggaatagtgaggggaccagggagatttgattgagtctggtttccaggtgaattaaaaggaagggtgtcatccagggtttgttactacagtcaaaagaataaataaatcaatgaagaaataccttcattgtctgtggttttcatgcagatatactcatggaggttgtatctctccaaaaacagacaaatccaaggctgtgaacaagcatccgcatttgaattccattaaaccaaaatctatgttgaacgaagtgaagtctgtacacagcattgcaaatgtgaacacattcctgtgtgaggcacatcaccatttgtcagttattgtgaatatgtgtatttttaagcaataagatgcagctggtcagttttctgggcaatcttggtgaggcatttcctgtgctgtggttgttctctaaccactgtgagaaacccaaataaaaatcgatcccccccaaaacaagtacgtatcacaaaaccatagtaatcaaaacaatatgacacttgcacaaaaacagacacattgaccaggggaacagaataaggagcccagaaataaactcatgcatttatgaccaataaatttttgacaaaggtgcccagaaaacgtaatgaagaatagacatttgtttcaataaatggtgttaagaaaactagatatccacatgcagaagaacacgaatgtgtatggtgtgtatccttatctcacaccatacacaaaaatcaattcaaaatggattaaaggtttaaacataaaactgtaaaactactagatgaaaacataggggaaaagttccacaatgttggtttggtcaaagatttcttggatatcacccccaaagcacaggcaacaaaagcaaaaatatatgggattgcatcaaactaaaaagcttctgcacagcaaaggaaacaatatggtgaagagacaacctacaagttgtgagaaaatatttgcagagcatacatctgatgaaaggctaatctccaaatatataagggactcaactcaatatcaagaaaacaaataaccaagtcaaaaaatgggcaaggtcctaaatagacatttctcaaaaaaaatacaaatgactaacataaaaaaagtttgtcatcctaattatcagggaaatgcaaattaaaatgacagtgagatgccacttcatacctgttagaatggctactatcaaaatgataaaagataacaagtgttgaagaggatacagagaaaagggaaccctcgtacactgttggtggaaatgtaaattaatactattatgaaaaatagataaaagttactcaaaaaactaaaactagaattactatatgatccagcaatcccacttccttgtatatatccaaaggaatttaagtcaatatgctgaagagatatctccaggctcatgttcattgcagcattattcacaatacccaaatatgaaatcaacacaggtgtctatcaactgacaaatggatgaagaaaatgtagtgtatatatacaatggaatactactcagccttaataggaaggaaaacctgatatatgtgacaacatgaattaacccagaagatatcacgctaagtgaaataagccaggcacgaaaagacaaatatcacatgatctcactgatatgtggaatctaaaaaagttgaattcatagaagtagagaatggaatggtgattatcagaggctagtagttgggggtagacatggaaaaggtagatgttgataaaagggttcaaagtttcagttagacaaagtttcagtgaactattgcacagaatggtgactgtaataaataacaaggtattgtatgtttcaaaatgactaacagagtagattttaaatgttttcaccacaaaaaagatatgtatgtcaataagatagacctaatctttccacaatttaaacatgtatcaaaacattacattgtaccccataaatagatacaattattatttgtcaatttaaaatttttcactaatttatattgttattgttgcaccaactcctttccaccaggcagattctcataaagactattttctcttttacatgaagcatttcctacacacctcttaatcacggtagcattgacgtcattccaccagattctatctccagtgttaaaataatcaagaacccagaaatctccaccagggggcaaccaatgcgtatcaaagtttcccactttcctttagatttacttatgggtaacttatgggaaaaaatacttaagtacttccctttttaaagaaaaaaattatatgaattctacaaaattatggcagaaaatttaagaagagcagatgcttcccaactcattctaaagggccagcattaccctgattctgaaacgaaaaagctttacaaaatccaagatccattcctgactaaagataaaagaaattttcagcaaactgtgaatacagaaaactttctcagcctgttaaagagtacctatgaaaaaaattatagctaacattatacttaatgatgaaatatttaatatatttcataacaggaacaagtcaaagatgtctactctaactaattctactcagcattcaacaaaatgaatatagtgaattcatactagaattttaaaagcaaatgtctttattcactgacaacataatcatctataaagaaaatcctacataacctataaaaaactgatggaacttataagttttgcaagtttacaggatataatgtcaaacaaagatctattatgtgcccataagctaagaataaacaattgtaaattgaaataaaaatgtcacttaaaagggcatcagaaatataaaacttagagataaatataaagtacatatgcataaagtacctgttcaccaaaaactacaaaacattgctgaaagaaattaaatgggcataatatagatgtagagatgtgttgaatttatgactcattttgaacaaggaatatattcatcatatattcatcagataagaattatgttacaggtctaataacattcaaatcaatacataatgtctcatagttcctgaatctaaaatatcaaagaaagaaacataaagccatatcatgtttaatgagaagggcttattatatcatttatgagatcctcttgtaaatcactagctgtttgcatactctctttattgctgccttcatctccttattcctgaatgtatagacaactggattcagaaaaggagtgagaactgcatcaaaaatagccagaaacttgtccatctgtgaattagggtgtggccgtgtatacacaaacatgggtggaccaaagaacaaaaggaccactgtgctgtgagctgaaagagtggaaagggccttggatgaaccacctgaggaatgtttccaaacagtaaacaggatgaagacgtaggagattagaagtatgaagaaagtacccacacagataaacccactgttaacagtgaccatgaactgcaatctgtaggtgtcggtacaggctagtctgagaagccgaggaaggtcacagtagaagctgtccaacacattagggccacagaaggctaaattaacaagaaatgccagttggaacagggagtgactgacaccaagggtccaggcaacagccagaaatgaaaggcacattcttgggctcataatggtcagatagtggaggggcttacatagggccacatatctgtcaaaggccatggctatgagcagcaccatctccacaccaccaacgacgtggatgaagaagatttgagcgatgcagcctccaaaggagatgactttgcgctttctgaacaggtcataaatcatcttgggagaagtgacagagcaggctcctaagtcaatgaaggagagactggccagtagaaagtacatgggggagtgtaagtgagggtcagtggtcacagaaaacacaatgaggatgtttccagtaatgcttgccacatagagcacagaggaaaacactaggaggaggagctggatctcccatgaatgagtgagtcccagaaacaaaaactcagataccactgagtgattctctccatccattggtccagccaactgggctgtggctaaaattatgagaactaagaaaatggggaggaaattgtgattatgaagataataatatgtactaaaatcaatattgcaatgtcactatgaataaatagtatacagttattctgttcctcacatattaaaaacaaaaaatcaacataatattatcacaacatgtgagctgcaacctgatttaaacccatcatcaatactttcagtgtaatgtctgatctaaaattaacagattaggtaagaacaagattcctgactatccatgaaattcatcaggtgtttaaatgacctgtgatattaactattcctcatttccaacatattccatttgtacttatacatattcttataatttccttcccttcccagtttgcacccacaattctctgacagaaagtagacataagaggaaaacatgattaacagatggattatcactgcagtaagaggtgcctgggacagacttagttgaggtaggctgtggattgagagaatatagagactggggtatgtgaaatcggaaagcccacaactgtagcagactagagtaagtggactttcacaagaaatagaatcaccaccattatctaccacattttctcatgcttactgctatttaagtgcctcagtttctatacaatctttcacaattacgaagccctaaatggcttcccatcctgcaatgatttcataaggagcctatgccacctgtcatgtaaggctttttccatgcctaataaatatgttttggagggatttcaccagtgtttctgctaagatacatgcataaaatggccacagaggttgtgagaaatctctgcagtttctctttgtctatacacatgaaagtattgaagaccagcacttggattagttaagataatgttttaattcatcactgtctcctcctccccttggtaccagcttttatgttcattgcattccccacccttttaagtactcagtacctcctgcatggtaacctattctgatatttgatattatcatgcttaatttgactgaatccattcggatattttatctttaagaaatttgtagttttatacttttaatttatgataaaattagattaatatcaaacattaacaagtgacttttaggaaggtatatgagctttcttattgacttcaaactataaagtacaaactgtgacactagaaatttagtcctttaacacatattgtatttatatgtgaagtggagggtgagcagaaaacagtgttatatttctctgtgtccagatggatactcacctcaatcattttcctatagtagaaagtagttcctgaaaacacttaatagagattattttagaagttgctgaggtacaaataaaactgctatgctgacatcatacttttttgcaccaacaactccagttcttctgacacaaaggaccatcttcctagtgccataatttatcttagaccccaaaactcacagaggcacacatcatatctctaatacttgctcaccaccactggcatgagtctctctctatcctcttctacgtgaagtgattatactgtcacctctggagctaactgtccacagtctcaagatgcacactttttacaaccagaagcctatggactgggtgagggagcagaaacagccacaggtactgcccatcagggtaatgtaagtcagcatgcaaacaactgatcagatgaacatgaatagcaaggtgctgaggcactgggaagagggaccggaaaactctataattgttgaaaaagactcaagcccttgggaagggaaatgcctacgaaattatataaagaccattttatccaagttggtcatcattcagatgaaaaccatgaggcccagaaaagtaaactgagtttccagaattcacacaattgatagaataggaaccagaattcaggcctcttgcttcctattccagaaagacaaattgcaataataatcaaataatatgagcaatcatccagtaaaaataatctagtaaaaacagcaaaactcaaaagagtgatttttcctggttaagaccaaaactaaccatagattgctatacatagtatctattataaatactgaattatatagcagcctgacaataaatacataaaatgtgtacacaaagattattgaacctgtacaatacagtagtaaatagtaactttatatttgcaaagtgactgatcattactatcagaatttgtacccattcttcatattttgttggtcatataaccagttactacaactgcaaaaacaacctaaggtcatgtttctgtgaagtccatccttttggtctttaaattttattatcctcaaaggtcaattatgatctcaatcttttcttgtaattttactgacaattctccttcacactgatttgttctttctctaattcctgtaaatagaaagaaccaaaaaaagttgaaaaaacatgtattgtacatataacaaacaatcatatgtggtatacaatatatatcaaatgagtattaagataaacattcaaagagttttaaagaaaaaagtgttatagatattggagggcagaagagacgattgccattaagaacaggtggaggaggttatgccaaggacattgacctgaccctttaggaattagtgaaaattgaataggagaagaatgaggtatacaatgtgtgaaaaatacctaaattgatataacaggaggagaccttttcatatcaattatcattacttctgtgtatataaccatattagatacccacaaacgaatagaaagtggatagttcttgattgacaagtaagactaataatcccagatcatagtaaggtcttaacttcaagtcaataatctttattacttatggttcattcctctccctcatgttttccaataattttaaaatgcataattaaaacaattctcatttaaaaacatagtagccatgactaatgatcttccagtgggaaggtactaagactttacaacatgtttcttgctggggataagacagcctacagccagcattcaactcatttttctaaagtctatggatcaatttgaaatacagaaaaagtagaacagagataaagttaaaaaaagattaaaaatatgggaagaatgggagaaaggggagattagaagatatgaacaatgatttaaaaataaaagagcctcaaaggagaagagaaactgctaagcaagactaaggtaggatgaaatacagtagtctctgtttctgagaacacaggttaaaaagaacataaataaaataaatttatcacctttaatacactcattcaaggatgctactgagtttgactttgggaatttctcacctttaatacactcatctggggatgctacggactgtgacattgggttgcatttaaagggggagagaaagggcagttgcttctattatcgccctgttggactcacagagtttctttgaaaagcacagatgataataaatggaaatattgccttttatactatacaataatatacacatgcaattcactggaaaaagtatacttgttactatgatttgaggatactaccatatactaatcaagagaaacacatgtacagaacaaagaaggcacatgaaatttttactagtgtgtgttttccttgtgttctaccaccccaggagcagcttctgctactgaagatcacagtagagttatttccaaaagttgtgggtctgcagggtggacttatcacatagctgtttgccaaaattcaaaagtccagaaaccatttccaaattttcacctcttttatcttcaaatcctaaaactatgaaaattcacaaacttagctccatacattatggtagaaaggttaataatttggactttgaggttgaccaggcctgatttttgaataaattcacaaacttacctccatacattatggtagaaaggtcaataatctggactttgaggtcgaccaggcctgatttttggatccaggctgcaacactcacttgctgtgttaacgtaacaaagttcctagaccatgctgagcttcagtttacttgttattgaattagggatatagcgttcgaaggaagaagttctagtatttgattgcacagcagagaaattatagttattgaactggggatatgtagatagacataataaattttagtattcaattatacaatggagaaatcgtagggaacaataatttattatatattctaaaatagctagcagagaaaaattataatgttcccaacacaaagaaaagataaatattcaaggtgatgaatatccaaattactctgatttgatcattacacattgtatacatgtatcaaaaatatcacatgtaccccaaaacatgtacaactatgatacatcaataaaaaacaacaaaaaaaccaaaagaatagaaatcaaaaataaatacataaatacataaaatagggataataatacctcccttgtttgcttgctcccttgctccatttgtaagaaataagtgatataatataggtaaaaatacttaacctcatgcctaccacatagtatagcacaataaatgttatttattataatctgaggcctacctacataagtgactttcaagtatagaaaattatttctcaaattttaaatactccctgattctcaggtatggtaattagacctggctttaggtaaagctctcatgtctacacttggatttaatcacttaagtatatttcccagtgccccccccaaaaaaaattgctcctaggtggacacactaatcaaagacttcctgagaaatgcaggaagaagttttgtcctctgaccacgctacgccctttccttgatggtaagccccataatctaaagccataagtttcaattcctcacataaaaagaaaaaaaatgtcttttatgaccacttcagataacactggatatttcccttgtcattaggaatgagaaatgggaggaaggtaaacttgtagacaggagaattggtagatgcttgaaaggatttctgaaaactgtgcctatccaggtgtacaaatgtgttgaccagccaaggcaaagcagtcaaaccatacaataccttatcctcaggaaaatggacttttctcccaaattgcctttttcatgaaaaatataaaattctccagtttcaacctcatgttaaatttcacatgtgaagaaaacagtcatgcacatcagaaaattaaatggcgagtcaagaccaaattcctagtcacagttatgttctgtttccagtattaccttctcacttattcattttgttaaagtggagccaaaatagaagtgggtgtcacacatcaagaaagactgaagtcgtacaaagccgatccttatccaacgtgcattaaaatatgcatcaggcatgtgtgatgcatacagtagaagtggaacaaatcaggccaggtgcagtggctcacgcctgtcagcccagcactttgggaggccaaagcaagcaaatcgcttgagatcagcagttcaagaagtgtaacaaatcctctacaatataagtagagtgaaaagagatagctacagtgatgagggaaggcactatagtgatgtggcatttgagtatagccataaaagaggataaatattacaatacatgaatatagggtctaaagaagtcttttcaagtagattgtaaaatatttcaaaaatggtaagtttggtgtatgttgaagcatacagattgtctacatcctaaaaatcattttggtgaataaaggaaaataagaaaggtagtcaatattcatttgttgcctatcattagaaacttctcaaaggtatatgagaattattaaataaatttaggaagccagtgaaggtatgggtcccgggaattgaggatgaagccagtaattagggaagatgccccatctataagtgtgatgtatcaaatggaggaaaagaaaaacggagggaaggagttcccttaagagaagattgaaatagagcagacttggggggctacacagaggaactgggactacacagttccagctttaaggctatagaaacagaaatagaaatactggtaagtaaaaacccaaaggattggtgacttatcacagctggagtgaatacgaaggagcatgaactcaaagaaaatatcaagatttaagcaagaataaataggacaatggtaggtccatttttagaaattagaaagttgaacataaaatatgtcagggtggagaaaataatcacgtgtattttaagcaaataagagtattagatattgagatgctcaggtgaaaacatatgacaggatatatgggggaaaagtacaaattcaacatgtaattgtatagtaatccatataaaaataatagacggatgtgtaagagtgcataaggtccctgaaggaaataatacacaggaaaaaaagattaaaaagcaaagacccaactatagaaactatccacattgattatgtaaagtaggaaaaggaatcaataaactagacagaacatcacagaggtaggaggacaagtgctggcctcgaggagccaacacagaagcaggtatcaagaataaaggaggagaagagagaacaaagagagagagaagagaacttctgtggcagaagatcaagtgggatggtagaataaaggagaagaaatacaagaaaattgaaataaaatttacagaaatgttctacattgtaagtgggcagttttgacctggcacattgttggcacacattataaatgtcaaatgtattaatgaatgaatgaatggataatataatgaatgtgatggagttgtcaaaagctgaattaattaaaagtccccacgagaggttagatgacaaaattttcagaaactttccatgccactctgttgtgacatcaacagtgctggacccttgaaatcaaaccaaaaggattccaccatgagaatgaaaagggctgagaaggggaatgctgggtgacacagaaggtgacaaagggcgaaaggtttctaggcatttgatagactgatggacgtccgcgctgaccataaggcacaggccacacaggaaggaaaatgagacccaacgcgaagaaaagtagggctaaacagtcgggaaaatgtgggaagaaggatgaatagtcatacgatcaactcagattcctccctgacattcttctacagctttattctcgtcctttgggagccgagatgttcattttcctacattcttagctgcctacacacggcgacttttctccacggtgcctgatccctgctgcatcctccttctctagtggcaacagcaaatggccacacagaaggcagacattgcacccaactgaggagaatgtaattcactcattgccagtcacagaccttggctcaccgatttactaagtatagattttatttctatccctcacctacctgttttgccaagggaactaagaaaagagcatcatcaaaaattcagataggtatagttctcacaagatgaaccagatccagtacggcatcactgcagacatacacacagagctgcataaaacaggaagagagctgctaatcacagccccagagggtagtggccaaagtgatgccttggagatccgagaatgccagactgagatcacacggcctggggaattaccgcctatggtcattttggttttcccgggatagccatgttaattgggtgaaataaagcatatttgattttcttatgacaaaaaagggcttttgccattgtctacagatgatactttaaatctttattttatgactaaaggtgaattccagagcaacattaaatgttgtccctttaaatttttaatcatttacataacgattaccataatattcaatttaaacataaaatgtaattgaaagtatgagattaatatgtggacatgaaatcatataatgttccatggaaaaaatagaatgtataaggcaaagaggtttaaagtaacatcaaaactaatgctcactatacaaattctatgaaatcctcataattacactgtgaagcaggtgttgttagagccacataatctcaaacaaattatttattatctaaaattacatagatattaaaaggttaggccatatatgaatttaggattctctcaaaaattttttctctttctcctacatcaaacttccctaaattatagaaaagtcacaatgttaccaaacatattcacaaaacacatataatcttgaatccaaatttcagttacagcagaaaaaataaaactctagatcaatctcaatcgtgtaaataaattcagatttccaatctaagagtctcaatttgacatacttctttctctctcttctttcaaaccaggagaaatataaatatgagccacaaccttacaaaagctagaaaatatttacaattccacacaacaacacatgaagaaaaccttctggacatcaaaagtttaaaccagtcaagactgaacaccaagataaagtgcatgcctctgaagagcttgagctagtcaagaagcccagaaatccctaaaagaggtgtgtatactgaggactgaggatcaaaacctgtgatctttacttggaacagaaatattgcagcatgtgaaccctccacagagtgacagagggaaaggagtttaaagggaaacatgcaaatgtatcacctttggaataattaggacacgtgtgtggtgtaatgaaagaaggcaaaaagatggggaagaagccagacagatggcaattttcattctattatgaaaagaaaaggataagtcacaagtcacatgatgaaattaacaactatgaatccactctaagccatagtcaatcctatagcctaggagtcattctaacagatgagagtgttttggagacaagattccaaaactcgtctgccttccatcatacttactacccccagctcctcctccacaatatcctttcacaagtatctagaatattcaaagactaataatattatataattatttataataattgtattacaaaaataaaacttgatgacctttataaaaatactagaagaaaaagggaaaattacataaggtacagaacatacaaattataccatgaagcagtaaaaaacaggatcaaattttctatgttttttaaaaatatgccttctctaaaatgttttctctctgaaatgatatttagaagacataattgaaaataaatacaaaataaagtgataaaaaataatctggcaaaattcaggatgtaatgagtaaagacaaccatgaaagaaatgaagatcaataaaagcaggaaaaaaagtgggaagtggagagaataatgctgctaaaaacacagataagaatataaatgacaggcttaaatatatcctgagcaaaacgaaatagaaaacacaagaaggtgaaatgtaacattaaagtcaggtccaacaaatgagaaattagtgtgaaagagctcacaatatctggttaaaaaattcaaagataaaagaaaacttttctgaaatgaagaaaacattgaatctaatggttaaagggcttatctttatccagaaaaaatgtgttatagtatgaccacatcaaggcagatgcaactgaatttaccggacttcacaaacacaaaataaacaacccacaaaaaaaaaaaaaaatagagtccccatgaggctttaatgaagacaactattagaggccaggcgcaggggctaacacctacagtcccaacactttgaaaggccaaggcaggagaatcacttgagcccaggagttcaagataagaccagcctgggcaacatagcaagaccccatctctatcagaaaaacttaaaaaagaaaactatccactaaaaatgaatagagataacatgatacaagtgagcattctgaagcctaatatcaaaatgttctggggtttgcggttaaagaacagaatgcaaatgttacaaaccataactgtataaagactaattatattcataacaaaaataagaagagaaagatagtagaaatatattctggtccattcaactttcacagtgggagagaatcaacaaattatgttatgggtgattaaatattattttaaaagataaaggtcattattagaaaaattaaaaataacaaaatcaaataaagttggatgacgaaggtgggagaggaaagtgggtttaaggggtaaagtggaactatattaaaagagtcaatggagagcacccttggaaataacacaaaaattaaagaactaaatataatttatacagcacataactaaactataaatcttcaaattaaaagaaaataggtacatacaaaatatcacatacagagaaatattaataccatgaaaatattaaaataaaagcataaaattaattcatttatttaccctattagtattttttgaacacctatgtgccaggtattgtgctgaatgccagtaagatatagttcctgcatcttggagttttcgtggaggagacagagattaatcaaacaatcacacaaatgtaaaattgcaaccataaaaattactctgaaatacaatgaaaattactataagagagggatttgatgtgagtcagagaagtttcccctaagaaagcaacactgaagctgagatctaaagggtaaacagcagttaactgagtggagaacaaaggttttcctgcagggggaacaatctgctccccgaggccagagtggggccttgggagttgtgcctgaaaccacattgtgaggaagtgaggggaagcattgtgcagataatgctgaaataagtagtggaagatgcttcctaagagaatgagaaatccaagactactaagcagaagaatgatttgaccagatttcacatttgtaaatatcactatggttacaatgtatagaatggattttaaggaattcaaattggatacaggtgagtcaattagaaagcaacatgcttgctaaggcaagaaatttgattacttaaactagatatgggagttttggaaataagtagataaatttgtcatatatttgagataataaatcaccatgacttgatggtagacttagttggagatgccctcactaatgcaccatctaatgcttcaagtctaataattattcaattcctccagagccaccaatccaatggttctaccatatttatgctgtcattcactttactgatatccttcttaccttacctcttttcccactttatattccatgatcaataccttgctccctcgtaatgattgtactcactcttccaaacaacaatcctgataaatcctactctctgccttctacatcttgataccacacagctatatgtggctagataaaacaatcacactgacaatcatcctatactttctgaatccatcactcttctactttttcagatcttttctttctccctcatccttaccatgtaatgaactcattttgcatgtcaagggctaaaagttgaatattttaaaagttctcattttcccactactatataaaccaacaaatatctttagtctgcattcacaaataacataacaaatgagctcttcatatttctatccgtggtgaattaagatgactagaaattttgtggcaccatcccgttgaaaacgtggggacatattctttctccttgaacctgggtgggctctttgactgctttgaccaataaaatacagtgaaagtaaaacttccagttttgatgtccagatgttaaaagccttgaagcttccatttctacatcttggaaccaacgtgtgtgggtgctgagtcagtatcgaagaattctgcttattctgcttgcattagtccattttcatgctgctgataaagacatatccaagaccgggtaatttatgaataaaaagagtttcatggaatcacagttccatgtggatggggaggcctcacaatcatggcagaaggtgaaaagtatgcattacatgggagcagacaagagacaatgagagctgagtgaaaggggaagccccttgtaaagtcatcagctctcatgagacttattcacgaccataagaacagtatgggggagccaccccatcattcaattatctctcaccaggtccctccacaacacatgggaattatgggagctacaattcaagatgagatttgggaaaggacacagccaaaccacctcattctgcctctggcacctcccaaatctcatgtcctcacatttcaaaaccaatcatgccttcccaatagtccccaaaagtcttaactcacttcagcattaactcaaaagttggcagtccaaagtctcacctgagacagggcaagtctcttccacatataaacctgtaaaatcaaaagcaatttagttattttctagataagataggagtacaggcattgggtaaatgcagccgttccaaatggtaaaatttacccaaaacaaagggactaaaggctccaaacaagtccgaaatccagtgggacagtcaaatcttaaagctccaaaatgatctcctttgactctatgtctcacatccaggtcatactcatgcaagtggtgggttcccatggtctcaggcagctccacccctgtggttttgcaggggagagccttcctcccggttgctttcacaggctggcattgtatgcagcttttccaggcacacagtgcaagctgtcggtggatctaccattccggggtctggaggacagcagccctcttctcatagctccactaggcagtaccctagtggggactctgtgttgggggcttcaaccccacatttccattccccactgccttagcagaggttctccatgaagacctcacccctgcagcaaacttctgtctggagatccaggcatttccatacattctctgaaatctaggtggaggttcccatacctcgattctggacttccgtgaatccacaggctcaacaccacatggaagctgccaaagcttgaggcttgcaccctctgaagccatggcctgagctgtaccttgaccccttttagctgtggctggagcagctgggacacagagcaccaagtccctaggctgtacacaggcaaacagcagaggggccctgggcccagcctatgaaaccattttttcctcctaggcctctgggtgtgtgatggaaggggctgccacaaagatctctgacatggcctgaagacttagcgattaacatttggctccttgttacttatgcaaatttctgcagccagcttgaatttctcctcagaaaatggatttttcttttctatcacagtgtcatgctacaaattttctgaacgtttatgctctgttttcctgttaaaactgagtgcttttaacacacccaagtcactcttgaatgatttgctgcttagaaatttcttctgccagataccctaactcatctccctcaagttcaaagttccacaaatctctagggcagggacaaaatgctgccagtctctctcgatagcaagagacacctttactccagttcccattgagttcctcatctccatctgagaccatctcagcctggatttcattgtctatatcattatttgacattttagtcaaagccattcaacaagtctctaggaagttccaaactttcccacattttcctgtcgttttctgagccctccaaactgtttcaacccctgcctgttacccagttccaaagtcgcttccacatttttgggttatctttacaacagcaccccactctaccagtaccaatgtactgtattagtctgttttcatgctgctgataaagacatacctgagactgagtgatttatgaagaaaaagacacttaatggactcacatttccaggtggatggggaggcctcacaatcatggtggaaggcaaaaggcacatctctacatgatggcagacaagacagaatgagagctaagtgaaaggggaacccccttataaaatcatcagctcttgtgagacttattcaagaccacgagaacagtatgggggaaatactcctgtgattcagttatctcccgttggatccctcccacaagacacggaaattatgggagctacaattcaagatgagatttgggtggggacacatccaaaccatattgctgctgaatagatcatgtagacaggctctcaaactacacggagagcaagagaggcccaccttaccacaacatttcatccaatccactaataaaacaggcacatcactgaagccaccttcaactctccagactacccagctgccagctgaataccacagatggctacagttaataccacatggagcagaatcatgtagctaagccctgcttgcgctaatacaagtccacaattttttttaagtttgttgttttaagctgctaagttttgaggtggtttgtggtacgtggaataagatgtcactctaatataatataaacttaaactatgtggcattggctttggaatcagacaatggatagaagccagaaggatttcacaaagactgttagtgaaaagtgaacagacttcaaggaaaatgatagcaaaacctgtaaaagcattctgggaactgacagtaaacactgaatggtccttaaggagactgaaaacttgaaagagcttaagaagtctactggaaagggctttaaggataatgagaaaaaatcatcagtggaggctgaggaaaacgcaccaaagtcatattctgatgggagaattagaaaacgcttgcctggaatgatataaaaaataggaaaaataccgaaaaagtttgtggatctggctggggagatttttggtgtcaactaaagaaaaaaattaagcttttaagaaattaaagttagatttatttaggggtctgagaacaagagactgaggattacagcctaggagaagtcttccagagaggttctgtcagactgctctggtgaaggtctttagcccacagtttatatgcaggctgtacatatacaccatggaatactatgccgccattaaaaaatgatatcatgtcttttgctggaacatggatggaccttctattatccttagcaaactaatgcaggaacagaaaaccaaatacagcatactctcagttataagtgggagctaaatgatgagaactcatgaacacaaagaataaaacagacactggggtctacttgagggtggagggtgagaaaaggaagagaagcagaaaagataactattgggtactaggtttaatacctgggtgatgaaatgatctgtacaataaccccctgtgacaccagtctacctatgtaacaaatgcccctaaacttaaaataaaagttaaaaaaaaagaaaattaaaatctccttatcatctacctggtaatatgaaaaacacaaatctttcattcattcctttcaactgatgaggaaaatgaggcatcgggagttagtaaaagtccacattgagatatgagacccaccactggctggacgcagtggctcacacctgtaatcccagcactttgggaggccgatgctggtggatcacctaaggtcaggagttcgggaccaggctggccaacatggtgaaacccccatctctactaaaaatacaaaaattagctgggtgtggtggcaggcacctgtaataccagctactagggaggctgaggcaggagaatcgcttgaacccaggaggtggagtttacagtgagccaaaatcacgccattgcactccagcctgggcaacaagagcaagactctgtcggggaaaaaaaagaaaaaaaaaaaccaccgccatcattttgcaagtgttaccactattgtgtgttaatattgtagaagtattcctaattatgatttctttgtattcctaattgtaatagctttgtatttgaaaaattattgattcatactctatatgttattattttgtatgtgatgacaacagaatatattatcatgctccttttgtgaatctcattcataatataaagtataaatttgtgattttgctttaatttgaaatattaacttcaaatatgttatcacaatttgatacaaactattgacagtaaatctgtggattaagtaatgtcttagtaggtattgggaaaatttgaaactagtaacatggaggactattgtcattgtttatttcaaagccagttaaaattctgcaaagcagtgtacataaaaataatttcaagaaatttataaaataccgagattatggtgtataaacaactttagattctttgtttaagaaattctgccagtttgtaatatatgcttcattcaaagtagctaagggctgtacctggctaatagtaggcacctaatatttgttgaaaaggaatactgagtagctgggacctcctgagtagctgggaccacacacatttaacctgtatttataaaattactgtttagagaataacatttgatggaatcatgcttttactttctgcttacgactcaattgtttgtactgacattaacatcccaaatccttagcatggcctacaaggccctgagcaatgtggcacctgctgaagcctgctgcctcatttaataactctttgtctctttcccagatccagccactctaacattttttagctcctggaccaagacaagctcttcccagaacctgacctttgtacctgttctttattcctggagtatttttcccctgacaaattacttatcatctatcataattcaggttaaatggcactaactcagggaaggcttccctaactgcctcccttctccaaccaaattaggaacaattatatggccacatagtatcgaatcaagtttataattttaaaataattgggagattttgttgtttaacacttgttttcactataagactgtaattacatgcaagtaagaaccatgcctgtttgttcactcctgccacagtcagaatagtgcctggaatatgcagtaagggctgaacaagcactaaataaatgaacaagtgaataaatggatattgtctcatttttagaacagagtactgaatggatcatgaacactatctggtatgtcacgtaggtaatttacaagggctacaatttcagctcagatttaccttttcctggatacaggtcttgataggtctcttgatgtcatttcacttcagattcttctttagaaaacttggacaatagcatttgctgtcttgtccaaattgttactaagaatcaagagagatatctgacatgaaatgacattggaaaacattaaacacgattgaaataatgctagccaatatggttattattagaaaccaattacattttcaacttaaaaatagtaatacttattgcagactcaaatgtgcttattctaaaacaagtaaatgtttgcctatggtctgagattctaatccacggagttcattctaatccacattcaacactatcatgtaccagtgggcctcataacccacctagccctgtgatttttcaggttcacttttctaaacttgtgaattaaatatttattttcttagttcagaagaggaaaaaaactcttgtaattgttgcccatttcaggagaaatcttgcatatgaaaacaagagataaatatacacaactgagggctgtggtttaaacaaaatcttgagaatgttttttgaccttacacatttgtgctttagtataacaaaatgatatagacaaaggtaacttttaatagaaccagtcactaaattaaaaaaatgacaaattcttctgcttagctaagcaacagagaaggtaaaatactaattcaattcatcaatttaagcaatactcattaagagccaagtatgtgctcactgaataagctgctaaggtttggtggttacagagtgtgcggtgaaatgatgtctacatcacagtccaacattcacagagtttaaaagcctaccaagaatcaagacagacacaaatacctaacatagacatttgtatatgataagagagccagagtacaatttaggagaagaaattgtatggaaggaaggttcatttccattagaccagaaaagacagcacatttgaaggcctgaataagaaatattctggataagatattgtggctgctaccagaatggctcttgatgatctctacctcttggtatttatacccttatataatctctttcctatagtgtaagctggtcccaggtacttgtttctattgaatagaatagaacaaaagaaatgagatgccacttctgagattagattataagatactgtgaatttcttcttgtgccctctccctctctctctttctcttgccctctcatttgaatgaagccaactggcatgctgtcagtggcccagtgtaagtcctgttacaagaaattgatgattacctgtagccaaccctaagtgaagaactgaggtcctcagtcctacaaatggagagaaactgaatctagctaagaaccatgtgagtgagctgggaagaagatccaccctcagttgaaatttaagatgacatattgagcagacatactgagacacactgaaagtaagagagcaggaggaaacaaaaccagggtcatacaaagaacacaactgattttgagattctcacataagtattacaccttcagtgagcacgtgtactagaaatttaaaaaataaataaaataaaccttcaaagtgagctagcaaataaatttccctatggtctcagctctgagtggagagagaaaatgttccctgtggagtttatagccagaatccagctctcaaacaggtttcagcctgaactcacacaatctgtgtggcttccaaatttgcaagctgagaatttaattcaaagtggtctcaggttgatagcagtccaaaatgctaggtaggaaaaaaaatcctctctggacaaataaatcatcaaagcaagctcataagagcaggtttcaaaggtcatgagcttctaacacacacacaaaaatcacacacacaaaatgggggtagcagcaacatgggtagcgtattcaaacttgaaaagactttaaatatttgtattattagatgtagattatgaaacacatattttaatgtggttaatttttttaaggaatcaaaactatgagtaaagaccaagaaaattgtgctggatggccacttccaccatggctcccctcctatttaagtctgggtactgtgtcacccgaagtcttcaggcacattgttccaggtctgggtttgcctatgaaagaaactcatgagagctggaaatgaggagtgaagaggaggtcttcaaataaagcaggcttaaggattagacatagcaggtttgacagatgtgatggcttgcagaatcctttatgagctcccactgtccatctggataagatttacagacctttcagaaattcctataagcttgggttctgtgcccacactctagactgtcaggctaagatctctgatataaaacagacctcttctgattttgtctagctgcttttctaatatctattcaccaagctcttccaataatagcataaggccctaattaatattaaacttttatcattataatacataggatgtcttctgttttcctgatcaaattctgactactattaaaatataaagaattgtccagaaatatataaaaaaagaatcacacattgatcttctttaaatgaaaatataacaattgtatggactaggatgattacagttgttcagttctgactgttatttgaagaaaaaagcaataagaagcctcagcaacttaacagaaggagctgccatttactaggagaaaagattgtggatgagagtgtagcaaaggtcagaattctgtgaagcttgagatgtttattataatgaattatcttttatactcactacaatttcctaacaattttggggtttatatttttgaaagagatatacctttaattttctttctttgtactattgttaggtaactttgatgtgcagattatactacagtgaaagttgccaatgacaaggcaaagtcacttacatcagacccaaagcaaagtggagccgggtcatgaaaaaggggatcttgtgtgtctgtccacgataagcactatcacaaggactttctataaactcacaagaaatttctgcccacccagcacactctgtttgtccagctcatcctgtaggtgtctctataataggacctatcataaaaaattcctcaagactgcagcatttcagataagccaccctcacaagaacacttgcctagcaatggctgtttctgccagtaagttaacaccagctcctgcatcagaccctgtgaccaatgatgtttgtttcaaaacagcttgcatggacttctttttgtctttacatattttccttacctcaacctcttgggatgcacctatgattgatcatagcacaaatatctcagattataatccttgtttatttccaaataaatttatttctttggagatccactttttctgttattatacattgacattgttattatgaaattggttgggtgatgtgtcttattttcttgtctccagaagaatttctgtaacagtgcaattaaacgttctttgcatgtttgctagaactcacctgtaaaattgtctgagcaaccaaagcctggtttttgtgtttagtttttcttttgtgattggggaggggggtttatcgtactgattcaaggtgtgaaggtaacatcattttgattttatacatcttcttcagtccatttaagcatgttacatagcgttgtttgttcttttcatgatattctttacagtagtctcctaaatgttccctctgcttctgccatgagcccctacaatctatttcaactcagaagctatagagtttgtttaaaacatgtaacatattatgccacctttcttactgtaaaacatcccatggtttctcgtagtatttatagtaaaagtgaaatttttatgatggcttgagaaacttttcccattagatgcccaagtgctggtctggtctgatcttctcatcttcccttgggtgattctgtggcagtcacactagcctccttgctgctccacaaaaactccagcatgatcctacttcaggatatttgccattgttactgcatctgcctggaaccttttctcccatataaacatagagattgctcttgcctgtccttcaagtctattcttaaatgtcccattctctgtgaagctttcctgcccaccctatttaaattacagacttcactcccaattccccatctactttaagagtcttcatttatcattccttgacaaactgtaaatatacatgttcacttttttatcgtctgtctccaaatactggaatgttaagttctgtaatgtcagatatttctgtttggttcactggtgtattcttaaagcatgttacatactaggtatactcaatgaatatttgttgaataaatatcacattgggcttattccagaaattcaagcttgtttcaatagttagagcaatctacaaatgtaattccttacattaactaattaaaggagctaaatcacatcaccaccacaataatgcagaaaaccacatttgatacaactcaatattcatgtctgcctaacaaacatctcatgatactaggaaaagaggaagggatatattattttcatgtataaagcactaaccattgtagcatgccaatatactcaaaattcaatgaaattcctatcaaaatcttagcattcctcttagccctcaacaaagcatttctaaaatgtgtatagaagaccaaagggccaaaagagtcaacttctgaagaagcgcaaaaagaaagttgaggaaatcttaaaacatgttattgagcttaaagttgcaaaaataaactcatgtgccataattcatgagtagaaaaatagactagtggaataacataaaaataaaaacaatgcttacataaaatgttgtaactgatttggatgtcattagaaatcagtaagtaaatagatggacaatgtaatgaaagatgctaggcaaataatgtggtagggagaataatggccctcaaagatgcccatgcctaaccctggaacctgtgaatatgttacactgaatgcaataaaggcttatcagatgtgattaaggatgcaaaccgagatggagagatcttcctgggttacccagatgggcccagtctaatcacatgagttcttaaaaatggagaacctttcttagctgagtccagagagagatgtgacaatgaaagaatggtcagagaaatgtgacattgccagctttaaaaagagagaggagaggcaatgagaaaaggaatgctgatgttctctagaagatagaaaaggccaggatatggattctaccctagccaccataaagaaacatgcctgtcgacaacttgattttagttcactaaaattcatgcctgatttctgacttgtgtacactgtaagatgacaagtttgtgttattttaggtcacttagtttgcagaaatttgttacagcagtaatagaacaagtggttatccatatgaggcaaattagattggatacctatctccaatagaaatcaattcaaggtgaattccaggaaaatacttaaaacatttagattaaaaataaatgagaatttttgttacttttggtaggtcatagaaccaagaaaaacaaacattaaggaggaaaaatgaacatatgactacatcaaaatataaagcttctctatttggaagatatcataaggtgacaaatcataaactgtaatatttacaacatatatataagtgaataaatatacatttagaatatatatgaactcccaaaaatcaacaggaaaaataagacatagaacaagcaaaatgcataaacaaaagaaggcaaaacaaaaataatgactcataattatatgaaaagaagctcatcttcatagatgagcagataaatgcaaattaaaaccaccctgagatgctttttacatccatgagcctgataaaagttagagtctaaaagtaataattaacaaagatgggaagtaacagaaaatcttgtccattactggttaaagtataaactgatacagctactttatagaatattacattatagaataaagttgtgagtatgtatatgcagtgactcagcatattcattgctagtatgtactcaagagaaacttacaggagtggactaggaagtaaatacaaaatgattacaacattgtttgttatatcaaaaaataaaaaagacacccaattttccagcaaaaaaaataagtaaaaataaatcctggtgtattctaacaatggaataatatatagccattaaaataaatcaactattactgtacatatgaatgtaagtatcagcaaaacatattgtttagtgaaaaactaagaagctgaagaagaatatatacaatatggttacatttatatgaagtcccaaaacttgcaaaataaagaaatgtatttagaaatagattcacatgtgagaaaactagaagaaaattaatgaaaggataagagggatagcagtaattctgagtagttgagggaatttcaattggaaaaaaataatatcatattctttaagtcaggtagtgggtattagcatttgttttaccatcgttctttattcttatagctacactatatattttcaatgtatttaatatattttttgcataattaaatattatgcaataaaaatgagaaaacaaaaaagtagaaaatgataaattacaataaagaaatggagaaaaaattataatctagttgagtaatggtatattacatagctattttcttaagtagatgtatgtacatgatgtatgcacgattgtacatacatgttcttaattatatataaatatatatgtacatatttttaatataaaatactaaacaaagtacaccaaaatattagctcctatgttagtgagataatgttttgtttttttgtattttaagttttacatagtaggtgtatttttctgttttcatactgctataaagaactgcccaagactgggtaatttataaaggaaagaagtttaattggctcacagttcagcacagcttgggaggcctcaggaaatctacaatcatggcggaagacaaagaggaagcaagccagcttcttcgcaaggcagcatgaagaagtgccgagcaaaggggaaagaatcccttataaaaccatcaaatctcgtgagaactcactatcacaagaacagcacaggggaaactgcccccatgattcaattacctccacctggtctctcccttgacctgtggggattatgggggctatggggattacaattcaagacgagattcaggtggggatacaaagcctaaccatatcagtaggcatgtattgaattttaaactcagagaaaaatactagtgtttttataggattcttactaaagaaaaaccagaaagtaataaaccatctacgctaagacataaaattcagttgtttagttacaagatagaatgtggccttgtaagaaagcaaattaacttctaacatacaaagccttagagaagattcaagtgactgacggatcttaaacagagctattattacaacttgaactgcagtaaaatatcctcagcaacatagatgtgtatgtttcactagtcagagcaatacaaatttaacgaaactccattggtggtgtttttaatcagacaatttctgaagatgtcctggcttattcacagatgcaagccaaatctctagaagagtaccataataagaaaaaaaagaatacaggcaattgagagctgttccaaagtttagggagtttttgtaaggaattaataaataaaaatgttcttgaaagagagaaattaatatgcagttcatactgccagaattgcaggcaatttatcaaagtcccctaatcctccaaaatcgctatttttttttttgacacacactttacagtacagaagaaaatgtctccggcaataaatcacaaagttaaaattacctagtctacaattaactacacagtgatggtaaatcattttctaccaaaagaaagaaatgtcttgtctattcaggttctgctctacttaaaagttttccttgttggcgagcaagtggttagaaaatcatattttatacgtacattcagcttaactatcattcagctcaggaagatgactcagggccttatccataccttcaagtttgctcttagcaagtaattgtttcagtatctatatcaaaaatggcttaagcctgcaacatgtttctgaatgattaacaaggtgatagtcagttcttcattgaatcctggatgctttatttttcttaataagaggaattcatatggatcagctagaaaaaaattaagaggaaaatcacatggaaagttatatattatatatctattatatataatattatatatctattatatattatatattgtatatctattacatatatattatatatgtattatatatattatatatctattatatatataatattatatattatatatcatttccaaattccccagcgttcatatttgtcagtgcaagtaaagagccttactgctgatgaggtttgaggtatgaccatttggccagaatttatgaactctacatgtcgcttgatgtgtgcctcagggtatactttttttttttttttgagacggagtcttgctctgtcgcccaggctggagtgcagcggtgcgatctcagctcaccgcaagctccgtctcccgggttcatgccattctcctgcctgagcctcctgagtagctgggactacaggcgcccgccactatgccctgctaattttttgtatttttagtacagacggggtttcaccgtgttagccaggatggtctcgatctcctgacctcgtgatccacccgcctcggcctcccaaagtgctggaattacaggtgtgagccaccacgcccggccagggtacacttttaagcagagacactactttgaaggtcataaaaaatataataagagataaggctaatttcctttaataataataaaatcctttaataaaaatataaaggaataatataataattttatttaataaaatataataagagataaggctaatttcctttaataaaatatagtaactacataccaacagaattccaaaaaaagaaatggagaggaagggagcatgggtcattaatcttgtcaaaaatataaaattatatacgaggaattcctagaaactgttttccttgtctgcggccattgtgctgctgctacacaactaccgcaagcagcccttcacgccctcctcccagtacaaagctaattgacttgtgagaaatgttaagcttggaagagtcagcatcgctgcacttattttttattctactctgacattagaataatccttgagtgggggaaaggttaaaaacccccctggataagtgttactaattaatgatgattgttttaaacaatgtttggataatttttccttgtcccttgacataaacttgataaataactgagaagtgagaaggagattagtgggttgattaaattccattcaggtacttaaagttagctccaaaaatttagctatttgtaaattgtcatgcattgttaatgtataagagatgtagatttcatttatctttggtggagcgagatgaagcagtgaatcattgaagactgaaagaaagaaaaaggtcttttcccttttctttaagaagcatcattagttaaaaacatgttagttgataccagagaactatatttaaagggacagcaataagcaaattgattactctggtgattattggagtgacattgccttttagttgtactttcacaaaaattcacaatatttgccaaagtcaagttatccattacactattaatttgtcattcttttgtttatatagtcaatctctatctcaattggatctatctcaactgcttctaaacaagccaccatagtctctcccatttcaacaatctcttccaagtaccacttcatttcttcttttcatatttttgaaaacttttgaaaaactacctattttcctcctccatttcttgttcattccattctagtggacatggaatctgttcctcctccaaaacggaatttggtaacccttaaattactaaacccaaaacaacatgttgtctttatctttacctctctgtggcatttaatgataagaccactactttcttctcttttacccttctttcttgaattcagtcaaacaacgtacttacatttttcgtcttattctccatcttagaaaccacctcagctttctccattcagctataaaattgtgcttttcctcaaagattaatctgcctctcctctcactctatactatctctgttagctaattttatttgtgcacattgcttatactgggcattatatacacatatgcatgtgtgtacatgtgcatacacacactgtatgtggacatgtatatatatatatgtgtgtgtgtatatatatagtatatatataaattacaataacataaaggtggcattttaaattagtggaaattaccctgatttgatcactacacattctatacatgtaaagaaaatatcactctgtatcccaagaatatgtacaattatggtttgtcaaatgaaaaagttcatacattgaaaaattttagataaatatcaaactttctctgaaactgtaactgtaaaatgtaaaaaacagtaattgctatattgcttatttctgagtagaagaatatgagacatttccctaatcattatgtgtaattacaattacatagaagaatatgagacatttccctaatcattatgtgtaattacaattacatatatatatgtaattgtaattacacataatgattagggaaatgtctcatattctatatatatagacagaaagagagaaaatatatgagggagagaaggaatctttccatctcctttgagttccacggtgttgagagtcaggacaactgcaattgcttcatcatgcctgcttgcaattatagggcttttgaaccatttgttccctccttagatatcctcatttttttcagattcttgcttagaagtcactcctccgtggacctcctctgacatattaaacattgcagtccattataagctgcaagaggacagggatttttgcctgttttattccctactgtatcaccaggggctacagcaatatctgacaaacagtgggcatgtaatgaatatatgttaagtgaagtaataaattcaatcaaatcacatcacctgtttaaagcacttcattggcttcacattgcacttagaataaagagaaattctttttatacaatataagttcctgcagaatgcagacactttctacttctccagcctcttttcgactcctctcctactagcttctgtatttaagccacattagacctttcttcagttttttatatagactttgtcgcatcacacctcagagattctgtacatgttcttcctcctgcctagaaaggatcgtccctccactttcgccaactaatccctgctcaacttttcatctcagcaggaggcccattctctttggcaatcctctggcctccagcccatttattatatgctcacatgtcaacatgtacttcgtacagcatgtaacacaattgcacttttatattttaacaaattatatttcccatattgaactgtaagtctcctgaaagcaggaattttgttcttgctcatcatcaactttttcaacatccagtgcaccatttagaacttagatgtagtcaatacaggtttgtggaatgaaagaggaaaagaaagaattaatattcctttaaattaggatggcaaagatcgtatatagaaaattggctaagttgtggtccattcatgtttgctcccaattaaggagcacagctatgaaaaggaaggcttcaaattaataaccaatagatttttttaaaaagaaaactggccaggtactgtggcttatgtctgtaatatcagcatgttgggaggccaaggcaggattacttgagcccagaaattccagaccagcctgagaatttggcaaaactctgtctctacaaaaaatacaaaaattagccaagtttggtggcatgtgcctgtagtaccagctacttgggaggctgaggtggaagaatagcttgagtctgggaggtcaaggctgcaatgagctgtgattgcaccactgcactcaagcctgggtggtagagtaagaccctgtctcaaaaaaaaaaagaaaaatcactaagcaaaataagacatgtgaaggatcatgtcaaaggtaagaaaaattaggggaacattaaaagctttcttcccaagccactaaatcaacttgactaacaaaattaccacttgatttagcattagaaaattacattacatatcaaacataaacccattaatcaaatactaaagaaatttctgagttaaatggtataatgttagcttatgccagagctgaccttgaaagattgttcaaatatggctcagtgtgattgaaagttctgtgtgaatatgtttttggaaagatccaacagcaacaccttagtgtatgtttttgaaataaaatgtatctgagtagcagcaaagttattctcaaatttccattttatagctggagatgtcataccgtgacgtatatgataggacccaatatggatcaatcccttttagaagtcaatcaggaagaggggagcagttaaaacagttgcttggtttacaaacattagaacaattttcttattcacaccatctgattattgtattttattttttccccaacgtttagactacacaatgagttaagaatgataaaaataagctcaccaatatactatgtacatatttaccaaaatctgtgcatgcttatacatataaacacagctgataatttattagttaggctcatttgtaatttttgtcactatagaccagttttttatttaaattgaagattagtatacattttaaatgattagtcaaaataaaaaatctaaaatgtgctctaaatacctcttaggtcagaaaaaaaaagtcaaaagctagagtatagagaaattaagaaacgccctaaatttctaatctgacaaaaattcatacaagatttaaatattttaatggaaaatagaacagaactaattattgaagaaattatagaaaggaaacaaaataaacagattatatggaggatttttagaagataagtaaataaattaatatactaggaaaaaacaagggaaatatacttgataaataaatacaggtaagagttcttttgaaataatgataaaatagaaaatctctgtcaaaactaaaaggaaagatgcataaatatataaataaatgataaaaaatgttgcatacatatatgactttttcagaatcaaaaaatttaaatttctgtaataaaatttaaatgtttataaatttaaaaaactagaagaaagaatgttgactgttcacaatacaaataaatgacaaatatttgaggtgatggatatgctaattatccttatttgatcattgggcattgtatacatgtatcaaaatatcactctgtatcccatgaatatgtacaattatttgtctcaaaaacaaacaaaaaaaaagataatgggagaatgttgaaaactcagagagaagagcaactctcacagatagggatccagataacattagcagctgatttctcggcagaaaccttgaaggccagcaggcagtggattatatatttaaaataatgaagaaacctgtcaattgagaaatatatagctggaaaacttatccttcaaaaatgaaggagaaattaagacatttccggatttttttttaaaactgaaaaaaatccatttatccctgaatttgacattcaggaagtgttaagtccttcaggttgaaataaatgaactctaggcaataactatgtaagtaaataagcaagctgtatgaatatacaaagctctctggtaaaggtaaatacataaacaaacataaaaacagtcctattgtaattttggtttgtaactctgctttttattttctacataatttaaaaggcaaatgcataaaatgtaattgtaaatctgttagctggtatacaatgaataaagatataatttgtcacatcaataacataaaaagagtagagctatatatatagcagtagaattttggtatgtgattgaacttaagttgaaataaattcaaattaaaatgttataactctaggatgttatatgtaattctcatagtaaccaaaaatgaaatatatatagaatataaacaaaaggaaatgagactagaaacaaaatgtgtcactacaaaaaaatcaactaaagataaaaaagaaataattgagaaaatgattggcaaaaatcagtaactctgacgtattaaaactttccatgctacataaatctgaaaactctatttcacataaaactggagctgaaagaaacaaatatttacctataaagttaaaagttatatagggaacaaacactaattttttttagaaaaaattataaaaagtaaaaatatgccttatactaccgtaatttcatgttttacagctctgggaaaatagaaaataaaatgttctgttagcatgaatccctctgtgcccccaaaaaaccctatggattgcatcattattacctaaaaagtctattctcaaatgcagcagagtgatattttttacaaggtagatattaattttagatatggaataatattgatgatttcaattttataacactgggttaagatgaaagaatgagaagataaaggtccctcagcaatataactcacaaacatgttcagaagcagtaagaagttacattaattatcttttgaaagtcgataatctacatctttaatgtatgcatatagcatagctaatgtactatcgctgggtccatttattcaatgaataattgccgctatgtgtcagacatttttctaggcctaggaatggatacataagtgaacaaagcaaagattctggttcttgtagagtttccattaaaagacaatttagtaaaacttttcttcccccaaattataaaatctgtaagatgatttaacaacatgtgtaaaagtcattgtgggccaggcacggtggctcataccaggtgtggtgactcatagcactctgtcacccaggctggagtgcagtggcacaatctctgctcactgcaacctctgcctcctgggtacaagcgattctcctgcctcagctttctgagtagcaaggactacaggtgcacaccatcacgcctggctaatttttgtactattagtacagacggagtttcaccatgttggccaggctggtctcaaactcctgacctcaaatgatccgcccacctcggcctcccaaagtgctggaattacagatgtgagccacaatgcccggccttattttctacaactttggtaactttagcatataccccaaatctgtaagacataatattataattcaaatgcaactcatggcttctctttgtactctttctctagcttttgaattatttattctaataccagttttaattctgacacaaaatcatgggagttctaatcaaaatccaaccttttatcataaaaactatgaagaaattatgagtagaatttaaaaaggaaaataggcctattaattagatttgtctttgtagcatttaactctataataaataatattttatgcctatgagtccccaacaaagcctccagcttctatttagatacaaactgtaaaagtcactactggatccacaagcaagactatggtaaataaatttctccacctaaccagcttcttttacatgatgttacatgtttcttttgttttttcattttggcaaatattgattgtcatcttcgtgtttgtctatgtcctaagtgctgggatacagaatctgaaaagatggacacaggacctgccttcaagttcacccccttttttttttttttttgagatgcagttttgctcttgtcacccaggctggagtgtaatggtgagatctctgctcactgcaacctccacctccagggttcaagtgattctcctgcctcagcctcccaagtagctgggattacaggtcccagccaccacgcctagctaatttttgtatttttagtagagacagcgtttcatcatgttggtcaggctggtctcgaactcctaacctcaggtagtcgacccacctcggcctcccacagtgctgagattacaggcatgagccaccacgccctgctaggagttcacgctttagttggggaaaatatacaataagcaagccagtttttaaaatgagaactgcaattagagttaaatgctacaaagacaaactcacaggaagatgggatgtagaatgataaggctctcagaatagtaagagaaactattgcttcttacgatgtttgtctttctttgtatcggtgctcagctgagtctgcagtgcttcagaggcagctttcattttataaaaatctatgatttctccttccagttgttttttctcttcctcgagcttccttatctcctcctgttgaatcattttaagatgctcgaacttgtcctgcagctgtgaaaccaatgtgcagttgtgacaccaaagcagtgtggctgaacacctaaaagaatacgctttttttctgattatcaaacaaacccaaatcatcacagtagagcacgatcttaataacaatctcaaaaactcaggagtaaacactcagatatggaatttttcttttctttcttttttccttttataagatggagtctcactctgttgcccaggctggagtgcactggtgcgatctcagctcactgcaacctccatctcccagttcaagtgattctcctgcctcagcctcttgagtagctgggactataggcatgcaccaccactacaggcgtgtgccaccacacctggctaatttttgtatttttagtagagatggggttttgccatgatggccaggctggtctcgaactcctgacctcaggtgatcctcccgctttggcctcccaaagacttttttttttttttttaatatagagacaagttctcagtacgttgcccaggctggtctcaaactcctgagctcaagtgatcctcccacctcagcttcccaaagtgctgggactgactggatgcagtggctcatgcttgtaaactcagcactttgggaggccaaggtgggaggatcgcttgagcccaggagttcaagaccagactgggtgatataacacaatagtcaacttcaacaggagagagaatctgtaaacttgaatatagatcttccgaaattatccagtcagaggacagagaaaaaaagaataaaagagagaaaagaaggctgggtgtggtggctcaagcctgtaatcccaacactttgggaggccgaggcaggcagattaagaggtcaggagttcaagaccagcctgtccaacatgacaaagccccatctctactaaaaatacaaaaattagccgggtgtggtggcacacacctgtagtcccagctacttaggaggctgaggcaggagaatcgcttgaacccaggaggcggaggttggagtgcaatgtgagccgagaccacacattacactccagcctgggtgacagagcatgactctgtctcaaaaagaaaaaaaaaagagacagagaaaagaaagccaacaagacaccattaagcaaaccattgtcaggttatgggagtttgagaaggaaagtagagaaaggagaataaagcttatttaaagaatggctgacaactgcctaaatcatgggaaagatttagacatctaaatccatgaagcttaaagattcctaaagaggttcaaaccaaatagatactcaccaagtcacaatataatcaaatagtcaaaagttaaagaaactttgcaggtcaggacagaatcgaataatacattcaaagtgctgaaagaaaaaaactgccagcaactaatactatgtctgacaaagctgtccttcagaaaggaaaaagaaataacgtgtttcctcgacaaacaaagctgagggcattcaggaccactaggtctaccttaaaaaaatgcttaacggagtttttcaagtaaaaatgaatgaagttgggagcggtagctcatgcctgtaatcccattttgggaggctgaggtgggtggatcacctgaggtcgggaggtcaagaccagcctggccaacatggcaaaaccccacctccagtaaaaatacaaaaaattagccaggtatgaaggccactgagatcgtgccactgcactccagcctgggtgacaagagtcaaactacatttcaaaaacaaaaaacaaaacaaacaaaaaaaacaaaacttgaggcctggccttctgctcctctccaacctccccttctctgggcccaagccaccttggctgaggagggggcgaggaggtgtgagcccctgccaggaaccccctgcccggaccaagtgctcggcccccaggcctgcgttcagtgaggcctcccgtggcgtcagcatgttcgtgtggaggaatgtggaaggtcactcttcggccgtgttctcctggtactccatccccttcctgacccctccctgcagccacacgaggcccagcaacctgccagtcactcagagtctctggcctccaaccagagaaaacaacctgccaagttggcagccgttgctcatgagcgtccaccaagtgggacagggagtgttgaccctgggcggccccctggagccacctgccctgaaagcccagggcccgcaaccccacacactttgggggtggtggaacctggtaaaagctcacctcccaccatggaggaggagccctgggcccctcaggggagtccctgctggacagtgagacagagaatgaccatgatgatgctttcctctccatcatgtctcctgacacccagttgcctctaccactcagatgatgtcaggcccagtccctcagtgccctgcgcaaggaaaaggactcatcttctgagaaggatggacgcagccccaacaaatcagacaaggaccacatccggtggcccatgagtggcgctcatgatcttcagcaggcggcaccaggccctggcggggcgcaccagggtcaccccaaccaggataaccggaccgtcagccagatgctgagcgagcggtggtacaccctggggcccaatgagatgcagaaatacaacctggccttccaggtgaaggtggcccacttgcaacaaggaccgaaagaagtccagctcagaggccaagcccacaagccaggggctagcaggagtgtaacaagggctcgtgggagcggagcatatcagagacgggcactgccactgcccctggggtgtcctctgaactcctgtcagttgcagcccaaacactccagagctcggataccaaggagcagcttctatggggcagaacggctgcacacagtcagggaacctggctcagcctggcccaagccttctcccacagcggggtacacagcctggacggcagggaaatagaccgtcaggcactacgggaactgacacaggtggtgtctggcactgcatcatactctggcccaaagccttctactcagcatggagctccaggccactttgcagcccctggtgagggaggtgacccgtgggcagccctgctgccgcccacgtgagctgctcattcccagcacatggccagcgaggtcatagcgagtgacgaggagcacacggtcatccatgaggaggagggggtgatgatgtcattgctgatgatggctttagcaccaccgacaccgatctcaagttcaaggagtgggtgaccgactgagagtggggacaactctggggaggagccagagggcaacaagggctttggtgggaaggtatttgcacctgtcattccttcctcctttactcctgccgccccttgctggatcctgagcccccagggtcccccgatccacctgcagcttttggcagtctatggtcacaccctgtcctcctcctacacatactcggatgcttcctcctcaaccttggcacccacctccttcttactgggcccaggagccttcaaagcccaggagtctggtcaacgcagcagagcgggccccctacggccccaacccctggggatgggggcccagggacgccttccaaggtggcctgtttcctcccaatggatcctgccaccttctggtgcaagagacctgaaagtgtgggtgacctggagctaccaggctcctcagtcatcagggtccctcccaacactaaggctttcctaggcaggagctgggctgagccacccggggggcagagcctgaagagaaactgactgggctttcggggtcggggcagagggaaccccacggacatggatcccacactggaggaccccaccgcgcccaaatgcaagatgagaagatgctccagctgcagtccaaagcccaacacccccaagtgtgccatgtgtgatggggacagcttcccctttgcctgtacaggtggagaagccgaggacaggctcagggaaccggagaccgagaaggcgctgtcctcttcactgcacgtaccctggaccagtgccggccctgatcatgcagctcttccaggcccactgcttcttcctgtccactaggccacagccgccctccaggcccactatgcacacatcttcccctccaaggtttgttctgcccctgccctgactcccagccctgtgggggtcctgaccgcacctcacctggctcagactcttgacgctgccctggctgccccaccactgcttctgcccgagagtcacgtgaggctgagagtaggggcaggggcagcagtggtgccagttggggggcggtccagtgggaggagcctcagcctcgcaggctgctccgtgggactgatgactgcatgatcttctgggcacctcacggatcttcaactgcaggtgaaacggatgctggtggtgggtgcagggccgctgggagctgctgcatggttcccagaggctggactgaggcaggtgccaactgaagctgctggggcagcatgggcaggatgttctgcacacaaaccttggagaagaagatgtgtgcatagcaggtccactgctgctgcccctgccctgactcccagccctgcctgaccccacctcaacctgctcaggctctggcacaaccctggctgccctgccactgcctctgccccagagttggggccttgacagcctggttggaaggggacaccccagccctgcctcaacacctgggggtctccataactaccacaggcaggtgggcaaccccaaagatcccaggactcacagtaccccctgagaacatggacagtatgtgggggtagcaatggagggcaggatggttatcttctcccaggtgaagccatttaatcctttcagtttgggacggagtaaggccttcctctttttttttttttttttttttttttttttgagaccgagtcttgctctgtcgcccaggctggagtgcagtggtgcgatcttggctcactgcaacctcttcccgccgggttcacgccattctcctgcctcagccttccgggtagctaggattacaggtggacgctaccacgtccggctaatttttgtatttttagtacagacggggcttcatcatcttggccaggctgatttcgatctcctgacatcgtgatctgcctgcctccccctcccaaagtgctgggattacaggcgtgagccaccacgcctggccaaggcctgctcctcttatctataccccctacccctgcagctgtgccgggggaaagctgggcagtttccctcctccgagcccctgtacataccatgaattgtgggaccttcagagcttttcacttttcggaaaatagctcctgctggggctacaagatggagtgtgaagagggccttgggccacagggaggcgcctgtggactagggggagttcatgcaccccttctttccccagaggggctggactcaggtgagtatgggggtgggggctcctgcacttcgacacaggcagcgggagggttttctccccattccctctgcactcccaacttgagctatactttttaagaaagtgattcaccctgcctttgcccccttccccagaacagaacacgttgatcgtgggcgatatttttcattgtgccaaaaagttgccatgaccgtcattaaacctgtttaacaccaaataataaggaaaataaaataaaaaattcgggcttggcgcagaaactcactccaaataaattacctatcaaaatatttacataatggtggaaatattccaaaattcaatattttgggatttatacacaaaagataaacaaattagaggccaagaggctgccggaagggaaaaacggggcctggaatggccgacgtgaggaatgagctgggcctaaagaggccactggcaggcaggagctggacctgccgaagtggccgaaaggcaggagctttggactggggaggccgcagtgaggcgagagctagctgggcgtggagagtctgctgtgaggccgaggccgaggccgggcccgtgcaggccttcgagaggcaggaggccgggcctgcaaaggccgactggagatcaagttctgcgcctgaagaggctgccaaaagtcaaaagcggggcctgggaaggccgccgagagccatgagctgggctgggccgaaagaggccactgggaggcaggaggagctgggcctggagaggctgactcgaggaagttttgcacctggagaggccgtcgagaggacggagctgggcccagggaggccgacttgctgctcttccaggcccacttccaggccgacttgaggacgacttgggcctgcagaggccgccgggaggctggagctaagcctggagagactgacttcgggacgatttgggcctgcagaggccgccgggaggcccaagctgggcctagaggagcccaccgaccggaggccatttggggcctgcagatgtcatcggagggccaggagctgagcctggagaggccaccgcgaggcctgagctgggcctggggagcttggcttagggaagttgtgggcctaccagggccgctgggagctgggcaggagctgagtccaaagacgttgttgggacctggagtcgggccagagtccggcctggagatgcagccgggaggaagagctgggcccggagggggcgccgggaggctgcaagtgggtctgagaggccaacttgaggaggcctggcctctgcctcccgcattgcccagctgttcctcctggctgcatctcccacctcccagcaaacaagctcttttggctcagctcccgcctgcgtttgtagaccccgaagtttctgcaaccaagctcttcagacccacatcccttctcccagtgactgaacagtcccagctccggctggagaagggcgtctgcagaccccgctgttgcctcccaggggagtctccaggcccagctctcgccccaccgcgacctcccaggcccaagtccctgcctacctcccagcagcccgagtgcgatcctgttcctccctcacggtggcctgttgaggcaggggatcacgctgacctctgtccgcgtgggaggggccggtgtgaggcaagggctcacattgacctctctcagcgtgggaggggccggtgtgagacaaggggctcacgctgacctctgtccgcgtgggaggggccggtgtgaggcaagggctcacactgacctctctcagcgtgggaggagccagtgtgaggcaggggctcacgcctctgggcagggtgccagaggcatgagttgggcatcaacaggccaccgtgagggaggagctgggccgcacgcgggctgctgggaggcaggcagggacttggccccgggaggccgccgtgggggcaagagctgggcctggagaggcccctgggaggcaagggaggggcctgcagaggctgttctccaaccagtgctagaactgtacaggccaccaggaggcaggaggtgggccctcagagcttggctggagaaagttcggggcctacaaaggcggttgggagctgggcaggagttgagccaaaagagcttgcttacttgctgggaggcagggccgggagagcctgacttcaggacaacttgggcctgcggcggtcgccgggaggcccaaccttggcgtggaggagcccaccgaccggagaccatttggggcctggagatgccatcggagggcaggagctcatcctggagaggccaccgtgaggcctgacctgggcctggggagcttggcttgaggaagctgtgggccgaccaaggccgccaggagatgggtaggcactgagtccaaagaggttgttgagaggcaggaatcgggcctggagacccaaccaggaagaagagctgggcccggagagaacgcccggagggtgcaagtgggtctggagaggccgacttgaggaggttctgggcccggagaggccgccggaagggaaaaactgggcctggaaaggctgttgtcaggaatgagccccatgggcctgaagaggccactggcaggcgggagctgggcctgccgaagcggccgagaggcaggagctttggactcgggaggccgcagtgaagcaacagctagctgggcgtggagagtccgctgtgaggcagaggctgggcctgtgcaggccttcgggaggcaggaggctgggccttgtcgaggcctgcagaggccaccgaaagtcaaaagcggggcttgggaaggccgccgggaggcatgagctgggctgggccgaaagaggccactgggaggcaggaggagctgggcctggagaggctgccgaaaggcaggagcttcgcctgaggatgccacagtgagacaccatctgggtctggagggtccactgtgaggcagaggctgacctgtagagtccgacagtagacagaagttgggcaaaagcctgatttgaggaagttttgggcttcaagagtcagccacgaggcaggcactaggcctggaaatggactcacagtcatgagttgggcctaaatgggccactgtgagggaggagctgtgcctgttgaggctgctggcaggcaggcagaaatttggcctggggcagctgccatgaggcaagagctgggcctggaaaaagcccctgggaggcaagagcagggcctgcagaggctgttctcaagtcaaagctgggcctgttgatgccaccgggaagcagaaggtgggcctggagagtttgacttgaggaagttttgggcctacattggccgccatgagctggacaggaactgggccaaaaaaggctgttgtgaggcagcagttgtgcctgtagacccagccaagaggaagaggtgggcctggagaagcccccatgaggcagaggttgggcctgtagacgctgacaggaggcaggagctgggcctggacaggtcaacttgaggagattttgggccttcataggccaccaggaggcagcagttgggactagagagtctgacttgagtaagttttgggcccggagatgacgtcctgggacaggagttgggcgtggagaggccaccgtgaggcataagctggatgtagagaggccagtgtgaggcaagacctgggcctgtctaggctgctgggagacaggcaggaatctggccagggaaggttgccatgagacaaaagttgggcctggaaaggcccttgtgaagcatgagcttggcctaaagaggccactgggtggcaggagctaggtgtgtagaagctgctgaaaggttgggagcttggcttggggggtccacagtgaggtagatgctgggcgtgaagaatctgctgtgaggcagactttgggactgtagaggctgacgggaggcagaggctgggcctggaggggccaccaagatgcaggagctgggcctggagaggctgcaaagaagcatgagctgggcctggtgaggtcgacttgagaaagttcagggcctggagagaaggctgggaggcaggagctgggtctaaagaggccattgtaacgatggagctgtgcctgtggaggctgttgtgaggcagtagcctcatctgcggaggctgccgtgacatagggtatgggcctaaataggccattgtgagtcatgagcttggtctgtagaggctgactggagaaagttctgggcctggagaggctgccgggaggtaggagctgggccaaaagatgtaagcacatttgcatttattaggcactttatttccattattacactgtaatatataataaaataattatagaactcaccataatgtagaattagtgggcgtgttaagcttgttttcctgcaactgaatggtcccacctgagcgtgatgggagaaagtgacagatcaataggtattagattctcataaggacagcgcaacctcgatccctcacatgcacggttcacaacagggtgcgttctcctatgagcatctaatgctgctgctcatctgagaaggtggagctcaggtgggaatgtgagcaaaggggagtggctctaaatacagacgaagcttccctcactccctcactcgacaccgctcacctcctgctgtgtggctccttgcggctccatggctcaggggttggggacccctgctcaagtgcatccaaagcgacccttcccacaccagtcttcacagtggtcaagggcagcaaccacttagctcccaaggcatgtgcctcagctggcatttcgtcacaatcaacagtaagtggtagcttgagtcactgtgaggtcacctactggaaatcaccagcaccccatttcccactggcaaagagctcagcactgccccctgggaaaccaaacctatgcccaaatcccatctgtgtgggtctacctcctgggacccttcctaacatattagtcagagtccaatcaggaagcataaaccactcaaaagtttaaagtggtaaaatttaatacagagaattattcattataacaggtgaacagcataatgagagattggctagcacagagtaaagagaactctagagaatatgggactagcccaggccaggcatggtggctcatgcctgaaattccagccattacagaagctaatgcaggaggattgcttaaggccaggagctagagaccggtctggacgacacagtgagaccctgtctctatccaaaagaagaaaaaagttagctgggggtggtggtgcacacttgtagtcccagctactcagaatgctgaagtttgagcctgggaggtcaaggctgcagtgaggcatgattatgccactacagtccagccggatgacagagcaagaccctgtctcaaagaacaaaaccacaacaaccatttacagacagaaaagaaatagagctaataagctgaggaaagatgttgaaatgtgacaagtaaagtaatatgaggtcttttgtctatttaaaataatcaaacaaaaaatggcttacgaaattataataccctgtgctggcaaaggtgcagtgaaatgggcactttcttatactatgaggggtggttaaattgtgtataagccttccagggtaaagcctgtcaattttttaaaataatggagacagggtctcaccatactgccatactgcctcctccaactcttggcctcaagcaatcctcctctcttagcctcccaaagtgctaagattatagctgggaggcacccaaaaccctgtcaatttacatcaagggtaaggagaatgtccattcaccatgactcacagtaatcttacttctggggagacaattcaatctaagcaaaaggtcatctgtacacacacagtaaaaatctgggagtaactgaagacagagttggtaagtgaaataagaaacagttataagaaattaaactatggtatcaataggcacctggtaaaaggtcagttgatgttagctgctacttttttgttgttttgagacagggtctcactctgtcacccaggctggagtgcagaggcctgatcatgactcactgcagtctcagcctccctgggctcaagtgatcctcccacctcagcctcccaagtagctgggactacaggaacatgccaccacactaggctaattcatgtatttttctgtagggatggtgactccccctttgtttccaaggcctatcgcaaactcttggcctcgagccatcctcctgcctcagcctcccaaagtgttgtgattaccagtgtgagccaccacacctggccagctgctacttttatcaatattattcttattccactcaattaaaaattattattttcaaggctatgcaacagtatgtatcctacagcgtaattgtaaaaacatacacagtcgtcatccctcagtatacagaattagttccagccccccatctctgcatataccaaaatccatgcttactcacgtttcgctgtcacccctctagaatccacgtatacgaaaattccaaatgttagttgggcatagtggcaagcacctgtagtctcagccacgtgggaggttgaggtgggaggatcgcttcagcctggaaggttgaggctgcagtcagctgcgatagcactactacactccagccttggacaacagagggagaccctgtctcagaaaaaaaaacaaaataaaacaggttagaaattgtaatgaggtctgctgggcaaaattccatataagcaatgtataaattaataaagcaaatcgtgataaattagtacgattgactttctggagtttctgacaataaaagtaaggaaaatgcagaacacaaagacagagagtaaaaagagaaattaggaaagcattctacatgttgaataggaagacactggccatgttcgtgcagcggcagtatgtcgtgacatgacataccttggagagaagttaacagatgaggaagttgataaaaatcatcagagaagcaaaatactggtagcgacactcaagtaaaccatgaaatttccataacttatgtcagcaaagtgggaatattgtacagtgtgtgttgaagttcctatacaacattgtttatctgccttttgtttgtttgtaaggaatgtacatactaaaagttcttcttgctgtcaaaagaatatgcgtgaataagtcattttaacttattcttctgtttttcttttatcttcctgccatcatcccacagccttactttagaaatttcttttttagaaaattgaacaagtgctccctgtggtggcacatacctcgaggatgggaggcaggggtggaagggtcacttgaggccattagtttgacaccagcctggccaacaaagtgagaccccgtgtctacaaaacaatttaaaaattagccaagtatcgtcatgtatacctacagtcccagctatctgaacttactgagaatgttcagggcctggagagaaggctgggaggcaggagctgggtctaaagaggccattgtaacgatggagctgtgcctgtggaggctgttgtgaggcagtaggctcatctgcggaggctgccgtgacgtagggtatgggcctaaataggccattgtgagtcatgagcttggtctgtagaggctgactggagaaagttctgggcctggagaggctgccgggaggtaggagctgggccaaaagatgtaagcacatttgcatttattaggcactttatttgcattattacactgtaatatataataaaataattatagaactcaccataatgtagaatcagtgggcgtgttaagcttgttttcctgcaactggatggtcccacctgagcgtgatgggagaaagtgacagatcaataggtattagattctcataaggacagcgcaacctagatccctcacatgcacggttcacaacagggtgcgttctcctatgagaatctaacgctgctgctcatctgagaaggtggagctcaggcgggaatgtgagcaaaggggagtggctgtaaatacagacgaagcttccctcactccctcactcgacaccgctcacctcctgctgtgtggctccttgcggctccatggctcaggggttggggacccctgctcaagtgcatccaaagcgacccttcccacaccagtcttcacagtggtcaagggcagcaaccacttagctcccaaggcatgtgcctcagctggcatttcgtcacaatcaacagtaagtggtagcttgagtcactgtgaggtcacctactggaaatcaccagcatcccatttcccactggcaaagagctcagcactgcccccgggaaaccaaacctatgcccaaatcccatctgtgtgggtgtatctcctgggacccttcctaacatattagtcagagtccaatcaggaagcataaaccactcaaaagtttaaagtggtaaaatttaatacagagaattattcattataacaggtgaacagcataatgagagattggctagcacaaagtaaacagaactctagagaatataggactagcccaggccaggcatggtggctcaggcctgaaattccagcaatttgagaagctaatgcaggaggattgcttaaggccaggagctagagaccggtctggacgacacagtgagaccctgtctctatccaaaagaagaaaaaagttagctgggggtggtagtgcacacttgtagtcccagctactcggaatgcggaagtttgagcctgggaggtcaaggctgcagtgaggcatgattatgccactacagtccagcctggtgacagagcaagaccctgtctcaaagaacaaaacaacaacaaccatttacagacagaaaagaaatagagctaataagctgaggaaagatgttgaaatgtgacaagtaaagtaatatgagttcttttgtctatgtaaaataatcaaacaaaaaatgacttactaaattataataccctgtgctggcaaaggtgcagtgaaatgggcaccttcttatactatgaggggtgtttaaattgtgtataagccttcccgggtaaagcctgtcaattttttaaaataatggagacagggtctcaccatactgccatactgcctcctccaactcttggcctcaagcaatcctcctctcttagcctcccaaagtgctaagattatagctgggaggcacccaaaaccctgtcaatttacatcaagggtaaggagaatgtccattcaccatgactcacagtaatcttacttctggggagacaattcaatctaagcaaaaggtcatctgtacacacacagtaaaaatctgggagtaactgaagacagagttggtaagtgaaataagaaacagttataagaaattaaactatggtatcaataggcacctggtaaaaggtcagttgatgttagctgctacttttttgttgttttgagacagggtctcactctgtcacccaggctggagtgcagaggcctgatcatgactcactgcagtctcagcctccctgggctcaagtgatcctcccacctcagcctcccaagtagctgggactacaggaacatgccaccacactaggctaattcatgtatttttctgtagggatggtgactccccctttgtttccaaggcctatcgcaaactcttggcctcaagccatcctcctgcctcagcctcccaaagtgttgcgattaccagtgtgagccaccacacctggccagctgctacttttatcaatattattcttattccactcaattaaaaattattattttcaaggctatgcaacagtatgtatcccacagcataattgtaaaaacatatagtcgtcgtccctcagtatacagaattagttccagccccccatctctgcatataccaaaatccatgcttactcacgtttcgctgtcacccctctggaatccacgtatacgaaaattccaaatgttagttgggcatagtggcaagcacctgtagtctcagccacgtgggaggttgaggtgggaggatcgcttcagcctggaaggttgaggctgcagtcagctgcgatagcactactacactccagccttggacaacagagggagaccctgtctcagaaaaaaaaacaaaataaaacaggttagaaattgtaatgaggtctgctgggcaaaattccatataagcaaagtataaattaataaagcaaatcgtgataaattagtacgattggctttctggagtttctgacaataaaagtaaggaaaatgcagaacacaaagacagagagtaaaaagagaaattaggaaagcattctacatgttgaataggaagacactggccatgttcgtgcagcggcagtatgtcgtgacatgacataccttggagagaagttaacagatgaggaagttgataaaaatcatcagagaagcaaaatactggtagcgacactcaagtaaaccatgaaatttccataacttatgtcagcaaagtgggaatattgtacagtgtgtgttgaagttcctatacaacattgtttatctgccttttgtttgtttgtaaggaatgtacatactaaaagttcttcttgctgtcaaaagaatatgtgtgaataagtcattttaacttattcttctgtttttcttttatcttcctgccatcatcccacagccttactttagaaattttttttttagaaaattgaacaagtgctccctgtggtggcacatgcctcgaggatgggaggcaggggtggaagggtcacttgaggccattagtttgacaccagcctggccaacaaagtgagaccccgtgtctacaaaacaatttaaaaattagccaagtatcatcatgtatacctacagtcccagctacctgaacttactgagaaagttcagagcctggagagaaggctgggaggcaggagctgggtctaaagaggccattgtaacgatggagctgtgcctgtggaggctgttgtgaggcagtaggctcatctgcggaggctgccgtgacgtagggtatgggcctaaataggccattgtgagtcatgagcttggtctgtagaggctgactggagaaagttctcggcctggagaggctgccgggaggtaggagctgggccaaaagatgtaagcacatttgcatttattaggcactttatttccattattacactgtaatatataataaaataatcatagaactcaccataatgtagaatcagtgggcgtgttaagcttgttttcctgcaactggatgttcccacctgagcgtgatgggagaaagtaacagatcaataggtattagattctcataaggacagcgcaaccttgatccctcacatgcacggttcacaacagggtgcgttctcctatgagaatctaacgctgctgctcatctgagaaggtggagctcaggcgggaatgtgagcaaaggggagtggctgtaaatacagacgaagcttccctcactccctcactcgacaccgctcacctcctgctgtgtggctccttgcggctccatggctcaggggttggggacccctgctcaagtgcatccaaagcgacccttcccacaccagtcttcacagtggtcaagggcagcaaccacttagctcccaaggcatgtgcctcagctggcatttcgtcacaatcaacagtaagtggtagcttgagtcactgtgaggtcacctactggaaatcaccagcatcccatttcccactggcaaagagctcagcactgccccctgggaaaccaaacctatgcccaaatcccatctgtgtgggtctacctcctgggacccttcctaacatattagtcagagtccaatcaggaagcataaaccactcaaaagtttaaagtggtaaaatttaatacagagaattattcattataacaggtgaacagcataatgagagattggctagcacaaagtaaacagaactctagagaatatgggactagcccaggccaggcatggtggctcatgcctgaaattccagtaatttcagaagctaatgcaggaggattgcttaaggccaggagctagagaccggtctggacgacacagtgagaccctgtctctatccaaaagaagaaaaaagttagctgggggtggtggtgcacacttgtagtcccagctactcggaatgctgaagtttgagcctgggaggtcaaggctgcagtgaggcatgattatgccactacagtccagcctggtgacagagcaagatcctgtctcaaagaccaaaacagcaacaaccatttacagacagaaaagaaatagagctaataagctgaggaaagatgttgaaatgtgacaagtaaagtaatatgagttcttttgtctatgtaaaataatcaaacaaaaaatgacttactaaattataataccctgtgctggcaaaggtgcagtgaaatgggcactttcttatactatgaggggtggttaaattgtgtataagccttccagggtaaagcctgtcaattttttaaaataatggagacagggtctcaccatactgccatactgcctcctccaactcttggcctcaagcaatcctcctctcttagcctcccaaagtgctaagattatagctgggaggcacccaaaaccctgtcaatttacatcaagggtaaggagaatgtccattcaccatgactcacagtaatcttacttctggggagacaattcagtctaaacaaaaggtcatctgtacacacacagtaaaaatctgggagtaactgaagacagagttggtaagtgaaataagaaacagttataagaaattaaactatggtatcaataggcacctggtacaaaaggtcagttgatgttggctgctacttttttgttgttttgagacagggtctcactctgtcacccaggctggagtgcagaggcctgatcatgactcactgcagtctcagcctccctgggctcaagtgatcctcccacctcagcctcccaagtagctgggactacaggaacatgccaccacactaggctaattcatgtatttttctgtagggatggtgactccccctttgtttccaaggcctatcgcaaactcttggcctcgagccatcctcctgcctcagcctcccaaagtgttgtgattaccagtgtgagccaccacacctggccagctgctacttttatcaatattattcttattccactcaattaaaaattattattttcaaggctatgcaacagtatgtatcctacagcgtaattgtaaaaacatatacagtcgtcgtccctcagtatacagaattagttccagccccccatctctgcatataccaaaatccatgcttactcacgttttgctgtcacccctctggaatccacgtatacgaaaattccaaatattagttgggcatagtggcaagcacctgtagtctcagccacgtgggaggttgaggtgggaggatcgcttcagcctggaaggttgaggctgcagtcagctgcgatagcactactacactccagccttggacaacagagggagaccctgtctcagaaaaaaaaaaataaataaataaaacaggttagaaactgtgatgaggtctgctgggcaaaattccatataagcaaagtataaattaataaagcaaatcgtgataaattagtacgattggctttctggagtttctgacaataaaagtaaggaaaatgcagaacacaaagacagagagtaaaaagagaaattaggaaagcattctacatgttgaataggaagacactggccatgttcgtgcagcggcagtatgtcgtgacatgacataccttggagagaagttaacagatgaggaagttgataaaaatcatcagagaagcaaaatactggtagcgacactcaagtaaaccatgaaatttccataacttatgtcagcaaagtgggaatattgtacagtgtgtgttgaagttcctatacaacattgtttatctgccttttgtttgtttgtaaggaatgtatatactaaaagttcttcttgctgtcaaaagaatatgcgtgaataagtcattttaacttattcttctgtttttcttttatcttcctgccatcatcccacagccttactttagaaattttttttttagaaaattgaacaagtgctccttgtggtggcacatgcctcgaggatgggaggcaggggtggaagggtcacttgaggccattagtttgacaccagcctggccaacaaagtgagaccccgtgtctacaaaacaatttaaaaattagccaagtatcgtcatgtatacctacagtcccagctacctgaacttactgagaatgttcagggcctggagagaaggctgggaggcaggagctgggtctaaagaggccattgtaacgatggagctgtgcctgtggaggctgttgtgaggcagtagcctcatctgcggaggctgccgtgacgtagggtatgggcctaaataggccattgtgagtcatgagcttggtctgtagaggctgactggagaaagttctgggcctggagaggctgccgggaggtaggagctgggccaaaagatgtaagcacatttgcatttattaggcactttatttccattattacactgtgatatataataaaataattatagaactcaccataatgtagaatcagtgggcgtgttaagcttgttttcctgcaactggatgttcccacctgagcgtgatgggagaaagtgacagatcaataggtattagactctcataaggacagcgcaacctagatccctcacatgcacggttcacaacagggtgcgttctcctatgagaatctaacgctgctgctcatctgagaaggtggagctcaggtgggaatgtgagcaaaggggagtggctgtaaatacagacgaagcttccctcactccctcactcgacaccgctcacctcctgctgtgtggctccttgcggctccatggctcaggggttggggacccctgctcaagtgcatccaaaacgacccttcccacaccagtcttcacagtggtcaagggcagcaaccacttagctcccaaggcatgtgcctcagctggcatttcgtcacaatcaacagtaagtggtagcttgagtcactgtgaggtcacctactggaaatcaccagcatcccatttcccactggcaaagagctcagcactgccccctgggaaaccaaacctatgcccaaatcccatctgtgtgggtctacctcctgggacccttcctaacatataaccttcataacaaacttgagaggctgaggtgagacaatcgatttagcccaggagtttgagatcagcctggacgacgtaactaaatctcatctctacaaggaagaggtgggaggatcacttgagcccaggaatttgtggccagcctgggcaacaaaagaagaccccatctggccaacatggccaacctggccaccacggtgaaactctgactctacaaaaatgatctgggcatgggtgacatgcatgtgtagtcctagctacttgggaggttgagatgggaggattgcttgatctcagaaggccaaagctatagtgagctatgatcacatcactgcactccagcctggatggcacagggagattctgtctcaaaaaaaagaaaagaaatatatatttaatctctgtccctggttcctggcacagagcttctaaagctcttacaaagacctcagtgatagatgtgacaggagcatcttttgttttaatatttgatcttggtcccaggtttctaacacaagagcctctaagaactttgggatctccagcatggtaagaatgcatttggggatgttgttgagatgactgggtgactgcaagctcctaaatttcttcaagaggagggctgattaccatgcaaccacatggtaagaggcttggaactttcagcctcatgcactgaactccagggggaagaggggctggagactgacttaatcaccaacagccaaaggttttatcaatcatgcttgcataataaagcctccataaacaccctgaaaggggtttgcagagctttcagggttgctggacacaggagatgctgggagggtcgcatgttcaacagagggcatgggagctctgtgcccctccgaacttaacttgccctgggtatctttcttttttttgagacaggatcaggctcttttgtccaagctggagtgcagtggcacaatctcagcttactgtaacctaagcctccccagtccccagctcaaggtatcctctcatctcagcttccctagtagttggaactctaggtgcacaacaccacaccagttattattattattttttaattttttatagagacaggttttcaccatgttgcccaggctggtctcaaactcctgagtttaagcgatcctcccaccttggcctcccaaagtgctgagattacaggcatgagccactgcatccagcatgcacgtctctttcattgactgtttctgagatgtatccttcacaatgaaccagtaataggaaatgaactggccagatgtggtggctcacatctgtaatcccagcactttcagaggctgaggtgggaggatcacttgagaccaggaatttgtggccagcctggccaacacaacaagaccccatctatacaaaaaataaaagaaactagccagatgtggtggtgcaggcatgtagtctcagctactagggaggctgaggtgggagaaccactggaacccagacaatcaaggctgcaatgagctatgactgcaccattgcacaccagcctgggcaacaaaataagaccctctctctcagaaaaaaagaaaataaactgtttttctgagttccgtaaactgttctagcaaattattaaacccaagaagacagttacgggaacccccgattggtaacaggttggtcaaaagtatggtgacaacttaggacttgccattgtcatctgaagtgaggatggcctcgtgggactgagcccctaacttgtggggtctgtgctaactccaggtagtgtcagaataaagtcatgggatacccagttaatatccagagcactgaagaatctggtgtagaaactccatacatacattcagtcggaagtgtgtgagtagagacaaacatgggcttttctgtcacctacctgcttaactgcataggagaggcaatatgtggtgctcatgaacaaagcaaacattaaagtcagaccagacccaacatttgactcagtcttaatatccaggtgagcctgcgcaaatcattcattattcctaaggttttcatcactccattcataaaatggggataactgtggcacctatatgtgattctgtgagaattaacgaaatattatgcttggggttattgtgatcattatacctgttccaaactatttgacaaggacagtgatggatgaagacatcaaaaaatcagaaactgcaatgaggtctctcaggcaaaattccatacaagcaaattactgtgtctacaaagcattcctgccacacttaattcaccattccctgaacaaaatatgccatcttcgttgttcaggtctgtacagtgctggtttcccttcccgggcagtttgcgctatcccatcccggcccattccccatccctccacctcccccttccctccccactctcatacaactcttcctcatctttcaggacttggcttcaatgtcaccttaactggaagcttctctcactctccagaagagcttcccattgcacctgatgcatgggaaacataatttgatcatttttaagttacagtccaaatctttttgtacctgaataacatgttgcccagtcagtctctcttcctggattcacaagtctttcatggtagatccagctggaagtgacaaaaagacatcttttgacataaagggatgacacagacagacataagttcttaaatgtcttaaatgtcatgtgaaaattaaacagaattcaaagacttgtggggagcacttaggaagttactgggaatgtcatgaagggttaatttgtattttattttattttttgagacagtctcattctgtcacctaggctggagtgcagtggtgcaatcaggctcactgcagccttgaccacctgggctcaagtaatctcacttaatttttatttggtttaagaaagtcttggttgagggtggtggcttatgcctgtaatctcagcactttgggaggctgagagaggtatattacttgaggccaggagtttgagatcagactgggcaatatattaagaccctgcctctaccaaaaaacagagtgaatgtgtggaagacaatttttccacagactgggaatgagggaataatttcaggatgattcaagtgcattacatatattgtgcactttatttctattattactacatagtaatatataatgaaatgattctacaactcactataacgtagactcagtgggatctctgagcttgttttcctgcaactagactgtccacctggggtgatgggagacagtaacagaatatcaggcattagattctcataaggagtacacaacctagatccctcgcatgcacacttcacaacagagtttgtgctcctatgacaacctaatgctgctgctgatctgacaggacatggagctcaggtggtcgtgcaagcgatgggaggggctagaaatacagatgaagtttcccttcactcgcctgctgctcacctccagctctgtggccctgtggttggagaccgctgctcaagtgcatttgaaaggaaccatcccacgccattcttcagagtcatctttactgctgcagtggtcaacttgtagcacccccaagctcgcaggacatatgcttcaactggcatttcacaatcaacagtatgtggcagcttgagtcattgtgagctcacttcctggaaatcaccagcatcccatatcccattgcaaggagctcagcactgctccttggataaccaaacctattcccaaatcccatctgtgtgcgtctatctcctggtacccttcctagcatcaattctgtatttgtaggagtccaatcaggagacacaaaccactcaaaagtttaaactagaatgagcaagatggctcacacctgtaatcccagaactctgggaggccaaggtgggtggactgctttgagctcaggagtttgagaacagtctgggaaacatggtgaaacctcgtctctacaaaaaacacaaaaatcagctgggtgtggtggcacttacctgtaatcccagctactcgggaggctgaggcaggagaattgcttgagcctggcaggtggaggctgcagtgagcagaggttgtgccactgtactccagcctgggtgacagtgtgagacccggtatcaaaaagaaaaaacgtatatatatatatatatgtaaatttaatataaaaagtattaattttggccaggcaaaatggctcatgcctgtaatcccagcactttgggaggccaaggcagacagatcacctgaggtcaggagttcgaaaccagcctgaccagcacagagaaaccccatctctactaaaaatacaaaattagctgggcatggtggcacatgcctgtaatcccaactactcgggaggctgaggcaggagaattgcttgaacccagaaggtggaggttgcgctgagccgagatagcaccattgcactccagcctgggcaacaagagtgaaactccatctcaaaaaaaaaaaaaaaggtattaatttttacagaggatcagcacaatgagggacacactagcacaaagtaaagacaactctagagaatacggaactagcagaggccaggcattgtggctcatgcctgtaatcccagcaatttgggaagcctaggcaggaggatcgcttgaggccaggagttggagaccaatcagtgctaaatagtgagactctgtgtctaccaaaaaaaagagacattagccaggtgtggtggtggtgcacacccgtagttccagctacttgggagtctggggtgggagaaatcccttgagcctgggaagtctacactacagtgagccaagattgtgccactgcactccagcctgggcgacagagtgagaccctgtcttagaaagaaaaaagaaaagaaagtgttaatccccctatgggaatctcctcttctcctgccctctctggaacctcacttgtcagttcttcctcccactttcctgtatctttaacctatcccccacttttagctccttcccatcatcatttaaattactcaaacttcttctgttttaaaaacctctccctaaactcagggagaggtcttctgcacacacattgagccatctgctcttcctggtgccttctctacagcagcctgagccatgtctctaatctatgaatctcatcatgttactcccccatttacatcacttctccttgcctcagggattaagtccaaactccttaacagcccctgctctgccctgccttgcaaggcagcctcactgcttgcccctctccatttcatctgctatggagtccaactgagcctcatctgccccttgaacgcacactctttctcctctgggagtctctgaagtgggtaatatcctctgcttataatatgcttccccttaaacctctactctcttcctagctagctttgactcctctgtcacttgtccgctttggcatcacctcctcatagaagacttctatgactcccgagattctcaggagcatggcaggtgaagtgctcctcccatgaatggatggagattagggagtgtgtgttattcatgcttaattcaccagtgcttagctgagtacctggcataaaatagttactgtggtggccaaagtaataacccccaccgccaccaattgctcatgtcctatgttacacagcacaattacataggaagggggaattaagagtgcagataaaattaatgttgctcatcagctgaccttaaaacaagattatcctggagtatctaggagagcccatgtaattacaagcattctttaaaactggaagagggaggcagaaggttaagaaccagagacggtgggcacaatggctcatgcctgtaataccaatactttgggaggccagggtaggaaaatcccttgagtgcaggagttcaaggtcagccatggcaacatactgaggtcccatctctacaacaaaataaaaacaaaattcactgagtgtcacgatgcttacctgtagtcccagctactgggaaggctgacatggtaggattgcttgagcctgggagtttgaggctataatgagccatgataggaccactgaactccatcctgagtgacagggcaaggtcctgtttctgaagaaaaaaaggacattggaatcaggaccctctccatcctgaggtgcctacaaggcatctctctctgcaaacgagtaaacatcaccctccaactccttacagagtggagcaacaggaaaactccttcacctcatttctgtgctgcttgggaggcctggacagcccaataaccagctcctcgctgatgaagcaatcaggaaatggctcgagttgagctaaggagaatttggatccttcctttggttctcagtaggcagggtagggggccaggcatggtggctcatacctgtaatccttgcactgtggggggccaaggtgagaggattgcttgaggccaggagctcaagaccagcctggacaacatagcaagacctgggtggcatacacctgtggtccctactacttggtaggatgaggtgggaggattgatcacttgatcccaggagtttcaggctgcagtgagccatgatcacaccactgcacttcagcctgggtgacagagccagaccatgtcacaaaaagttagaaaaaaaaaagagggagagagactatacacaggcaccaccacatttggctaatttttaaatattctgtagagacaaggtcttgctaggttgcccaggctagtctaaaactcctggcatcaggctgggcatggtggctcatgcttgtaatcgcagcactttgggaagctaaggcaggcaaatcacctgaagtctggagttcgagaccagcctggccaacacggtgaaactctgactctatcaaaaatacaaaaattagctgggcagtagtggcgtgtacctgtagtctcacctactcgggaggctgaggcaggagaatcacttgaacctgggaggtggaggttgcagtggaccccatcactgcactccaccctgggtgacagagcgagactgtcaaaaacaacaacaacaataacaaaaacaaaaacaacaacaacaaaaaaaactcctggcatcaagacatcttcctgtcttagcctcccaaagccctgggattatactgtttcctataattgaagacacttgttcttatactgctttaaggtataaaggaagaaaaaaaaaacagataatggcaaatgttggtgaaggccgggcatggtggcagcctgtaattccagaacttagggaggctgaggtgggcagatcacttgaggccaggagtatgagaccagcctgggcaacatggtaaaatcccaccactacagaaaaatctaaaaattagccaggcatggtggcgtacacctgtaattttcagctacccaggaggctgagatgagagaatcacttgtgcctgggaggtcacggctgcagtgaactgtgatggcatcattgcactgcggcctgagagacagagcaagcccctatctagaaaaaaaaaatgtcagtgaagatgtggaggaattggaacccacatacattactggtgggaacataaaattgtgtaaccattttgtttgggtatttcttttcttgtcattttaattggatttttaaaaaatcaagacggggtttcactatcttgcccaggctggtcttgaattcacgggctcaagccatcctcctagctgagcctcctgagtagctgggattacaggtgtgagccattgcacccaactggtatagccacgttagaaaacagtctggcagtttctcaaaaggctaaatgtacagtcatcctataatgcaacaatttcactcctaggcatatatcccagaaaaataaaaatatatgtccacacaaaaacttgtacaacaatcttcatagcagcattattcataatgaccaatacatggaatacatggaaacaacccaaatatccaccaactgatgaacagataaacaaaatgcagtgtgtctctaccatggaatactgccatagaaggaatgaaatattgatacacactatgacataaaggaactttgaaaacactgtgctaagagggaagaaaagccacaaaagatcacatattgtacaattctatttgtccagattaggcaaatctatagtgacaaaaaaattaatcaatggttgcctaaggctgggggcaaaggtaggtggggagagtaggaggtagtggctaaggggtatggatttctctatagggtaatgaaaggttctaaaagtgactgtggtgatcgatgcacagctctgtgaatattctaaaacctactgaattgcagatttcaataaataaagtgaatggtatgtgaatattttaataaagctattatttaaaataataataatagggggctgggcacaggtggtcatgcctgcctgtaatcccagcactttgggaggctgaggcaggaggatcacttgaggtcaggagttttgagcccagtcggagcaacatggcaagatctcgtctctatgataaaaaattacctggacatggtggcacatgtctgtagtcccagctacttgggagactgaagtgagagaaccacttgagcccaggagtttgaggctacagtgaaccatgatcatgtcactgtactgtagcctaagcaacagagcaagatgccatctctgaaaaggaaagaaaacaaatgcaagtttttatcactttgtgagtgtagccaagttggaggagaaatagacaataataaaagagcactgaataatgacggtgagtggctggttaggctcagttgctagctaaatggcttctaaaaaattcaataaagttacagctctggggacagtcatgtagtcaaagaatgaaggcgaaattcattacaattgcccatggtctttatttacatgccttctagtgaaaaattcctaagtgcctaaacagcaagtctgcaatgatagcagctgtttattaaagactacaaaaaagaaatggaggccgggcgtggttgttcacatctgtactccttgaattttgggaggctgaggcaggcagattgcctgaggtcaggagctccagaggagcctggccaacatggtgaaatcccatctctactaaaaatacaaaaattagctgggtatggtggcgggcacctgtaatcccagctactcgggaggctgaggcaggagaattgcttgaacccagaaggtgaaggttgcagtgagccaaaatcgcaccattgcactccagcctgggtgacaagagaaagactcttatcttaaaaaaaaaaagaaaaaaaagaaatggcatcttcttcaagaattacatcgtgtttcatgataaagaagctctaattttgcatttgttcaagtattgatgagatttacccaatatgacacccatcttggataaaatgcaaacaacacaatttcattttctcattaacaaaaccgattaagtagtctaatataaattgcgatcttattaaaaactgatcagattaaaaaaattatggaattatggagccaataagatgttacaacctgttccaaggggaattccaaaatccacacatatctgagaccatcaagtatgatgaaatatatttgattactatattgaaaaataaactgattacatagccaacaattggacaggggtctcctcatccacagccacacaaacccgatcatgcagctatgtggttacaaggcctacatagcctagaagggactggtctgacttgagatttcatttgtatttgtattttgagacagggtcccactctgtcacccaggatggagtgcagtggtataatcatagctcactgcaaccttgaccaactgggctcaagagatgctcctgcctcagctgcccccatacctgggaatacaggcaagtaccaccatgtcaggcatttttttcatttttgtagagagagaagacttgctatgttgcccaagctggcctcaaactcctagaatcaagagatctgcccatctcagccacatgagtaactggggccataggtacataccatcatgcctggctatatttattttattttattaaatttattttttttatttttgtagagaggaggtcttgctgtgttgcccaggctgctctcaaactcatggccttaaaacatactcccatctctgcctctcaaactgttggaactataggtgtgagccactgtacctggcctgacttgggatttcttttatctagcatcctttacttggtaggattgggaaaagcagtagtgttttttaaaattacttaataattcaatcagaatcaaactcaaccttgaccactgccttctctcacagctcacatccagtctgtcaggaaatcctactgactgacttcaacatgtatccaggctctaaccatctctcaccaccaccatgaaccccgtcaggatcactatcatctcccaccgggatgttgccacagcttggctcccatgcttctacccaaatcttcccatagtctttctcaactcggcagccaggtcgtgcttttaaatcaggagacggatcatgtcgcctctctgctcagaagccctcggtggttcccattttagtcagagtaaaagccaaagccccagcaatagcgtcccagggcttacacgatctgtaccgatcccagcccagcaactccctggccacctcgctgacttcgctccctctatctctttgctccactggcctccttccagagcctcagacacaccagagagtttcctcctaatgcctttatcctgttgactcagcctacaatgctcttccctcagcaccttggccagctccatcacctgcttcaaacttttgctcaatattcacttatgaggccaaccctgaccactctacttaacactgccatctgtccccattcccaccatgctcatttctttctttctttttgaaacaaggtcttgctttattgcccaggctggagtacactggtgcaatcacagctcacagcaacttcaacctcccaggcttaaacaatcctcccgcctcagccaccctaggaactgagactacagctgcatgccacaacacatggctttttttttttttttttgagatggagtctcggtcgcccaggctgaagtgtaagggtgcgatcttggctcactgcaatgtctgccttttgggttcaagtgattctctgcctcccaagtagctgggattacaggcacccaccaccacacctggctaatgtttgtatttttagtagagatggggtttcaccatcttggctaggctggtcttgaacttctgacctcgtgatccaccctcctcggcctcccaaagtgctgggattacaggcgtgagccactgcgcctggcctttaaaaaaatttttttttagacatgaggtctcattatgttgtccaggctggtcttaagctcctgggcttaagcgatcctcccacctcagcctcctaaagttctgggattacaggcgtgagcaaccgtaacatgaggtcccagcttcatgttcattttttgttgttgctacaacaaagtaccctacatttagtggcatcaaacaccacaaatctaccatcttacagttctgggggccagaagcccaactaggtctattaaggttaaagtcaaggtgtcagagaggctgcattccttctgggggaggctctagaaagaatgtgctcctttgccttttccagcttctagaagccacccccattccttgacttacctcgtgactccatattcaaggccagaagtgcagcatcttcaaatctccctctctgacctcttcttccattaccacatcactttctctaattctgactctcctacctcattctcttataaagatccttgtgattggtgggtatgggggctcccatctgtaatcccaacattttgggaggccaaagaggaaggattgcttgaggccaagagttagagatcagcctggggaaaaaaaggaagatcctgcctttacaaaattaaaatcagctggacatggtgatgcatgcctgtagttccagctactggagaggctaaggtgggaggattgctttagcctaggaggtcaaggctgcagtgagctatgatcacatcactgcactccagcctcagtggcagagtgagactctgtctccgatataagaaaagaaatatacatttggtctctgcccctggttcctggcataaagcttccaaagctcttataaagcccttcgtgacagaggtaataggagcattttctgttttgatatttagtcttagtcccaggttcctgacacaagggcctctaaggtctttcagatctgcagcatggtaagaatgcatgtgggatgctgttgagctaacagggtggctgcaagctccgagactgcttcaggaggagggctagctgccagagaaagcaaccacattttttttttaaaacggagtttggctcttgtagcccaggctggagtgcaatggcacaatctcagctcactacaacctccacctcccgggttcaagcaattctcctgcctcggcctcccgagtagctggaattatagggatgtgccacaacgcctagctaactgttgttatttttagtagaaatggggtttcaccatgttggtcaggctggtctcaaactcttgacctcaagtggtccatgtgcctcagccttccaaactgctaggattacaggagtgagccaccgcacctggccccaaccacattttttgaggcttggaactttcagcctcacctgctgaactccaggaggcaaaaggaactggagattgacttaactaccaatggccaatgattttatcaatcatgcctccataaacacccaaacagcagggtttggagagcttctgtgttgctaaacacaaggaggtcctgggagggtagtgtgcccaacagagggcatggaagctctgtgcccctccccacttaccttgtcctgtgcatctctttcattggctgttcctgagatggagccattacattgagccagtaatagaaaataaggtggccagatgcgctggctcatgcccgtaatcccagcactttgggaggcagaggtgggcggaatcacttgagcctaggaatttgagaccaacctgggcaacataagaagaccccatctatacaaaaaataaaagaaattagccaaatgtggtggtgggaaccctgtaattccagctacttgagaggctgaagcaggagaatcacttgagctctggacgttgaggcttcaatgagctatgattgcaccactgcacaccagcttggacaacagagcgaggccctgtctcttaaaaagaaaagaaaaaaaaacttgtttttctaagttctgtgagttgttctagtaaataattaaactcaacaagagggtcatgggaaaccctgatttctaactggttggtcaaaatacaggtgacaacctaggacttgcaactggcatctgaagtgagggtggtcttgtgggactgagcccctaacctgtgggttctgtgctaactctaggtagtgtcagaatggaattgtgggatacgcggttggtatccagagagttggagaactggtgtagaaactctgcacacacatttggtcagaagtctgtgagtagagagaaacgtgttgcaggaagtcagggaccccaaacggagggactggctgaagccacagcagaagaacataaattgtgaagatttcatggacatttattagttccccaaattaatacttctataatttcttaggcctgtcattactgcaatctctgaacataaattgtgaagatttcatggacacttatcacttccccaatcaatacccttgtgattttctatgcctgtctttaatctcttaatccggtcatcttcgtaagctgaggatgaatgtccccgcaggaccctgtgataattgcgttaactgcacaagttgtttaaacaatatgaaacctgggcaccttgaaaaaagaacaggataacagcaatttcagggaacaagggagataaccttaaactctggctgccagtgggccgggttgaacagagccatatttctcttctttcaaaagcaaataggagaagtattgctgaattctttttctcagcaaagaacatccctgagaaagagaatgcatccctaaggggaggcctctgaaatggccgctttggggacggctgtcttttacagtcatagataagggatgaaataagccctgggttcgcgtggcgctcccagccttatcaggacaaggaaattcccgcctaataaatgttggtcagatgggttgtctgctctcaaaccctttctcctgataagatgttatcaatgacaatgcgcgcccgaaacttcattagcaattttaatttcgccccggtcctgtggtcctgtgatcttgccctgcctccatttgccttgtgatattttattaccttgtgaagcatgtgatctctgtgatccacaccctattcgtacactccctcaccttttgaaaatcactaataaaaacttgttggttttgcggcttggggggcatcacggaacctgccgacgtgtgatgtctcccctggacatccagctttaaaatttctctcttttgtactctttccctttatttctcagactggctgacactcagggaaaatagaaaagaacctacatgaaatatcaggggtgaatttcccccgatatcacactggctcttctctcacctgtctacctgcttaacttaataggagaggcaatgcatggtgctcatgaacaaggcaagcattaaagtcagaccagactaacatttgactcagtcctaatattcaggtgagcttgggcaaatcgctcattaaccccaagtcttcatcattttgtgcatataatggggataactgtggcacccacctgtttttgtgagaatcaatgaaatattatgcttgatgttattgtgatcatgatactatctgacaagggcagtgatgcatgataacatcaaaaaattagaaactgtaatgaggtctcttgggcaaaattccatacaagcaaattactgtctctacaaagcatttctgccacacttaattcaccattccctgaacaaaatgtgccatcttcattgttcaggtctgtatagtgctggtttccctgcctgggcagctcactccatcccatcccagcccaatccccatccctccacctcccccttccctccccactctcatacaactcttccttatcttacaggacttggcttcaatgtcaccttaactggaagcttctctccctctccagaagagcttccgattgcacttgatgcatgcactattatttgatcatttttgagttacagtccaagtctttttgtacctgaataacatgttgcccagtcagtttctcttcctggattcagaagtctttcatggtaggtccagctagaagtgacaaaaagacatttaaaaaaaaaaaaagagggatgacacagacagacatcagcacttaaaagttttaaacgatatgtgaaaaacaaaatttaagggcttctaggagaaatgtaggagggaaggtgttactgggaaatatgatagaaggttaatttttattttattttatttttagagaaagggtcttgctctatcacctaggctggactgcagtggtgcaatcacagttaactgcagcctcaacctccagggcttgagcaatattcccatctaatttttattttgtttaagaaatgcagtcttgctcttagcaaagctaaagtgcaatggtgtgatcatagcttactgcagcctcaaccttctagactcaagtgatcctccagtcttagcctccccagtagctcggactacaggtgtgcactgcaacgtgtagctcatttttttttttaatttttagtagagacaaagtgtcactatgttgaccaggttggtggtgatctcctacactcaggcagttctctcacctcagccttccaaaatgctgggattacaggtgtgagctgccacacctggctgagggggttaatttttaattatataaagagctcaaagcaaatattagaaggagcctaaatgcctccagcagttgactggtactggtaaattgtgatacatccatataataaaatattatgcaaccataaaaaggattaagatagatcaataggtattggcacaaatgtccacgaaatatgaaaatatgaagtgatgttcaatcaccatgtacgtatcttgaaggatatggcccattttctcaactgcaattatttcctgagataagattatgggtctaaagagtgaaggacatttttcacttatttaaaagtatttatcatttttataatttaataaaagattaaacagatcattgaattagtaaaagacaaagtaactctataaataaatggaaaagacacagataccccaggcatggtggctcatgcttataataccagtactttgggagggggtggtggggggattgcttgaggccaggagttccagaccagcctaagaaacaaagcaagacctcctctctagtaaaaataaaaaaataaaaataattggccaggcatagtggcatgtgcctatagtcccaactactgaggtggaaggatcacctgagcctaggaggtcaaggctgcagtgagttgagactgtgccactacactgaagcctaggagacagagcgagacttcatctcaaaaaaaaaaaaaggacaataaagaaataaagctaataagctaacataaggaaagataaaatatgtgacaaataggctgggcacatggctcacagctgtaatcaagcactttgggaggccaaggcgggtagatcacgagatcaggagttcgagaccagcctgatcaacatggtgaaaccacgtttctactaaaaatacaaaaattaaccaggcatggtggcatatgcctgtaatcccagctactcaggaggctgaggcaggagaatcgcttgaacctgggaggcacaggttgcagtgagctgagatcacaccactgcactccagcctggtcgacagagcgagactgtgtctcaaaaatgaaaaaagaatgggtgacaaagtaataataggaggtctttcatttatcacacagaaaataacttgttaaattataatacctgtgtgggcgaaggtgcagtgaaatggccattttcttgtagtattagtggtgtttaaaatgtatataagccttccagcataaagcttggaaattttttttaaatcatacagacagtgactcattatactgcctcctccaactcctggcctcaagcaatcctcccacctcagcctcccaaagtgctggaattacaggctgacagccaccatgcctgaaagctttgcaatttacatcgagggtaataagaatgctcatgccctgtgactcacagtaatctcacttctggaaatttcacctttggatataattcaacctaaacaaaaggtcatatgcacaaacacagtgaaaatctgcgagtaatttttttctctttttttaaaaaaatatggaatgcttcacaaatttgcatgtcattctttcacagaggccgtgccaatctctctattgttccaactaaagtatgtgtgctactgaggcaagcatgagtaatttaagatagagtggttaagtgacataaggaagaattatggagaatttaaaaatctatgctatttataggcacctagtaacagctcagtaaatattagctgctactattattatttttatggtaatttcactcaattaaaaactgtcattaaaaattaccattgtcatggaacataatgtctcctactgtgtaattgtagaaacagatacaatttgtcccttggtatatggggggattagttccagctctcccatttctgtgtataccaaaatccacgcatactcaagttttcgaagtcagtcctgtggaatccacatataacacaaatgggaaaattagtgaggtgtggtgacaagcacctgtagtcccagctacttgtgaggctgaggcaggaggattgcttgagcccaggaggttgaggctgcagtgagccataattgcaccactgcactccagtctgggcaacacagtgagacagaaggttgactttttaatagaatttttctgttcacttgaagatatggtcaggattgtggcatatgaaaattcttcataaaataactatctaatccaattaatgctggaattgggaacagcagaagtgtcatctcagagctactcacaatgaaaggtgatgtctggggctcaggtgtgttgaggtccccatgcctggactatgggtgctgagtgggatttacttgtccatccattttctatattccagcactgggaaactagggacagtacttgttctcaagggaatcttcagcttaggtggctctgtaaaagagaaattacatcattgaaaaatcgtcgcaggtcaggtgaggtggctcatacctataatcccagcccactgggagactaaggcaggaggattccgtgaggccaggagttcaagaccagcctgagcaacacagtgaaacctcatctctacaaaaaattagaaaatgaactgggtgcggtaaaacattcgtatagtcccagctactctggaggctgaaataggaggatcgcttgagcccaggaagtggaagctgcagtgagctctgatctcaccactgcactctagccttggtgacagagtgagaccctgtctcaagacacacacaaacacacacacacacacacacacacacacacacacacacacacccaatctcactctgtccagccttgactaatcaaaagggccttctggttacagaagaggtatgctcttttgtaggacagggagagaccagcaagcttgttcacagacttttcctcatcctctgcttagttttccaagaaccctcacagtggaaatggagtctctgggaaaatgacctaaatctttgggttaccaggggagaaatatgcctcctttgtcaattaataaatggaacatcagccttaaaatccagggagttctgctagaatgaatcactccctaagaccctgaccaatgcatggaacatgaaaaactgaagtttaactgggcgcggtggatcacgcctgtaatcccagcactttgggaggctgaggcgggcggatcacctgaggtcaaaagttctagatcagcctggccaacatggtgaaaccccgtctctactaaaaatacaaaaattagttgggcatggtggtggacacctgtaatcccagctacttgggaggctgaggcaggaaaatcgcttgaacccggaaggcggaggttgcagttacttctagaagaatttccattagccctttgaaatccttcaacattcatgaaggccaaagagttttcacctaatttaatctgatgggtatgtgaccagagtctttctagggaatagagactcccaaacagttcgactgggaagtgaggagagaatttattactcaaaaccaaagggaaatgaaaagaggccaacatagaatgtcattattctttcttggcggggaatggattccagagtcattctgtgacctttacatgacctccttattagcatctaaaagcttccagtgtaggatgcagccagctaggttctcttctaatgtaataaaatttgcttcggcaaatcttatgcagagccaactccaggctccagaaacaataggctataaattactggatctcccatttgatacaatgaagtatgagcacggtcctgaatgactcctctacatactactctgggtggcttgaagtgaatttgatacaagaactggagcgagggcaaagcagagctagatctaggattaatgtgcttgggcccagctcctcactactcacctatgagtctagttccagaacccaagtagaggatggggaaacaaggctcctgactttttttccctaatatctgcatctctttcacatttcttatctccttgcaaagaaactaaacagtctcaactgaaataactaaatgattaaaccctatacagagaatctccaaagactgacaaaatatcattcaagactgttacacagacaaccttgaggatgacttgatgtaccagtgatctacaatatttgggatcattccaaattcccatcaaggatctgcctatatcaacaaaggagccaaggaccaaccattcaaatgggccctgctgccaagcctttttttttttttttaacaatgccatctcttcatattgttccatttaacaaaactgcagcccttcatctatccttaagtcccttggccaatggtacagagccagagtatgctactccctagcaggaaatcaacaggatgacctactaaacaccattcagaagatgctaagacccatgaattgcaacaggaaagaaaagacagagaattagtcagacaggtacatgctgtgccaaaaatgcactacagcccccacccaattctgcctaatcctagctgggctgacaccaacctgatgagacaggcctataagatctcaaactaaaacagaaactcctgaactgggttcttttgagcccaggaagcagcagtaaatcattaaagaacagataagttcttaaggtgagggagagtttcagataaatggaatgctggtagaacacagggcccaaaggagcaaaagttaacctaagcccaggtagaaccttgtttactagagtattaggcatgggtttgggcaactattctaaccagagaaactggcttcagtgagggcaagttggcaatccaaggtatagcatgcatagggctggcaaaattcagggtgactgaagcaaaagcttcagaaccagaaagaccacatctgggggtagagcacaaaactctcaagagatgaatctttgtaagagtgaggcagaactatatagcagttttaggagatctgttggtgcccagcaagagctccaaacgggctatatgcagggatgcaggctgtagtctcaggagaggaggttcacaaaagtcattcagtccaagacctcaaactgtgttctctactaaaaggaatcaaggttccctagagaaacggctgactccatgtatggtgcagtatattgatcctggaacatcttttttgccagaaagcaaggaagccatcaaagtccaacaggatcacgtcaaaaagacatgaaagtcaacttgaagagataattattaacctagatgagacaatgtaagcatccaaaacaataaagactgcaatggcctgaaatacatcaaatgcaaacaataaactatgagttcataatggtattcagaaaaaaaaactactggtcattagagggaaggttactaggtcactaacttactactctgaaaagtgacttaagatgagaggtagggtggagaattagctatttattcagtctttcctgtacaaacataaatttttagggagattgaagcagatgaaacaaatctggaaaaatggaggtaactgcttaatctgcgggttgggtgcatggaggttcaacatatttcttttgtgtatatttgaaccccctacaaaaaaagcacaagacagaatgtgagccaagcagcttagggtttaggcaaggcttctgcctacaagagacaccaggatatgaggggtagttttagccctattgggctgagccaactggaggtatatagggaagtgctaaattgcagaggtatcatgttgcccagcacttgatcaaatcctagatcctaggtctgcttggtggcatgcttcctaggtagtggatctgaggctacctatagaacttcctttgcagtcatagttcactcagaaactacaaaagtgcttgctcttgaaaatggagtctttgtccatttcatgcttctataaaagaataccacagactgcataatttataaaaaggaaaaaaggaaggaaagaaaaaaggaaggaaggagggaaggagggaaaaagggaaggagggaaggaaaggaaggaagggaaagaaggaaaggaaggaagggaaagagagaaagagggaaggaggaagggagggaaggagggagggagggagagagggagggaggggaagggaagaaaagggaagagaagggaaaggaggaagaaaaggaaaggaaaggaataaattttatttcttaacagttctggatgttaggaagtccaaggttgaggggcctgcatctggtaagggtcttcttgctgcatcatcccactacagaaggcagaaggaaaagagagtgcaagaaagcaagagggcaaaaggggctgaactctgttttataataagcccactctgtgattactaatctattagcacaataacaacattaactcattcatgaaggctattttattaggccccacatcccaactgttgcattgaggattgagtttccagcacataaactttgggggacacatttaaaccatagcagagcacttaggttaattcaactaagaggagctgggaaaatcaaaggcatgagaaagacagcaaaagctagcagagagaaatgcataggttaaggaaaaaagtcacagtgaatcctgtagtgcaggctactttatcaaaagcacctaaaaaagatctcattaactcccccagctcacctccacccacatctaaagagccacacacagcaccaccaaaggcagcacaatgagaacagcattctcctcaacagacaagctgggagtatctagacacctgacctcaatagctccagaacagccctaaaacatttcctccctaaccaccactcaagtcaccagcttggaaagtattaagaaaacccaaatcctgacacaccactatgaaacaacttaaaacagcaaagaacaacccatttaaacagcaatgccagctgttggggaaaaaaggaacaatgagtagaggagaaacagaccactcggggtccaccaagacccagtctctcagcttcagcacttttaaatgcagaatccatacccctctggggcctgtggagctccacaaggcatgtcgtcctcaaagataaatgagcaggcaagctggctagaaaaccactaagggtatttattctttaaagaatctttacagggtcaaagaagaatgggtcttaactggctatgtgaactccccacagattctgaggatgatgtcagtatccctttccagatgtgtttaacactttgcagtcacttgtattcctgccactgagtgccagtgctttgctaatttgaactgattccagctcacgctgaccccagctccctggatgttaccattagccaagactgtcacccatactgtaccctttcaaagagtcctaaaaacagctcttcacctactcttccaagacaagtaaaaatgtctgccaaagaaatggggaaaaaagattcagagagtgaaaacaattaatatactaacaagagagcaaaaagcaaagggggaggagaaactaggaaaatcatatatgggctctcacctatttccaaagctgggctaatgtccttttgcttgtgtctgaataaggcaccaattttaagctgctaatgaaaaaaaaagaaaaagagaaagaagcaggcccaggctgggcgcagtggctcatgcctgtaatcccagcactttgggaggccgaggcgggtggatcacccaaggtcaggagttctagaccagcctggtcaacatggtgaaacaccatctctactaaaaatacaaaaaattagccaggcatggtggcgcatgcctgtaaatccagctactaaggaggctgaggcaggagaattgcttgaacctggaaggcagagaatgtggtgacctgagatcacgtcattgccctcaagccacggcaatgagaacaaaattcggtaaaaacaaaacaaaacaaaacaaaatcaccataaaataactcagacttaattaaatacaaccctagtggtgaatgactaaagatggattactcataacagagataacggtccaataagaatccaggaatcttaccttttaataacaaaaaaatcctttccttctaaagtaacatcctctcaaggccaggaattccattagtagaaagccttcctaaaaaacaaaattcctggccaggcatgggttcacgtctgtaatctcagcactctgggaggccgaggcgggaagatcacttgatatcaggagtcgaggcgggaagatcacttgacgtcaggagttcgagactggcccggccaacatggtgaaaccgcatctccactaaaaatacaaaaattagcctggtgtggtggtgggcacctgtaatcccagtgacttgggaggctaaggcaggagaatttcttgaacccaggaggcagaggttgcagtgaccagcaaggttgcgccattgcaccccagcctgggcgataagagtgaaaactccatctcaaaaaaaaaaaaaaaaaattcctttgggaaggccttctacataaaaatcttcaacatgagactggaaaaaagggtatgggatcatcaccggacctttggcttttacagctcgagctataagaacaaaaagaaaaagggatatcatttaaacacagtatgtagaaaagaataattattgaatctgtactggtctttaacttttacactttgatctttaattctgttattgtgattgagtccaaagaaaaacagtatgagtaaaataaaaagaacaccaaaaatgctaatattctgtttaccgaagtctgtagtgatatatcccattaaatccaagtgcagtgacacacccataatcccaagcactttgggaggctgaggcgggtgaatctcctgaagtcaggagttcaaggccagcctggccaacatggtgaaaccccaactctactacaaatacaaaaattaggcaggcgtggtggcagaggcctgtaatcccagctacttaggaggctgaggcagggagaattgcttgaacccaggaggtgagcttgccatgagctgagatcataccactgcactccagcgtgggtgacagaacaaaacttcaacctccaaaaaaaaaaaaacagctagcaggtgacatttgctatagggagactagggatatgatcttgctgcaatccttccattttagtaaatctaaacagtgtgaatccattctgtttcgtccccactccactccagagccaaaacaagaaaatcaattatatttctagttctttaaaaacatatctaactaaatcatctaattaaaagataatatgcatggttccatactctaaaagaaaacttatgtcctgcatatcatggacatttgatgaatgcttattcagttgactggtgtagacttcaataataacctgttcaatgcattatgccagatgaatcttgcatctcaaaagtagaacaaatattgttctttcagttttgtctacccataaatgcaatatttactaataaaaagaaaatgagtttattgttctagagagtatgagaattttgacaacatgaattctcctgtcctaggacataattaatacttagaggcatactatttcatgtggaagctaccattaaatcaatgttaagtgttaattacctcacataatcttctaatctgacttgactgaagacgtacctgacaaagttgatttatcaagttgtaaatcttcacctgttgaattcataagttcatgtctgaaaggtgagaataaatacttaatattcactaggcaatttcagcaaagtaatatccactagtacatatttaacatttcatcatgaactgcgggtgtgaagagaaaagacaggctgggcacagtggctcacacctgtaatcccagcagtttgggaggccgaggcaggcagatcatgaagtcaggagttcgagaccagcctggccaacatggtaaaaccccgtctgtactaaaagtacaataattagctgggcatggtggcaggcacctgtaatcccagcgactcaggaggctgaggcaggagaattgcctgaacccaggaggtggaggttgcagaaaccattatcacgccactgcattccagcctgggcaagagagcaagattctgtctccatcaatcaatcaataaaaatataaggaggaagcatttactgtgtatttatatgtctggtattatgtgaagcactttactatcttatcaaatcttcgggacaggtcttcagttctcatgaccacaaaagaggatactaaagctcagacaggagaagagacgtggccagcctgtgtccccagggcctatggtcttaccactaggttacagtgtttccagatatcacatgttgtgagatttttgctttaaaatgaaccaaaaaaaaaccaaaggtgaaaaaggcataagctattaaaaagtgggagaaacactaagagaaccttaagcatgtaactaaaaatattatggaaatgttattgaattcattagcaaatttagtgctaggttttcattgaggagtaggttatattactcatgatgaagaaaaatgttccttttaagtatattaacataaataccatcaatattgtttatcatgtttaaatgttcacttaaagcaattcagttaaaattctgcatatcatacaattttatagtttgctagtaggttacaagtaaatagtcacccaaataaaaacatcatgttttccactggttgttgctcttttttaggtgagtatttgatgtataccaacagagagaggataataacaaatcgctaatttctttcatcactatataaaggtggcttcaggatagaatagtatcagggcaatgatgaatttgaaatctaacatcaattcagtgatgcatcaagataaaagcagagacaacaggggcaccttggtgagtactgaacattttatttatttacttatttattttgagatggagttttgctctttttgcccaggctagagtgcaatggtgccaacctcgcctcactgcaacctctgcctcctgggttcaagcgattctcctgccttggcctcccgaatagctgggattacagacatgcgccaccacacccgtctaattttgtatttttagtagagacggggtttctccatgttggtcaggctggtctcgaactcccgacctagatatctgcctgccttggcctcccaaagtgctgggattacaggtgtgagccaccgcgcccagatgaattccaaatttaacaaagcagactaagagaaacaattcatttaaaaaaataatatttggccaggcatggtggctcacacctataatcccagcactttgggaggctgaggtgagtggatcaggaggtcagcagttcaagaccagcctagccaagatcatgaaaccccgtctctactaaaaatacaaaaatcagccaggcgtggtggctggtgcctgtaatcctagctgctcgggaggctgaggcagagaactgcttgaacccgggaggcggaggttgcagtgagccgagatcgtgccactgcactccagcctgggcgacagagtgaggctccgtctcaaaaaaaataaataaataattcaatgaaattcctaagatccagggctttgcaataaatatgtaaataaatttccaatctccatactgaaagtttaaaagaaatgctaactaataactaaagaaatacaacttttcctcagctttgcagcaatctagaaacaaagtgtgtagacactacaaagcaccttacaaggagaaacatgtaaggatggcatgactcgccggcagccctgggcttgtccacggtacccccatgatgaacagtaactccactgtgtaaacgcccatgaacataagattacaagacttttccagtttagacataccatattttctttcagacaattcttcagtttgtttacgtagatcagcgatacgatgattccatttctctgaaaaccaagcaaaagttgcttctcaataacacatccctatgtcagagcagcactaacgtataatgactgatgtcatatattttacattctaacagtccatatcattttactgctttcaagaaaaaatttccccttcttggtggttcttagaattggtttaatgggagactattagagaagctgaaaagcaggagggcagaaaagttcaatcaaattaaacacaataacagggaggtcacaatgaggcggtctccaggggtcttttagcaaacttcctaaaacatgtctcagctgtgtgaaaatagactttacagcagccgggtgcagtggtgcaggcctgtaatcccagcactttggcagcagaggcaggtggatcactttgagctcagggcaacatagccaaaacccccctccccagccccacccccaccccgtccctaccaaaaatacaaaacagcagggcatggtggcgggcgcctgtagtcccagctactcaggaggctgaggcaggagaatcacctgaacccaggaggcagacattgcagtgagccaagatcacaccactgccagcctggatgacagagcaagactccacctcaaaaaaaacaaaaacaaaaacacaaggttaagagggacccccgaccttacagatgcaagtttaagagggacccctaagcaaaaaatgccaaccctttttctcccaatcattgaaacaccaggagggtgtaacagttttgcagcctagctgtagcaggctgatgcccccaagatgcccatatcctaatcccgggaactggtgaacatgaccttatatggcaaaaggagctttgcagatataatgaagttaagggtctttggcttttggggttgatgtactcactcggatccttgtaagagcagagcaggtgatggagagggtgggaggtgtagtgacagaagcaggaaactccagtcattcgagacgggcagcacaggctgaggagtgcaggccacctctacggccaggaaacagattctcccgcagagcctcggaagctaccgaccctgctcccaccttgactcagtaggacttactgtagaattctggccttcagacctgtaagggaatacattttggttgttttaagtcactaagtgtgtggtaatttgttgcagcagccacaggaaactagtattgtagtgaagcctcaaaacccccctgaaggggctgggctcagtggctcatgcctgtaatcccagcactttgggaggccgagatgggtggatcacttgaggtcaggagttcgagaccagcccagccaacatggtgaaatgccatctatacaaaaaatacaaaaactagccgggcatggtggcacatgcctgtaatctcagctactcaggaggctgagacaggagaattgtttgaacccaggggggcggaggttgcagtgaactgagattccaccactgcactccagcctgggtgacagagcgacgctccacctcgaaaacaaaacaaaacaaaaaaaccccacctgaaggtttccagttctgccagcactctcccacccaacccccagaaacagacattccattgctgtgggccatggacaggcagaaggaagcacctcctcatggcagaggcctacccaggagaaacccaagggaaggcactgctgggctggcccctctctgccaaggccatattcttttttttttttttgaggccagtttcactctgtctcccagactggagtgcaggggcacagtctcggctcacttcgacctctgcctccccagttcaagtgattctcctgcctcagtctcctgagtagctgggatgacaggagtggagcatgcctagctaatctttgtatttctagtagagatgcggttttgccacgttgccagtccacctgtctcagccccgcaaagtgctggtattacaggagtgagccactgcacccagcatttgccaagacctttgatggcaggctttttccaggtgatcagtccttgtctggtctggctctgccccactctccttctcacctagttggaatccctagctacttttcagtagaggagagtgtgtaccccaatcccagcttggttcagatctgcatttaactcatggaacctggctgctccccaggtcctgaagaaaaaaacggtctctctgtgggtatgataaaggatgggcctgtccccaggaccctgtgagagggaagcccaatgtcccaccaggttggcagggctggggaagggaaagtgttatggcagccccaagaaaaaaaagaggcagcagagggagcaggacagcgctcacatggaactcatgccactgcctgaggggggggaggagtgcacgccagtgacgtcagggggcagagaggcgcagttccagggtggctttccccctcacttcctgccatgttactctgatcgcctccaggtgagcctgcccactttgtgcccaggggcctgtagaaaaccacagctccccatggttatggccccaggagtggggcagagcagggaggagtcctggacagaggagaggcaggggcaggagggagtgggcctcaaactccaggagggggcccttctcatgggtcctgctttctggcttctccttccttacccctgggctgatcacttggggaagaactgagacaaagtttctcgccctcaggcccaaagggtttaattactgggcccttagggaggtgtgagccccctgaaaggatgcaaggttttgttttgttttgttttttgagacagagtttcgctcctgtcgcccaggctggagtgcagtggcgtgatctcaccacactacaacctgcgcctcccaggttcaagtgattctcctgcctcagcctctggagtagctgggattacaggtggctgccaccacgcctggctaattttttgtatttttagtagagacagggtttcgccatgttgggcaggctggtcttgaactcctgacctcaggtgatccgactggctccgcctcccaaagttctgggatcacatgagccactgtgcttggccacgatgaaaggttttgtgtggagagcatgtacatgcctttctgggaaaacagtccacagcgcttattctcagcagacttcacggtgaaaaaaggttagaactcttgctacagagctgtggaagcagccaggtgaggggcctgccaagggcactctgggcactacctgggcactctcgagcccatcatcccctaggcaggctgcactgcttggtatttgcagagctgagggggtggggcatgtggggactgtgaaatcgccctgagatgacccacagtcctcagctgggaagtgagcgctgcatctcctgcagcgtcctccatccctagagccatggggccaggagaaccggcccttgcagcaagtgaaaagcctattattgattccctccctagccatgtagacagtgaaccaagacactcatatcaggtaaatgccttgttctctgttaccaaggtaaccagtaggcattcccagatacagcgaaggtcctcacaccaagatatgcacctggccacctgaggaaagagaaaggactatctgaggggatggggctgagctgggtgtggagtggtccttgtgggtcttggagagtgggagggggagcagcatgagccaggcctcgaggcagaaggacaaccaggagacagcctggaaaaagtgctggacccacaagggctctaggctggccagaggggaggtgggataggctgtaaagtcctgaggtctgaagattggccctggcaggaagaaaccaggtaaggtggggtgttacctacaccctcggggccagatgcaggccagagccagccaattaccaggcccttagggaggtgtgagccccttgaaacgatgcaaggttttttgtttttgttttggagacggagtttcgctcttgtcacacaggctggcacctttgcccagagcaggcaccaagacttctggctctgggtgtgacctcagtctgggtaaaagccccagcccccaccagcaccacctatcccctagactacttcaggtgctgagcccaagccaggggcaggaagctaaactgatacctagggtaatcccaacaaagtccctggttccccgcagctatggggctgacggggaattacagcccaaaccccagatgctggctctcaaactaacactgagccctcagtgcccacagggagatacaatcagcgcactttccagatggggaaatgggatcagagaagtgcaacagccttgcccaatgccccagaccagggctccaggcccagagtgttcttttgtcactgtgttcagagggcagcagctgctgtgatgtacccacctgagcctggcagctttctccaactttggaagcccaggagcatggcccctgtccacagatgcacctggcatgaggcgtgcccagagggacagaggcagatgagttgcgtctcctccactggattgtgagggcctagaaggagacaagggtctgcttgagaaggcagtgaacagcgagcagcctgaggcagtgcccctctggatggatgcgcagtgcctggatggaacctggctcagacagagctcagttctgcaggtccctgaggcatggagagttcacagctaccaagtgtaggagtctggattcaaagccaacggcgtgactccaaagtccctgccctagcccctggaccacccttgcaggcccatcagatgcccaggccagcagcacagccggccaagaccagggaaacttggggagcctcagagcacccccaggtattccaacctaaccctggtgccccgcctctcaccacccttcttcctgcttttacctcaacccctacacaaagcctgggccacttaatgtggcatcaaacagacgcctcaataaatcagtctaatctcgaaaaaaaaaaggcttaacagatatacaattgcacgttagaatgctaaagaccataaacatataacaacttaaagtacatataaattcaatatatatccaatcattgtaactatgacacagtagaatattaaaatactattttcaaaatgtatacaagcttaatgttctatgtattcaaactgtttattcaaaatacaaatcatcaacataaattgccactaatattcagtcccttcacaggacatgattcactgggagttaataaattagcagccggcaggcagtgacacaccgcaaaaatgaaaaccaagaggtgaaatagttctgaaataaaggttttaaagctaacagaaatcactgaattactaagtcattagcactaattttgagccaactaactaattaatatgagatgatacaatgtcctatactttggtaaatacagactatgtttaaacaatgtctgtaacgtgacttgtaaaatgctcctggctttacaaagatgtgattaagatgtagtaacacatgctaaaccatttccccctgcagagcatgtggtaactttcatcagtcacattgagagtccagaagataaaggaaaaggtcatggatttcgctgagaacttaccagagttgaactccctcattttccgttccccagcattggcgggttctgggactggtggctgtggtggctcgttggtctttgtctcttagaaggtggggaataatcatcatcttgaaaaagaaaaaatggtcattactgaaggaaccatcttaggttacagccacctctgggtcaattcccaacattcaaaagctgagcagggctttaaagctatcttattaataattatttctgtattgcgaacttcagcatacttttttctagttacatttgaaatgttattcttttgggatgtgctcaagtgagtactgctttttcctctgccttgcttcattactttttagtttccttcatttgaatcatcattgtaagtctccccttctcctcaaataactttcaaattgctgccaagaactatgttctatcttaaggcttttgagaaaaaactttcaatgaagatagccgcctaaagttatacaaatatagaagaaacgggataaaataaagcttagattggaaaaaatatttaagattctacaaaattcacgcgtaaacaagggaagctgagtaattgtatgttcaaatacttgcaaaacatgtaggcttaaagaaatagagctggccaggcatggtggttcacgcctataattccaacagtttgggaggccgaggcaggcagataacttgaggtcaggaattcaagaccagcctggccaacagagtgaaaccctctctctactaaaaatacaaaaattaggccaggagtgatggctcatgcctgtgatcccagcactttgagaggccgaggtgggtagatcacctgaggtcaggagtttgagaccagcctaaccaacatagggaaaccccgtctctactaaaactacaacattagccaggtgtggtggcacatgcctgtaatcccagctactcgggaggctgaggcaggagaatcccttgaacccaaaaggcaaagattgtggtgagccgagattgtgccattgcactccagcctgggcaaaaacagcgaaactccgtctcaaaaaaaaaaaaaaagaaaaaattagccaggcgtgaagttgcggtgagctgagactgcaccattgcactccagcctgggtagcagagcaagaccctgtctcaaaaaaaaaaaaaaaagagagagagagagaaagaaagaaagagggctacattatttatgaaacaggtactgttaactcagtcaccagaaagcctgtgtataaatgagcagtgagatattcaagcacagcacacacacacttctcaggacagctgtcgtgagtgttccatgctcatttccttctggatacatcagcaactcactctgctatgatcctgcaatacatctcatgttagaattagagacatctgggccaggcacagtggctgacgcctgtaatcctaacactttgggaagccgaggcaggcagatcacctaaggtcaggagttcgagaccagcctggccaacatggtgaaatgctgtctctaccaaaaatacaaaaaattagctgggcatggtggcgcgcgcctgtaatcccagctactcgggagcctgaggcaggagaatcgcttgaacccgggaggtggaggttgcagtgagccgagatcttgccactgcactccagcatgggggacggagcaaggctctgtcaaaaaaaaaaaaaaaaaaaacagaaaaagaaaaagaaaaaagaattagagacatctggatcaaatcagctgccagtctcgcaaagtgtcgggtaacatcctattaagcttgctgcttacacatcatctataaaatactgaaaatatcattttaagaaatcttttttttattttgagacagagttttgctcattgcccaggctggagtgcaatggtgcgatctcagctcactgcaatctctgccccctgggttcaagcaattctccttcctcagcctcctgagtagctgggattacaggcatgcaccaccacgcctggctaattttgtattttcagttgagacagggtttctccatattggtcaggctggtctcgaactcctgacctcaggtgatccactgaccttggcctcccaaagtgctgggattacaggtgtgagccaccatgcctagccaagaaacccttattttaaaacaagccaggcgcggtggctcatgcctataatcccagcactttgggaagccaaagcgggtggatcacttgacgtcagtagtttgagaccagcctgggcaacatgttgtaaccccatctctactaaaaatatattttaaaaattagctgggcatggtggtgggcacctgtaatcccagcttctcaggaggctgaggcaggagaaccacttgaacctgggaggtggaggttgcagtgagcggagatcacgccactgcactctagcctgggtgacaatagaaagactccatctcaaaaacaaaacaaaacaaaacaaaacaaaaaaccactaaaaaaaagactccatttcaaaaacaaaactaaaaccaaaaacacaacacaaatgtagtacacaaatgaaaataattactgtgttaaacacagtttcatagaaaataaaagaccaatcaaatacaataagctgcctttttagatgggtatgttattcttctttcacagctaaagaaacaggctcagagaatgttatttgattggaccgtgttgcatttctggacagtgcagctgagatcagactttgtgtgtaactccactagcctaccagggtgcctctcataaagctaagaaatgtaaatttggcctaatatacaaagttgccagggcagcactgggtcaattctacatacagtacttctatgttcatcaagggaaaccttaagggaaagtgaaaatgcttctagaaggcgactggacaccagcgcctttgcttgttgcctttgggctcttcttctaaggccaacagtgacctgaaattattgactggcttttcaatcaagtggacaaaatggtaccaaggtcggcaacatcagacaaatttacttgagggccttatctatgcgctttgaaagacaaaactgcttttgtaaaggacactgtatttcagaaaaacataatcatattaacaaataataacactgtaaaatgctgatgtgttgaatgctactttagaaaaacatgctcaaatctagggaaaaaatttgatacaaaactacgtatcaattatctagctagctatctatctagagacatgctttcattctattgctcaggatgggaagcagtgggattatcatagctcactgcagccttgagctcctggcctcaagtgatcctcctgcctcagtctcctaactagctagggccacaggtggacacagttatgcctgggtttttgtttgtttgttttgtagagacagggtgtcactacattgcccaggctggtgtcaaactttggagtctcgctgtgtcgcccaggctggggtgcagtggtgtgatcttggcccagtgcaacctctgcctcccgggttcaagtaattctcctttatcagcctcccaggtagctgggactacaggcatgcgccaccacggccagctaatttttgtattttttgtagagactgggtttcaccatggccaggctggtctccaactcctgacctcaggtgatccacccgcctcggcctcccaaagtgttgggattacaggtgtcagccactgagcctggcggagcactttatgttattaagtagcctaacccaggtgggtcgctgtccctcacgcctgtaatcccgacaactctgatggccaaggtgagaagattgcttcaactcaggagttcgaaactggcccgggcaacatagcgaggcaccccccgaccccatctctagaaaaaaatacaaaaattaggccaggtgtccaccgcgcccggctaatttttgtatcttttgtagagacggggtttcgtcatgttgcccaggctggtctcgaactcctgagcccaagccatccatcctcccgcctcggcctcccaaagtgctgggattacagtagggcccagccagcctcatgttttatttagcagtccctccctgttgcacacctggatagttttttaaatttttttagacagggtttacctcaatctcgcaggctggaatgctgtggtgggatcatagctcactggagccttgaacctttgggttcaagtagctggggggctgaggtaggactacagagatggggttgcgccatgttgctaggctgctcttggcctgaagggtcctcccgcctcggccgcgccagacatagttttctatttttgaccaacataaacactgtgctgggtctgaatttttcagctacccttcttcagccggcaacacacagaacctggcggggaggtcactcttaccagtccccactctgatgagaaaactgcccagctccaggcaccatggcgccccagtgatgtagccgaacacccgcgcctctaacgtcgccaacggcccacctctatggtgtcggcgaagacccgcccttgtgacgtcacggaaggcgcacccttgtgacgtcacaggggactaccactcacgcagagccaatcagaactcgcggtgggggctgctggttcttccaggagcgcgcatgagcggacgctgcctactggtggccgggcgggatgtaaccggctgctgagctggcagttctgtgtcgctaggcttctgcccggccgccgccgcacataagccacgaggaggagctttacgacttcccggtcttcggcgccgggcgcagcaagggccagactctgcgctagcaggcgctgcgcgccaaccggccggcacctgtcgcagaaggtgcaaccgatcgcactgtcgcgcagaagctcctcaatggccagcgccagctgcagccccggccgcccactcgcctcatctgagcctgggtacgtgcgctccacaacgcctcccccagccagggcccggggatccccgggagcgtccccggctacctggcgccgctcatcctgggtagggtcggccccctgaggctgcccggcatgagggagttgcacccctgagcttgacctctgacggtcctttgtaatagcattaagtctttgaaacttgtagcggggtagaaggggctaggaaatgaagaaaacatctttttaaaaatataagcagtcggctgggcgaggtggcccacacctgtaatcccagcactttgggaggtcgaggcgggtggatcacgaggacaggagttcaagaccagcctggccagcatggtttcactgaaaccccgtctctactaaaaacacaaaaattagtcgggcgtggtggcaggtgcctgtaatcccagctactcgggaggctgaggcagagaattgtttgaacccgggatgcggaggttgcagtgagcggagatcgcgccactgcactccagcctgggcaacagaccaagactccgtctaaacaaacaaatatatgtgtgtatatatatgcgatcgagcccgggaggttgagattacagtgagctgagattatataagcgatcgagcactggaggttgatgttacaatgcgctgagattgcgccattgcactccagcctgtgtaacagagggagactctgtctctaaaaaattatatgcaagtgagagcttttcttccagcactcatgctcagactgaagaaagtaattgggccaggcccggtggctcacgcctttaatcccagcattttgggaggcggaggcggaagtgggtggatcacttgagctcaggaattccagactagtttgggcaacatggtggaaccctttctctacaaaaatacaaaaaattagctggacatggtggcacgcgcttgtagtctccgcaacttgccgggcttaggcgggagaatcgctcagctgcagcctcgacctccaggggcaatccatttcagcctcccaaagtgctgagattacaggaatgagccatcgtgcctggctttacactatattttaacactttttttgaaaatggaaacttttacaggcaattcacttccttcaaactaatgataaggaagtgatgctgttctgttctgttttgttttttgtttttgtgggttttttttcttttttgagatggggtcttgcccaggttggagtgaggtggtgcaaacaaggctcactgcagccttgaccttcgggctcaaggaatccttccccgtcagcctccccggtagctaggactacaggtgcatgctaccacgcttggctaattctttttttgaaatggagtctcactctgtctcccaggctggagtgcagtggtgcaatctcggctcactgcaggctggtctcaacctctgacttcggatggtccacccacttctgcatcccaaagtgctgggattacaagtgtgacccaccgcgcctggcgattttgctcattttagatactagaactttttaatttaaaatttttttttcctgagatggagtcttactttgtctccaggctggagtgtagtcgcgtaatctcggctcactgcaacctccacctcctgagttcaagcgattctcctgcctcagcctgccagagttgctgggactacaggtgtgcaccaccacacccaggagttcaaggctgcagtgagccatgatcgtaccactgcactccagcctgggcaacacagcgagaccctgactccacaaataaataaatcaacgtcatatgatctgtaccagggtataggcaggtgctatgatccccacttttcatcctcaactctaagttgagtcatacatcaacctctagtaaaaagtggcatgctctcagtcaaaggggtaagcccaaaccacgtggagagaatcttatctcttttgagagctaatataaaaagaattcctcctaggcataaaaatattatgacaccagttacttaggctaaacatgcctattatgctaagtgagttattaacaataaatactttaactctgtgccatgttaattatcataatctgatttataatttgttttaaccttaggttatatataccttgaagccatttatattttggtatacttgtaataattactatacactggactatgtatattggactaaacacggagagtcaaaaaagagtatgtggtcagagtagaaatcatgccctagcttccttcgtgtctacctcctaccttgagtagaagtggtagaaaaagtaattacctaagattttttggattctggtttgtggagaagcacccttatatttaggctgatgggcggcaaaattagaaagtattttttgtgatttagaattttatacagagatgttcattgtgattaattattctttgtattagcagatttttgctttttatagctgcatgatttcttgtttattattcattcattattgtctattaataaagaaaaactttatttcactgaagcagtgatatataatccaacttggatttttaaataatgactgactttttttctttgggaatacattactgttaaaaatgtaattattagatacattacttttaatgaatataagtggtataattagaaggctgaaaagaatccttggaaacgtgagtttaatttgatagctaagaaactgaggacaagatacttattctttgtagcatattttctaatgtcatttcattgtctcaccaagaaatacttgcataaagcaagttcaattacagtatctgttgaatatttaaggttgagtaaagtgggtgagtttaacagatattttcccttatttcttttaggcaaatctggattgggaaagttgacattaatcaactcattattcctcacagatttgtattctccagagtatccaggtccttctcagagaattaaaaagcctgtacaggtctagatattggtatttttaattgatgataagctggaataatattaatacacacaaagcacgtgttgtaactttcattatgcttccttagaggtaagatgcaaatttgcccttagccagtgtaagatggtaaatatgacttcataaaatcaaaaaaacagaagaagtacagttaatcgaaagattatcttgactagaactttccaaatttgtcctaaggattctcctagagatgacactgtgacatagtaaccaattcccctggagttgtgctatgtagtatgatagtcatttgccacatgtttaaatcaattaaaattaattaaattaaaatgcaatttctcatttgctccagatacatttcaagtgctcaacagccacatgtggcaagtggctgccattttgtgcagcacatatatgaagattttcatcattgtagaaaattgcattggacagtgtagagaaaacatgattcatagaaaaactattgttatttaaatacagtgttctatattagtcagtgggataataccatatcatagttgaatggcaatagcaattctgtaagactcccaagctatatgtgatctaatttactgcttctcagtctttgctatgcattccaatcctgggtatcctgttaaatttatttcttctagtagttctgagatgggctgcctttctacatttctaacaagatcccaggtgatgctgatgctgctggatggtagatcacactttataaagcaaggggctagactctagatatgcactttttattaaatagtacagcagcctgtagccacatgtggctattaatctttgaaatgtgggtagtctgaattgtgatgttctgcaaacataaaatatgccacagatttctaagactgagcatggaaaagaaaatctccataattttttatattgattgtatactgcagtgataatattttggatgtatcaggttaaataaaattgactgatttcacctttttcctattttaaaagtggctactaagaaaattttaaattacttacatgaccgacatggtatttttatttggcagcgctgctctaagctgttgatgaaaaatattgttggtgagctctgcttaggtaatatataggacatgagcagagaggaggcacgtgaacagttctggcctggagtaggcttcattgaggctgtgatgcttttagctggatttgaagaagtggtagtgatcatcccagtgcacaggataggtggacagtctatgtattctgagcagtaactcatatatctcatactgcaagaccccaaaggagtaattttgtgaagtaaatatcttatttctcctttttaatgtttctattttaggaattttttttttttttagtaaccttcatagggcttgagatttaaaattacctgcaaaattctactctaaaaacttgatcctacatgcttattttgtgataaatattggaaattttaaacctaagcaagaaaatgaactttgaactttcttaatttgggtatctattatgaataccttcacttaagtatttatgaatttagatatgaaaggtaaaactaaccactatccaaattaatatacagttcatttccagaaccctagtttcttccatgtgctcacttgcattcagtattacaacccccaaagataaacaccttactgactgccttctccataaatttgcctgttcttgaatgttatatacgtatacttttttgtatctgttttctttcagtgaagattatgtctgtattatttactcatgttgggtgtagttgtttttttcatcgtcgtataatactccattgtgtgaatgtatcagtatatcctttattatttatttaaactgacttaaatgttttttgacactttggttatatttaagaagttgacttctctaatttccttgtcatgtttatttttaaatatctttctctttaaaagttgggatactataataaatattcagcaagtattttgtgtttaaatataaaatcttgttatttggattttaatactttatatatagtatttatatatataaacataaacaaaactaaagactctatgaaagaatcaaatggattttctataactgaaaatttcaatgactaaaattaagatattaccagataggtttaacagcaaattccataaagttggtaagaaaacaagaatactcaaaaaatggaaagaagtagaaaataaaaacactgagaagcatagaatgcaaatttagaaaagagcttaagagacatatcagacatggtaaaaggtttaacacacatataatcaaactttcctagctctgttcacggaaagggcctgggagctgcaacacctcaacagcaacaagcacacctgctacctagaacttggtttctaaaaaccatcctcctctaaaaggaaacagagctctttgaagaaacggtaatttcaaagctagagcacagaaagtataagatgagcccagaatatctttttgtacaagaaagtaaggcaatgctcaaagaatgatggagacatgcccaaaaaaagcagagaagccaacttgaaaagattccaacaggccaaatatggggcgatttgaacatcagaataaaatggtgacagtcacagaattataacccagtgaagaaaggaattcatgacatcatattaatataaataataattgaatattgaaattcgttaaaggaaatgagatatttatgtagtcttaaggtatcttctcacaaattatgtattacttacaaaggggaaaagtgcaccttgacgtgagaatcttggcagaactactttaatcaagaggtttagttgagcattatcagtaacagagtaaatcaaaatcataagccacttgatagatacaatgagaaaataaagcatcacttctgtgacaccctataaaaaatgaatctaataatgaggaaacatgagaaaaaaccaaactgagggatattctacaaataaattgtcctgtaatcttcaaaaatttcaaggttataaaagtcaagaaaaacagacaatcttttccaaactcaagggaactaaagaggcatgaaatctaaatgcttaattctggatttcatctttttgatataaagaacagtattgagactattgataaaatttgagtggggtctgaagattcattggtagtagtaagctcaatttaatttcctcactttgatcattgtactctggtttttagaatgttctagtcaacaggtaatatgaattaaactaatcgagggtgacagggcattatatcagccacttatcaacaaacatttcagagaaaaatagttccttgtattgttattgcaattttctttgagattgccccctccgaaacagtaagaactttcaaaaacaaacaaagatatcaagccacagattcaaagtgctataaactccacgcatgattagttctcactcataggtgggaattgaacaatgagaacacatggacacaggaaggggaacatcacacaccagggcctgttgtggggtagggggaggggggagggataacattaggagatatacctaatgttaaataacgagttaatgggtgcagcacaccaacatggcacatgtatacatatgtaactaaactgcacattgtgcacatgtaccctaaaacttaaagtataataaaaaaaaatcatacctagatatatcacaataaaacttgacctcagagtttctagctctcaagaccaattcctcccatcctgccactaacagatttctccaaacatctctgcacctcagagtgcaaatacaatcaaacatttcactccattgataggaagcatccttcactatcttctaccaagggcttcctcctttggtgcttcaaaattttttatgaaaggaacatccattttattcaaagcacctccaaacctgcaatcctaagttccaggcaactcaatcccaaaaatccactgtagatgcccaaaggctggggtgttcggtcttcaacatttttgcctttgtggctcccagtcaagatagagctgcaccaagtccaattccattcctcatcacagatgattttttctactttaagatcagaactatacaagcttcttgctttgtgtcagcatgctgttgtacccatgggcaaattcttaggtaagacaaaaacacagtcccaagggcaggtagtaattttttcagaaaaaggtaaggcaatcatttatctcagtctgcccaggacagtcccaatttacacatgtatattctcccaatctgtaggctgtcttttcattttgttgattatttcacttaattttttattatttatttattttatagagacagatctcattatgttgcccagggtgatccttgatctcctggcctcaagtgatcctccaaccttggtctcccaaagtgctgggattacagatgtgaactaccacacccagtcaacgtgcagaaggttttcagtttgatgtagtctgatgtagtctcatgtatttatccttcttgttgttgcctgagcttttggtgtgatatccaaaaatatcattgccaagatcaatatcaagaaactttccccctatgtttcttacagaaattttatggtttcagatttttcatccattttgagtatatttgtgtgtatgatgtaagataagggtccagtctccccagtgttggatatccaattttcataacaccatttattgaagagattattctttctccactgtgttttcttgatgtccttgtcaaaaattagttgacttttatatgcttgggtttatttctgggctctattctgtttcattgctttacatctctgttttcatgccagtgccacagtgttttgattactatagctttgtaatataatttgaaatcagaatgtgtaatacctataactttgttttttgctctaaagatttatttatttatttatttttgccatttcaggtcttttgtggtttcatatgaatttcagaattgtttttcctatttctgtgaaaaatgccattgacattttgatagggattgtgttgaatctatatattgctttggatagtatggatgttttaacactattaattgtcccaatccatgaacatgaaatatctttccattcacttgtgtcttcttcaatttctttcatcaatgttttatagttttcattgtgcagatctttcacttacctggttaaatttattcctacaatttcattctttttgatactagggtaaattgaattattttcttgatttctataaattatttcttataatactcatacttgtcaggcctctgggcccaagcctgcatgtatacatccagatggcctgaaataactgaagaatcacaaaagaagtgaaaatggccagttcctgccttaactggtgacattaccttgtgaaattccttctcctggctcagaagctcccccgctgagcaccttgtgacccccgtccctgcccaccagagaacaaccccctttgactgtaattgtccactacccacccaaatcctataaaacagccccacccgtctcccttcactgactcctttttcagactcagcctgcctgcacccaggtgaaataaacagccttgttgctcacacaaagcctgttggtggactctcttcacacagatgcgcgagacaatactaacactaatattattttgattcgtcagatggaaaagtaaggcttgaagaggttagaaataacttttccaaggtcacagagctaattgccacaactataactcagctctagtatgtgaacaaagatttttttataccaaaccaaaattatttatttctactccactattctatcatggtgcattttaggtgctaatgggaaaatctgctctatgatggtgtccaatagacaattaaaattcaaatctggaaatgagatctggactgaagatttttttaaaaattagccctcatcacatgtagtcagctgtagaaatccttagcatggctgaaatttttcatattaagacaagactagaacttggccaggtgtggtggctcacacctgtaatcccagcactttgggaggctgaggtgggtgaatcacctgaggtctggagtttgagaccagctgaccaacatggtgaaacaccatctctactaaaaatacaaaaaattagccaggcgtggttgcacatgcctgtaatcctagctacttgggaagctgaggtaggagaattgcttgaacccaggaggtggaggttgcagcaagctgagatcgtgccattgcactgcagtctgggcaaaaaaagcaaaactctgaagaaagagagagagagggagagagggagagagaaaggaagagacgatgagagacagagagaaggagagagaaagtacaaaagaacgaatgaacgaacaaactagaaatcgagcaggaaccttggaggacctattgcttaaggtgtgggccaaagaaagtaagttagggcaagagactaaggtatgccagagacccaggacaaaacacagtgcagagtgatgtcacagagccaaatgggagtgcaagctatggcaagccctcccaagtatgtgtgggttaaatgtaattaaattcaaaatctctcaacccaaaaattttctccacaaaggaagtagagaaacaaaacagttcattattgaataagcattaaaccagaatgtgatgtgtgaatataatggaatggaatggaatggaatggaatggaatggaatggaatggaatggagtggagtggaatggacccgaatggaatggaacggaacggaatggaatggaacgcactcgaatggaatggaacggacatgaatggaatggaatggaacggacacgaatggaacggaacggaacggaatggacttgagtgggatggaatggaattgaatggactctaatggaatggacatgaatggaatggaatggactcaattggaatgcagttgaattgaaaggatccaaaaggaatgcaatggaatgcattggaatggaatgcaatggacttgaatgggatggaatggaatggaatggactctaatggaacggaatggaatggaaccgaatggaatggaatggacttgaatggaatagaatggaatggaatggactcgaaagaaatgaaatggaatggattcaaatggaatggaatggacacaaatggaaccaaatggaatggaatggactcgaatggaatacaatggaatttaatggaatggactctaatggaatggaatggactagaatggaatagaacggaataggctcgaatggtatggaatgcaatggaatggactcgaatggaatagaacagaatagactagaatggtatggaatgcaatgtaatggactcgaatggaacggaatggaatggacaagaattgaattgaatggactggaatggaatggaatggactccaatggaatgtggtgggatggattcaaatggaatggaatggaattgagtggatttgaattgaatggaatggaatggtatggaatggaatggaatggaatgaaatggactagaatggaatggaatggactcgaatggaatggaatggaatgtacttgaattgtatggaacggaattgaatggactcgaaaggaatggaatggaatggaatggaatggaatggaatggaatggactcgaatggaatggaatggaatgaactccaatggaatggaatggactcgaatagaatggaatggaatggaaaggactcgagtgggatggaatggagtggaatggactcgaatgggatggaatggaatggaatggactcgaatggaatggaaccgaaaggaatggaacggaacggaacggaacgcaatggaatcgacccgaatggaatggaatggaatggaatggaatggaatgcaatggaatcgaatgggatggaatgtattggaatggactcgaatggcatggacaggagtggacccgaatgaaatggaatggaatggaatggtctcgagtggaatgggatgggatgggatgggatgcgatgggatgggatgggatgggatgggatgggatgggatggatttgaatggaatagaatggaatggaatggaatggaatggaatggaatggaatagactcgaaaggattggaatggaatggactcgaatggaatggaatggacatgaatggaacggaatggaatggaatgaactcgaatggaatacaatggaatttaatggaatggactctaatggaatggacttgaatggaatagaatggaagagactcgaatggaatggaatacaatggaatttaatggaatggactctaatggaatggacttgaatggaatagaatggaagagactcgaatggaatggaatgcaatggaatggactcgaatggaatggaatggaattgactcagatggaatggaatggaatggactcgaaaggattggaatggaatacaatggaatggtctcgaatggaatggaatggaatggactcgaatggaatggactgcaatggaatggactcaaatggaatggaatggaactgactcgaatggaattgaatggaatggacccgaatggaatggaatggactgggctcaaatggaatggaatggaaaagaatggaatggaatagaatggactggaatgtaatgagtttggaatggacttgaatgcaatggaatggaatggaatggaatggaatggactcaaatggaatagcatggaatggaatggactcaaatgcattggaatggaatggactcgaatggaatggaatggactcgaatggaatggagttgaatggactcatatggaatggaatggcattgaatggactcgaatggaatagaattataacagaatggaatgaacccgaatggaatggaatggaatggaatggaatggaatggaatggaatggaatggaatgaaaggtgctcgaatagaatggaatggaatggaatagaatggactcaaatggaatggaatataatggaatgggaatgggaatgggaatggaagggatgggatgggatgggatgtaatggaatggaatgcaatggaatggacacctatggaatgcagttgaattgaatggacccgaaagcaatggaatggaatgcaatgtactcgaatggaatggactcgaatggaatggaatgaactcgaatggaatggaatggaatggactcgaatggaatggaatggaatgcacccaaatggaattaaatgtaatggaatggacttgaatgaaatggcaagaatggactcgaatggaatggaatggaatggaatcgaatggaatcgaatggaatgacatggaatggattcgaatggaaagacatggaatggactcgattggaatgggttgggatggaatgatctagaatgtaatggaatggaatggactcaaatggaatagaatggaatagaatggactcgaatataatggaatgaaattggctcgaatggaatggaatggacttgaatggaatggaatggaatcgaatggaatggaatggaatggaatggaatggaatggaatggaatggaatggaatggactcgaatggaatggaaaggaatggactcaaatggaatagaatttaatggaattacaaaccacagtgatataacacacatgcatgaagatttctaacatgccatcctaaattaagtcactgtatcagtcagagtccaagtataggaaacagtcactacccatgcaaacctgaagagaccttcatacaagggagctgaggcagccgcagcctgcagctctgtcttctagtcttgcaggcattcatttagttagtggaagcatatctcctcccagagcccaggctgcaagagtctgaaatggagcttttagctttccagcctctgtatcaaaagggcacaccagaaagaggctagaatgaatggttgggcactaacaaatattttcacaacctaagcccatactcgcagttgtttgctgaacagacaatcaataaatcaaacagcccttccatgtagaaattaagaaggaaacacaacaccaaaactcattattaaatagcattttgtatttgaaaactcattattaaatagcaaataaattgcactaaaatacaaaattgtagaatttgtattctgggaagccacagtaacaaatccctgtgacagaacccacgaagtagaggtctcctgtgggaatgatgaccgaggccctcgccgctgctccacctgcccctccagggatgccctgcttttccagttgcccctactctgatgtgcatcatggcaggaaaaagtgggctgctgctttcctttaatgctttttgtcccactttattttttacttttgcctagtatatcttttcattcttttattttcaacttttgtaaatctctgttttaggtgggcttcttacgtacaacttggagttgggtttcactttttgattcaatctgaaatcttttacttttaccaaccttcaggttatgtgtataaagttatgtgtttacatgtatagatacaatgtttggtcttacttttatgacatgtttttgtagctttttgaaaaagtttgtgttctctctgtagttcttctgaaatttagaaatgtttgcactattttgtactaggggttacttttggaattttaactctatgtaattccctctccttcggaatcctcatacaacacatcttagcctgttagtttcctgttccacactgtgataaaactgtcattcatcttgctccttcttccttccatccctctcctctacaacttgattttagtgaataacatcttactgcctccctgtgattataggtgagacagtcaacaaacctctaaccaccgaccttttctcctctgccctccactcacactctgctccatcaccctcagccacacagctgacgctgtagagattcactgacatccagtctgatggacactgtttctccagccgaaactgctcatgagaacagtgtgtattccctgagttctcacatgatcaatagtgtttgtttgcagactggatacaaaagatggtttgactggacataaaattcatgggccatcctttcttcctggaggatcccataagtaaggattactccactatctgaagaatttggagaaatttgaagccaccctgatcttttccctccgtaagagatgacatgtttgtttacccattgggaggttcttgcttcatcttcagagtttaataattcctgtaggatatggcacactcataacctgttctcagtcaaccttccccagcataaaatttgccctctcacaatgtacacttccatctatttttacctgagcagaattttcctgaacattatctttaaatatttgttctgtccttttgttttgttttcctgtttgaagattccaatgataaatatgctggaacccctctccctgttctcttcagctgtaattttctttctagttccttttaaactcatgattacggtttcattcttattaattctctcattcgtatttttccatcaccttttttgtgtttcccaaaacatctgtcttctcctgggcccttccaatcgcaccttcacctctgtggtggttctcctggctgctgccatcctttcttctgccaacttgactttgtctcctgctgtctcacttggttgtacaggttgagcatccctaattccaaaatccagaatcctccaaactccggaactttttgagcatggacatgatgccacaagtggaaaattccatacttgacctcatgtgatgggttgaacaaaattattaaaaatactgtataaaattaccttcaggttatatgtataaggtgtatgtgaaacatacatgaatttcgtgtttaagcttgtatcccaagttatctcattatgtatacgtaaatattccaaaatctgaaaaaatccaaaatctaaaacacttccagttctaagcatttgggataagggatactcaacctcattaaaatctcttttctgttttgtggcattcctgcactgggatcttctgccacagaactgcttcatgagtttcctgtttttttcatttatgatgaactgtctggtcatgattccatcctgcttcacagacacatttcccacaatttccttagagaatatccatgcagtgatggtcaccttctctaacaggcatttcagagtgaggtgggacgttctagggcacctgttttgcagatgccctcagggtgggggaagggcagcttccagccttcccagttccagcactctctcccccagccgctacctgcatgtgaatccctgggagaccccacagcccatgtctctgagtaaaactggatccaggaagccctttgctttcagtggtcctccctggaacttctgcactctgcaagctggagttgaacatctgcgactcagcctctcagtgcacagggtatgtggggctcgacttctagacctggccctgacgagtgcttttgttagcctgagcccttctgctcagttccgcctatactatcgctgcccaggcttagctgcttttggtaagcctcatgcacattttagagtctgtgaattgcatctgcctcttatttctctgaaaatggagtttttcatcccttccttccaattctccttccagcctttcttgatttccagaatgagaaatcattaagtcatatactgagccacaaataacattataaatgtgacaattacatgataatctttggggggaaaacattctgtgatttctaacatatttacataaaaatatcttacactaaaacacaccagttgagggcactggccagagataagattaggttaaggccaagcaaagctgagaagaccattgttaaaatttcaatcctgttcctttatcttttcaaattaactgaatattgttattaaatttcttgttttagtgtcgaatagcaccttttccctgcctcactttagaatcaatttagagacaaaggattcaggccaactgaggtcatcagcattatcgctaataatagctggactggcggatgcgattcagattcacacaacaatggatttcctaatctgaatcctagactgagatgaagccagccagccgtaagcattgcttaataaccaaagcctccccagataggcttcttgccctacagcactgaagacatgaaagaaacagaccaaaatgtacaaatatcttttattcctcaaaggaaaaagaagagttacacatgcctgtttctcaccaataagaggggtcagggcagagtgagtctgggagagagagttctaccaccacggttcccaaagcatcgtctaggggcctgttaggggagcccgaggtctaaactatttccacagtttcactaagataagattttccttttccatcctcacattcgttagtgtgcagtgaagtgctccagaggccccagcatgctacattacagaagactgaactcaggagagatgaggaataatcccctccatcacaccagacaccaggagggtgtgccaaggtgtgagacatacagtccttactctttttttgttttgttttgttttgtgagacggagtttcacttttgtcccccaggctggagtgcaatggcccgatctcggctcactgcaacctctgcttcctgggttcaagcgattctccagcctcagcttcccgagcagctggcattacaggtgcatgccaccatgcccggctaattttctgtatgcctggctaagttctgtatttttagtagagacaggtttcaccatgttggccgggctggtctcaaactcctgatctcaggtgatccacccacctcggcctcccaaagtgctgggattataggcgtgagccactgcacccagcccagtccttacttttaaataaatggagaaatattttaaaaattgttttaatttctaatgtggcaaacattaatagatataactcacatgaccaaaatctctttggggtcctcagtaattttaaaaagtgaaaaggacccctgagacaacatttgggtttggaactgctgctccactaggggaagagataccagaacagagaatatgtgttccctgggagataaggccttcccgactacctcccctcctatcatcgaaataagttttctacatttctttaatatcatgttttaaaattccttttaaaagactgaaatcatcagcagaaggcacgggattagcttagcacagtcagtttagactagttacccacaggggactacagaatggacatcacgaggcatacataagcatagaggtgagaagggccgtgttcacagttgacaagattacatttcaggttaaactggtaactaagataacagggaaaaagacaattaacaaagaaactgtaatcgtccataagcctaattagccataaagcaaagtctgttgggaatttaatgaacatttgttaaaaacacaaatattataggaagttttttatacagtcatgggtcgcttaacaagggggatacaatctgatccgagaaatgcattgctaggtaatttcctcattgtgtgaacatcacagagtgtattacacaacacctacacagctaggctacagacctatacaacatattaatgcactgaacagcaactgtaacataatggcaactatctgtgtatctaaatatatctaaacataggaaacgtacagtaaaaaaaggaaacaatcttatgtggccactacactacacgcggtcggtcattgaccaaaacatcgttatgtagtgcatgactgcatatctcctcaaatctgacaattctaaacaagtaaagatgtggaagaattagataaacagaaagaaagtacatccttcaaatagagaatctgtatttttttcacacatcaatagaatatttacaaaaatcaattataaagaaggccacaaaggaaaacttaatcatttcaaagaattagagatcttaaaggccaaactctctggtggtaatataataaaactagaattcaataaagttaaataaaatcacagctatttgaaattcgaagtccacttctgaacacccttggatctgggagcaaattggcactgcatgtgtgcctgggctcctgaagggcctcacatacatggggaagggcagagaaagagaaacaacaacatccactacctctatttttaaagtcagccttactacaaaatacagaaagtattcttcactgggcagaccaaatcaactttgctcaatcttcgcctttgggttcctttaggtttataatgaactgtaagcatttactgagtgattattataaaggcaccatttgaagtacctgatgcccttttaatgctgtaatgcccctgtgaagtaggtcttactattatccctgctctagagatgagaaaactgaggcagggagagatgaagaagctggccccaaggccacaccactgaggagggaggggccagacctggagagcagggggatcccacaatctgtgcttgtgccttcctgctctgctgcttcccagctagcgtgtgtgctggacacagccctcagtgatctcaactttgattatctaattttaaaaagacttctcaagtttattgtcttttacaaaaaagggatgtaatctagcaagccaaagcagaaccaagcagactttgtagttttcatcaattttctggacgctccagccactttcctcaggtcctttagcaatgtgtggactgcccgcccaccgctgccccgaggtagggaagcaccacactacaacctcatgcaggctggattaaaacatgccctccacttcaggcttaggaaccagcgcccctcctacagctcacaagttgctcaagcagtggtctgtgagaagtgattctatttttggggttgtcccttttctctgcttttcttgggaaccattttgactctgtcaaatgttcactgacttctagcactggcagaaagaacgtctgcttttttatctgaaactgaactgttacacaacttataattttattttggtaaaagcattcttagttgctgtgtttagtcatactctacaaattatcttgttggtaggataaatatggtgagaattaaagaaaaatgaagatggtagtggacatttgcagactattatcaataccggcatttcaaacttccaatataattcggatacttgcctggaggacaaactttttttggcatgccgtataatgaggagccttatattcccagtgtgctcaaactgccctgacaccacctatccaccgtcgtcagcaatctatgttcaatgtttcttaaaaacatcagttacaaggtcaaatttaattcaactgaggtcagactctcaggggagctgaggagcacttccttcaatggaaatggccatttctgagtggtgacaacactgtcatttcttggaccttctttaacaaatctgttctcaggagcattaacatactttgctaatacattttaatctggcatttttatgggggtaattataggaaatgcctggaattaaatagcctacaaccaattcttggatcaacaactaggaaaactgaaaaatatatatgtaaatatatctttttctgtgtaagaaaagtcctgctaacttaggaaattagaggatatctttgtgtagaatctttttataaagtggaaataggccaggcatggtggctaacgcctgcaatcccagcactttgggaggccgaggcagccagatcacctgaggtcaggagttcaagaccagcctgacccatatggcaaaaccccctctctactaaaaatacaaaaattagccaggtgtggtggcaggtgcctgaaatcccagctactcgggaagctgaggcaggagaatcacttgaacccggggggcggagattgcagtgggccaagattacaccactgcactccagcctgggcgacaaagcgactctgtctcagaaaaatacaaaataaaaaaataaagtggaaataacttcctctgcttctaactatgcagtttgcttggaaaaaaaaaaaaaagtaacctgtaggtgtagtacaactatcagcacaaatgtaattatcttagagtatcttaatagttcctacttcaagtagaacttatgaaggagtttaactgtggtaaaaaaaaaaataattggagtaacttagaaaacatttatatatacaatagttggtttgtatgctcagtcactcattcattttaggaataacaagtgcctactacttgccaggtgcttgggatatagcagggcctactgaataaattattatacaacagtaaattagcattggattgtgttgcttaaaacaacactcaccagagcaaacaaaagcctgattagcaatatgatctgaaattttaaaaacagcccttttcaacagttccatctaatttgccaggtcattattttataatgtcatatgggattgctgggtcaaatagtatttctggttctagatccttgaggaatcaccacactgtcttccacaatggttgaacttatactcccaccaacagtgtaaaagcattcctatttctccatgtcctctccagcatctgttgtttcctgactttttaatgatagccattctaactggtgtgagatgatatctcattgtggtttttatttgcatttctctaatgaccagagatgagctttttttcatgtttgttggctgcataaatttcttcttttgagaagtgtctgttcatatcctttacccactttttgatggggttgtttttttcttgtaaatttgtttaagttctttgtagattctggatgttagccctttgtcagatggatagattgcaaaaattttctcccattctgtaggttgcctcttcgctctgatgatagtttcttttgctatgcagaagctctttagtttaattagatcccatttgtcaattttggcttttgttgccattgctttcggtgttttagacatcaagtctttgcccgtgcctatgtcctgaatggtattgcctagcttttcttgtagggtttttatggttttaggtcttatgtttaagtctttaatccatcttgagttaatttttgtataaaggtgtaaggaagtggtccagtttcagttttttgcatatggctagccagttttcccaacaccatttattaaatagggaaccctttccccattgcttgtttttctcaggtttgtgaaagatcagatggttgtagatgtgtggcgttatttctgaggcctctgttctgttccattggtctatatatctgttttggtgccagtatcatgctgttttggttactgtagccttgtaatatagtctgaagtcaggtagtatgatgaaaagattataaatcattctactataaagacacacgcacacgtatgtttattgcagcactgttcacaatagcaaagacttggaaccaacccaaatgcccatcagtgatagactggataaagaaaatgtggcacatatacaccatggaatactatgcagtcataaaaaaggatgagttcatgtcctttgcaaggacgtggatgaagctggaaaccattattctcagcaaactaacacgagaacagaaaaccaaacaccacatgttcttattcataagtgggagccgaacaatgagaacacatgggcacagggaggggaacatcacacaccagggcctgtcggggggtggggggctaggggacggatagcattaggagaaatacctaatgtagatgacgggttgatgggtgcagcaaaccaccatggcatgtgtatacctatgtaacaaacctgcacattgagcatatgtataccagaacttaaaagtataatttaaaaaattttttaaaaagtcatatgatgcatttaagaaagtcacttaatttacatcagaggaaaatcaaagtttatagacttaggaaataaagtcgtaatgaagaagctcttcacggctgtcaggacagctacgtttttggtctctgtccttgattccattgtgaccttcagcccatctctctgggccccattttcttgtctttacctcttgggtcataaatggatctccatgcagctgatatccctctgcctaaatcctcctcaaaagaaaatcaaaatagtggctaacacagagtacagactgttccaagagcttcctatgatggaactaatctaatctttataacagtgctctgaggtagatgctaaaatctaccagatactatggatgagatgatgaagtcatatgcttgagatccctgagtaaataaataagaaagagacagaattccaacagcggccgtgtggctgcagagcctctctccctccctgcctcaccctcgagtccccgcctgggagggctcagggtcactcactaagcatctttcccatgcgctgctgtgaggctgctgctattaacttgctactatggagtagtcattagtagaaattatgaaaaaatttgaaaaaaaatcttcatatagccagagattctagcctgagatgtctttccttatttgcttattattatttgtaaaaacagggtctccctatgttgcccaggctggcctcaaactcctgggctcaagttatcctcctgcctcggcctcccaaaatgctgggattgcaggcatgagtgaccgcacctggccacctttccacatttaagagatccctgggatactgcgaagcaggagtccatctccagacatgaggagcaggtgggctaaaggaaacaggactggggagtcttggaggggcagagcaatgcccagggacacagaaacttttgaataaagacaagagagaccgactcttcgcctacatctaaagcaaatgaaaacataaaaataaatgatggcaagaaactaaactaaaaatacactacccctgaaagtatgtgacactggatgtactatctaattggtctgccacaggtagagaatgaagtacttcagataagttaatttatcaaataactaaaattagatatataaactttacgattctgaaaacttttttcctacagatgtgtgtactttaggaaacacagcatatttaacatttttataaatttcagttgcacaccgtgcagctttcaggaagctttcacaccgtgcactgccctgcatgcacctcccaagcctcgggctgttcatgcctggctgtcagaagtcacctcctggctgccagaggggcgagggggcaggctgttcttctcagtgctataagcaagcccaggactccaagggaatgataacaaatgtgtaaaaaccacagtcacattaacctataggctcaggacccagttctacttcctccagacagcttttgggtactggtctccctctctgtgtttacagccgtcctgggtttgctgggcacctccgagttcatggaagtgcagctcctcactgcagttgggacacactccactttgacaaagggggtgttattttcagcagtgggtgaacagcagtgaacaaaccaagcccctgctcctggggctcaactgggatggggacgcagacaacttaaacacgtgaccactggcgtacctaagggccagggaatgctgctgacatgatgggggtggcgaggccaaggtcccagccaggtaggcttgagttggtattgctacaaccttgtgatcactggcaaacaagatttcatggtgggagtgtgactagaactggatttcaaagtttcttgaaagcactagttagaaaagacaaggtacattgatctgcacacaggaggtgctcagcgacgccagcactgatgggctcctcctgccttgagtgaagagcatctgcccctggacagtgaacaaaaggtggggccattttatgcctccaacaagacatctggctcaaactcaacttcaaagattagagtaaaaacgaaacttccattccaaactacttatctttattttggcaactggaacaatctgtaattgaacactaaattctattactaacttttatcctaagactgtgtagtaattattgattagtctccgtttaaagttgctgtttagatggaaaaaatgattttacataaaacattagttgaaagatacaggctgggcatggtggctcacacctgtaatcccaacactttgggaggccgaggcaggtggatcacttgaggtcaggagttcaagaccagcctggccaaaatggcgaaaccccatctctactaaaaatacaaaaaagaattagccaggcatcgtggtgcatgcctgcaatcccagctactcaggaggctgaggtaggagaatcactggaacccaggaagcagagggtgcagtgagcagagatcgtgccactgcactccaccctgggcaacagagtgagactccatctaaaaaaaaaaaagatacacattaagtttttcacacaaattcttaagggcagatattactaaatgccattagaaaaaaaggaaaccttttatcaagcattttttaaaaatgcttctacatttcttatttataggtattctaataatactgcgtgacattacggacaacttagcctaaattatggaaaatcaaattatttagtagaactgcaagacaatcctctcagttgttgtagtaagtgttgctataaacatttaaaacagcaaaaaaataccaaatacctgcacagtatgtatgataaatgcatatgataaagtaaaaaaaaaaatagcacacactgaaagaaagccaacagaagagggcactgggcatgggccagggagggcaagaattgggatggggacatggaggagcccaatccaaggcaagacacaggttcaggctttaccacagtcacaaaggctgcttcttgtttttgtttttagcagaaggtaagcatgagcaaattactttttagaggtaactttgctgaacttgtgaagaatggtgtgcaaggtccagagcgactgcaggagagggaaggtgggattcccacagagcaggagcacagataagccaagcaaggccctgcttggaaggcagcaatcaacagagatgcacagacctgtgagggtgccgggacagccatgcaacaatgcagcccttttgcttcctgagctcaccagttccctcgctccacctctgagaggtggtttggagaaacacagcccttctcaagagggctgcaaggtaagtttagttggtacatgagtgcacagcacattttaatttttatagttatgcatttattttatatgtactagacaaacgaccgacagaaaatttaccatttcacaggtattagtgtttaggatgaggctaaagtaggtatttctgtttaaaaaagtaaatttgaagaaaagctacccagcaaattatagtagtatgtggtacacagacaaaaaaaaaattatgcagtcgtccaaatgactgaaactgataaaatgctggtcctggtctatggattccccctctgacaaagcacagaatactcgcaccttctccagagtcagtgaccaaagatgagagagcagggcacccagcacagaaaccaccaggagccaatgacttcctcctgtgctccatcctactctctcactcacaccaggaattaaatccttttatgtagacagatggtcaagaattgctactataaagcaactcagtatggtctgaactatcagagagctacatggagaaatagctactgctaaacagacctctctgctgatgtttttcccagctacttaagtcctgaaaatttccacaaggctgagtcaaatctgcgtttcatcatctataagaaaggtacctatcgagaacaccctgctggccagtgtgtaaatatctaaaggaggactcagaaaacaccggggaagtccagcctgcacgtggtggctgggcttcagtgaagcatgcagcacaacaggagttgtaagtagtagttacatcagcagccctggaaattctgctcagaaccaaactgaacaaataacattatctaaggcttacaattatttaactccctaaattttctgtcctcccagtagcactttcaaatgcctaaaagcaattaaaagaaacatttttccaatgtctcacagaaccattagaaacacaaaattaatagcttcataaactatagcttctattttatccataatagaatgaaggtgcataaaccacatagtaattaatctttggacaaaagcaaacaataaatggaatatatggctaagatcctttctttttgagtgtggcccaagataaaaatttcttccaaaagggtaacattaatgcaataaggcttttgtggaattctattttgtacgaaattcctgttttctattagctacttcttcctctgtgacacaagcctcattccttgtgaaaaacacgaagcagaaaacattcgtgaaatcatcaggtaaagatcccatgaccgttctatcactgacacagtatgtaggtacatggtacaacccccaagggaccaccttgtggcatcctcagcaaccacagagccacagggcagatgagtgtttgctcccactgaggctctgcaacctctgccaccaatactggagaaatcctccaacctcactgttttctcctgaacttgttcccttctgtttttcgattaatacacagcaaacaggcacaccttcaagctgccaaaagcatcttaaacgttgtacacttacaatcttcaaaatatagttgttcaaaagagtcatcaaagtagtttttgaaatagaacacttactttgaccacataattgaaccttcggatatcttgaattgcacttgagaagtctaaccgattaaaggcttctcccaaggtgcaatagccatgcctctggaagagcaacacagaatttaaaattagtcaattagccaaaaagaattggcagttaatgtcaattaattgtgcgattaaaaaaatttttggcaaaggacaatttgtttttattttgaagactgattttagatttagatgagagtatagtaaaattgtagcaatgctaataatttaagctgtttatgtatacctgagacaccattaactgacattttttacaacctgctgaagtaatgacaaagacaaatatttattaaatatcttgctggtttgttttgttggggacaaactggggtgtggacgatgttaaagctaagatcataaaaaaactggattcattctaggctacgcaactaaaaatacataaatcatctgattaactgcattgtaaggatgtaggtgttacaaatatctagttgaaacacaggatttctctgcaggggaggcatgcactgcccgagtttgaagtgtaacatgggatttctctccagagcagccatgcactgcccaggctggaagtatgctcaaccacaagggtcagggctgggagaggcgcttcggtagcaagaaggtgcctctgaaaaccagcattgggatggagagggctgaaggcaagtgctggatgtgaccacgggcagctttcaggctgggagcacggatgccaagaacccaaaacaccaaaaaaactggtgcttagacccacaggtccaagaaccgaaggaagaaaatgaaacaatttattttcagtactgtaaacactgctgctattctcttagatgtttttcttccatgatatacccttatcctgtattggtttgtatagattagcacattaggtttcagaagtcattttaaactccatcttcatcctccatatttgaaatatttaaaatctacagattttcaggtcaaagttgtagagataagtaagctagaaaacaataatagaaaacatgagacgattggtctcaaattccaaacaggtgacttgagatgtcctagagaaagcagctggagccatagcacctttgtctctaacagccgatacactcagaggctcatgtgcttctgtgcgccaaccccaatcgccctgacgggtgcacaactcaactaaatatactcatttaaaacatccaaatatgttgactgagtgcctgctatgtggaaaacattttcctgggaactctggggaaaggaaacactcattttgatatagattataatctgaaatccatcacagctgatattccacacgatggtgtagcagacactttccaaggtcaccacccatctcacaaaaggaaattaaatctgattcacagagcagaccacaaagagcatgtctggacctagaaccacagcatgtaacctcggaagcagtgagacaccagccagcatggacaagcagcaggcacttgctctataccaggtgagggtgtggagacatgacgtggtgcagggacaccagcacccagtcctagttctggtccctctcagccttgttaggtcctggttcctaagattccagggaacatccccacagcctcacaataagatcctcctttcctgcatatgctagcttggatgggatcctctgttctgtaatcagtatggcaacagagcagatgaaatatttaatggtctttcatgagcactaaattttgttttttacaaactaggttagattctgtcaaataatcgtctaatggtgtattcgagtgtatattaaggatctgattcattctatacccactaaccataaccaaacagattaagttttctttctcagaatctaatccttcagtttcttggaagctggactagtttcagagcatctacaaacatttctggaatatttaacttaccctgaaataacagacgatagacagtaattccctaaattattttccccagttgttgcaaaataaagcaaatgcagagtttctaggactataaaaggaactcaacttcccggatcctagtaaagaaacaggaaacagcttgaagctctctggtttgttttatggctcatgaaaaagctttagcccaacttggcaaaagaaaggcagggaaagagttcatatggctctgcacaaacccaacccaattactaatttcatgttagccactctttatgtggaatgagagggctcacagatgccctgccctccaaaacacgccacagggaggacacattcccatcagcatcaggggttcatgctaacacagagaaaatgcgtatgactgcaggagtccatgcttggtttaaatagccctgctgttgactcagatatgtacaggtaggcaggaaccacacactgtacacatataccacatgccaccacacaccatacatcccacagaccaatgtgtgcataaatacatgcacaaccatacatacacaccatacatacaacacacatacaccatacacacaacacacaccaatgtgtgcacaaatacacagccacataccacatgcacatgcaagcacacacaatggagaatcactgcctcaaaagctcctcatatgctattatctgtcagaatgtgaaccatagatctgatattgcaaaagaaatgtgttttatgcaactttattaatacatttatttaatgtgactccatattcaacagaaacaatccaagatactctcttatttataatagaatacttacttcttttgtgctttctttatggacatagatccatttttcatgataaaaacctagaataaaaattacctttgtttttaaaatctggcaaatcatttcaaaatgaagattttaaaggaatttaaataattggacatattaacaaaattatctgacttactatattgacaagaaatgcttttacttggttgaatgcaaacagaattgctttgtttcttaaatcagtttaagatatgaacaatgatttcagacagtaccaagtcctagtaacttagaagaaaattagtattattaatgactgaagccatatgaagacataaatgattataaaatgcaattacattactacattcctatgtaccctaataaaaagttctattcttctgttgctgtgtatagtactccatagaaacaaatttttcagataaatcttaaaagtttcaagaatcacactaactgtattctccatgtgaccctatcttcttcataaagtagtccccccgtattcacagtttcatcttctacagtttcaattacccacagtcagctttggtttgaaaacattaagtggaaaattccagaaataaaccattcataagttttaaattgtgtgccattctgggtggtgtcatgaaatctcacaccgtcctgctctgtcctgcctgggatgcaaatcctccctttgtcaagcgagtcctacactacccgccccttggtcactcagtagccgtcttggttatcggatcacctgttgagatatcacagtgcttgtgtttaaagaacccttattgcacttcataatagccccaaagtgcaagagcagtgatggtggccatcttgctataactgtttcattttattattattctcgttaatctcttactgcacctaatttataaattaaactttattataagtgtgtatatacagaaaaaaaaacatagtatccataaggtttggtagtatccacagtttcaggcatccactggaggtctatcccctgaggtaaggaagcctactatacattaacatgtgtcttggtaactcacagatatgctgcatgatagaacgctatgccctctcacagataggtcccacctccagccttcccctgctgccatctaacatcctaaactccagctctgaatgtctgtctcctgctctgaatcttcagtgacttcgaaactcaagtcaggacacctctcagtttggcctcactgctcaagattgagctgaattcatgaccataattcaagcattcagattcatgggctgttttgtgggttttgctatctcttattttgtttttgcacatcttacccactgaaacgttgggctgcaaaaagtttgatcactaaatatgtaggcaatgctggatactgggctgttatttacatatttgtatcaccttttatttcataagatagcattgtcagagtaatttagtatttcaacataatcaacaagtaaaataaaattaatgagaatgatcttactttgagtatttgtgtcatttctaaaatggtcctttttcctttttttggatgcatattcatgctcttcattattgactatttctccatcttcactatttaagatactgaaataaagacatattctattaaaatattttttcagggagatcttcatttggcttttcttttgtaaaaggatacaaatacttcaaagtgacagactgtgggcttgaaatcacaggggtaatgtctaatacatttttgtttcattttgagaaataagatgtatcctggttctttgagaatattgtaccagaaagtgctgaacatgttttagaatctctgaagggtcttgatatgcttatccaaggtagtttcaaacatcaaaatggcttattaaaacagagatttttttaaaaaacaactattaaaactccagaaaaaagatggtaagaacatgatgatacccaatactgaccaatgacttgatgtgtcccttaccccatgctgagtaaccactcaacatttctgtttactccctatatgtttaagggtttaactgaagttaattattactgcactgaacatgtttttattaagcaccaaccacatacactgttaacacatttaactggaaccaggtgaagtgacatgtatatttttactatttaaatacgtttaattaaaagctgttctttgtgaaacaagaaaatcaaatcataaggcaataactaaacaatgggaacaccttttactttttaaaaaaatgtcttccttacagaaaaaaaaaacctgtaaatagtaatccacatcctcaaaactaaagatgtgtaaaatttttattttccacacactgataacagattttcagtgtaaagtgaggaaggaagctctgtggagacaagctggttggtggaggcatgcaagagtggtgctcaaatccaaggaactaaaattgcttatttgccggtcatcgttctttgacaagaaaattgtatacaagcccctttccactcaccactattcacttttagtaaaaaacagctgactttgccaaatgagtcactttctcactgtcagaacagacttaaacagcagtgccaacagttgtaaatcatcaagacaagcaaagcacatttgaaaaacatacaaacaactgaactttttgtggcagacattataacagcaatttatggaaatgtgttgatttatggaaatgtgtttgtattttatatttagtcttacaccagtttgttatcattgattgaaatactgaatgtagaagctttagaatctaaaagggttttctaacgaaaattacaaacatatcaaaggaaaagcacaaatacaatgttctccagaaatagtgtcgcagaaataaagacagaatatggaaggagacaggattgctgactaatctcatatgtacagggagaacgacactccatgcagcttagctccaacatgtgagcgtgggacagaaaagcaaggtgaacctaaagacatcccatggacacactgagctggaaccaactctgcccataggtggtggggccaggttcagatgcttgcagtaaccgcatcctcctgtgaatctgggtctacatggctgtggctccctgggggctacccacactgtggattccacaggtggaggtgaccttcttgggcactgctgggacacttcctgggcctgcctgggcagtggtagggctcagagaacttcagcgttagggccttggggagtctatgtcagacttgaggaccaagcctgggctcacaaatgacaactaggctactatttttacaaagtattttaaatggggaaaaagccattattttttggttgtgggttttacactgtcaggtaaacaaaaatgtacaagtagagaagaaagatgaatgcttctgaaatttaaatttgacacattaaaatgttaataaaggagtatttaatttataaatctttctattctgcatgtgtcaactacatttcatagcaatcaactacatgtcatagcaaacatgttctctttttataaccttcaagacaaacatcacctactctgacttaaaaacaagggaacctgtccaacaacttgattaaaaaatgtcaaacaacttcaacagacacttctccaaagaagagacacagcagccaacaagcccatgaaaagatgctccacatcacgaattgttaggtaaatgcaaattaacactacaatgagatactacctcacgctcattatgaggctactggcaaattaaaaaaaaaaaaagaaagtttaacaagtattgacatggatgtggggaaactggatccttcgtgcaatgttggtggaaatggaggatggtatagctactataggaaacagtatggaggttcttcaaaaaattaaacacagaattaccatatgatccagcaattccacttctgggtatatattcaaaagaactgaaagcagagaatgaaagatacttgtatacccacattcatagcagtattacttgcaacagataaacatggaagcaacccacatgtccatcagtggatgaatagataagcaaaatgtggtgtacactatacacaatatggaatattattcagtctgaaaaaggaaatgctgacacatgctacaatagggctgaaacttgaggacgttacgctgagataagacagtcacaaaaggacacatactgtctgatttgacttatgtgaggtactcagaaaagtcaaatcatacagacagaaaacagaaagccagttaccaggtctgggggtgctggagaatgaaaagttagcgtttaatggggacagagtttcagtgtgggaagatgtaaaagttctagagaaggatggtggtaatggttgcacaataatgtgaatgtacttaacaccactgaactgtacatttaaaaatggttaggaaggcaattttatgttatgtgtattttgctgcaattaaagataaacagtgtgcaagagaggagaggaagtagcagcttgtcttgttcatgctgtctgaggtgcatgtcggagggatggggtgggggcgggaagtgttaaaaacaaagaatagaacgttatacaacacaagcggaaaacacagggcacaaacgcacttgtataaaacacagagtttccataaacttaaaacatgtctgaatgatggagctaacagcccttaactccccacacccaggctgcaccacagcatatgtcacccccttgcttgcaaatgtgcccaaaaggcaatgacattccaagtttcctctgacaagcccaaggacagggcatgagttttccaagttcctttccattcaagaaaaggaagagaagagaatagagaagaatcaacaaaacaactccaaatagaagtaaacgagagccaagaacggaactatttctcataattaaaccccaatttctataaattacaatcctcattctagtgatgacctataataagatttgcattttcctctgatggtatttcccttaagagatggataacaaggtcttaatcttcatctcccagaccactctagggttctaagcacaggctttacagaaatgtgctgttatgggccatcatcttcaaatcatttccacacaagtctaggaaaataagacaggctaggataagcctccagtttttaaaattgctaatcaagggcatcagttcttaactatattgctgtaagatatgtcacaaaacttttgttaccagtaagaaaaatgaccaacatttgtgaatgatttaatttttaataattattaaagtactacactacacataataaaaaataatacatactcataaactcaacttccctgagttgccagtaggaagcaaccctgccgagcccttgattttggatttctggcctccagaattgtgaggacatacatttctgtggttttaagccaccgagtttgtggttatggaatcccagaaaatgaataaaattatctatcttttcaagctacttcagtttgatattgattatgaaaggtacatatatgctatcaaacagaagagactttagggagaaaaaatctcgcataaatgcaacaagttgccatgactctaagtgccaaggtcatataacatgcagactgtgataatttcaccaaaaccaaaacaaagtggaacaaatcctcagacacagttgctgataattcccaccctggcctcctctgacatttcctttcgatcaatttggctgcacctcttctgtcaagcaggagctggacgacattttggtcagctcctccccagaagggagctacaatctctgctctaacaatccccagttgttgtcttaagtcacactgtgttcatcaatggctacctactaaacttagctttttatctgtacattttccaatcaggtcgtattattttctcctggtaggcaaatgtttacgtttatccattttcctgatataaagctacttcgtatcagtgtgttattagtctctaattataagaagataatccagaagagaaagtccagtcaattttatataagttaaaaaaaagatgtgaaacctattttcagaattaacatttccttcctaaacatctaacacgacacacttacggactcttaacacacccttattacatgaaggagcagcagagcagagggcggcaagagcaccaaggccaggtggagccacagccaatgtgggcccatctcactccgcagggagaagcaactgcactgtgcacagagtgcaatctggcagaagggaaacgccgtcttaaagagcttcagatgcagcaaccttgaggaagggctgtgccagaaagtccaccagatgaggccgcaaacctatcaaagggcatcagacactctgtgcacagggtacacaaaacaatgcctcccacattctgtgacttcctgcgcgtgccacttggaccaccacactccctacctgcaccatcttacctggacagactaaatctcagccacctcatgactaggatattaacatggcttccagttctataaattcctcccccttaagaatgcatgtctgtaaaatcagaaatgatgaaaactggactcgtgagtggctttgtagtagggattacaggtccagaatagaataggttcagtaacatatttaagatatttaagggaaaaaatataagccaaagatttaacatctaaatagtgactatcaagggtaaaagtcacacatattttttatgagtacacacaaacacaggaagtacggtgaccaggagctgagggatgacccactaaagaataagctccggaaaccaaaatgactagaggcagatgcaaaggtgagctgcaggtggtctgtatttatctgtggagctgctggcacatgacggtgataaaagtgcagcatgccatggttaccagcttggacaatgcagacaaagaacaaccaccagagaagtggtaggggcgggcagaagatgtgcaggggccaactgggactggggtgtccatcagctaactgcagtatcaggtactatggggagccaaccaaagaaactaagtgtttgctataaaggcattaggataaaagtggaaaaaaaagaggaagaaagccctcttaaataccaaaagggtaaaagcaaataaaatagaacaaggtggttccctgttatctgtgatgtaaaaaatggacttggctcacctattaaatggaaaacagtcttggattggctcacaaagcaaaatcaaacaccatactgcatataagatatacagctataaaaggctgggaaaatatatagagaatttataggactcagaaaaaaagtaactgtcacaggaaactttatagcattaaatacctatatcaatacaaatttaaataataaaaataaattatttaaacatataactgaaaaagccagaaaaagaataagtgaaccaaaagaaaggggtgaattattacaaataaaagcagatattattaagtagaaaaagaatagaactaagaagtaaatccaaaagctggctctcaagagaaaataatcaaccaaaacaaaccactaggtatctgattagaaaaaaaaaaaaataagaaagttacaagtgctaacagaagaaaatttaaacattgtaaaagataaggaaaagaaagagatagagagaaaaacgtgtagattaaaagagactttaaaaacatatcaaattttaagaataaaacaacactaaactatagtgtctagggatatacacttggtgataaaactataaagattagggaaatgattaccataagagtttgggaagtggttatttttggggagaggaagtaggttataatagaaatgggacatgtggtgggcgcttctgggatgattgataaagttctattccttgacctgggtgtggttacaaggatgtttcctttataaaaatgaagaaaaacattaaaaaatcattacaggcaactttataaaactctttgcagtaagttagaagtagatgaaacattttttaaaaatattaaatttaatgctattccaatacaaaatcaagtttttttcttagagctaaacaagttaattataaaatgcatttaagaacaagaagaaactatcctaaaattcatatggaatgaaaagagagcccaaatagccaaagcaatcctaagcaaaaagaacaaagccagaggcatcacactactcaacttcaaactatactatacagccccagtaaccaaaacagcttctgtactggtacaaaaacagactcatagaccaatgaacagaacagaaaactcagaaataaagccacacacctacaaccatccaatctttgacaaggccagcaaaagcagcagtggaaaaagaccatactattcaatatatggtgttggaataactggctagccacatacagaagactgaagccagacccctacctttcaccatatacaaaaattaactcaaaatatattaaagatttcaatgtaagacctcaaactgtaagatcctggaagataacctaggaaatactcttcttgacgttggccttggcaaagaatttttggctaagttcccaaaaacgattgcaacaaaacaaaattggcaagtagaatttaactaaatgaaagagcttctgcacagcaagagaaacgtttgacagagaatacagacaacctactgaatgagagaaactatttgcaaactatgcatctgacaaaggcctaatatccagaatctacagggaacttatgcaaaaaacgttcactttctgtctgtgttcacgtcaccaagagaatagaaaggaaaagggaagaatgcaaaagtcaaagacacgtcaccctccttgagacagccctccagtccaggccaaatctcagcctgcccttggtccgctgtggttgggcctgcacccaagccatgagcacacgcagcaattgtggcagcagaagcttcctctgggctcagactcaggctgatgctgcgtcaggacctgccgcggtctcggctgggcttcctgggactcggtggttgtgggctgattgtaaagcacggaatgactcttagaaactgggcgtcattctttgtggttttccaagcttggtctctgatgatactccaggtcttaggagacatgctgaatatttattatgcttacattcaagcaacattaacccttaaggttgatgtagctccccgtctttttttcccagaaggaggagcactgaaggaacacttttccagtatggattctttccagctccgagaagctggaggcacacggatccctcggccagctctcatctatggacgtgctgtagtcacaaggactgtgactaaggctcagtccctgaggactgccttggcatgggctgctttaggctgtaaacacccagttttatccactttatgtgaagaaagccaacaaggggcatggagtgagttccgcaggttttagcggctgcggcggctggtgctcagtggggatgatggcgggaaggcgcctccctctgtgggccccgaggtctgtgcgggaatcagctctgcagctgtgtccaggggcagccgtagaccacacacggcaggctcacagctctgttccatgagaactttatacacaaaagcagacgggctgggcttggcctctggatcataatctgctgacccctgggtaagaaattttaaatatttacttatttctgttcaacagaaggggtgatatactgaggagtgaataatgggaaagatctgattcggctgtatcaggaaggactggtgtaaattcaacttattaactgaattcacagtattcgtgttttatgcctttaggggttaaaaatgggtcacacacgagcagcatgcacttcactggcgtggcagggcacctcagtgtttacatgtgtggttcccatgcttaccagggctggaggcccctgtgagtagtgaagtgcatgtggagttctggatacttttcctggctttctctatttgtgtgagcttgtgcagttagaggtttgggctgaatttgggtagaaatgggtggctcacaggctgcaaaagttctgtggacactttttcccccagctgattaatgttgtaaatattagaatattgttacataaaagtctggatttttagtttctttcacattggaatagctgccaacattgggcctgcattcatctctctagggcaacgtcggctgcagctgagatggctgctccccggtggggtgtgtgctcggcctgcagtccccgccctccggactccattcgcctccactctcaggtttgcacctcgtcattgtcttctaattttgcatccctggactgcgtgacctacaaggctctcagcacaacaagactctatgattctgtctattggaacaaaaagccagtgaggcaagtgtatcatcctgttgatgaattcacagcattaactctgggagttggggacagtgtgtattcttcctccagacactctctgtttctcctggatggaaaggttctgctacttgtcccgtggtcaggcccagccaatggaacggaatggaagtgactctgccccttattggcagaaactttaaaagccgcacaacgttcctgcaccctcccctctgccatgagcctggcagtgctcaggatgggaaaattatctcacctgggcctgaggatacaggagctacccccagcctgcagtggaagagaagcatggacaagtgattaaactttgtgttttcaagccacagaggttttttgaagttgtttgctaccatgctttgtccctacaaacacagtcatggagaaggccagtggcagagcctgagccgttcgcgcatctgttcaccagtatccagaataacaatagatttttgaaacattcctgagaaaattctgggagttgcataccggccagtcttattctctaaagttgttccttctaaagggtgtgatgaccgaaaatttcagaaaagcaaaccaccgctgaaaggcaacgttatttctgttggcagaaggcggcctgagcaatctagattttccacggttcaccaactagtttttaaggaaatatggctgtgagaggaataaaacatgattcctacctttaaggaactcagagaagtgaattaaaggaagtcacagatcagacaaccaaccacacaaagtttctaagagcaaactgttcaggtcggcaagtcactcttatccactgttttgccttctaaggtttcagttactctcagtcagtcatggtccaaaaacattaaatgaaaaattccagaaataaacaatacacacgtgttaaatcatgtttcattctgagtagcttgatgaagtctcatgccgtcccactcagccccacctggggtgtgacacctccctctgtcgagcagatccaccctgtctatactacctgcttttccaggagatccaccctgtctagactacctgcgtggccagcagatccaccctatctacactacctgcttttccagcagatccaccctgtctacactacctgcctgtccagcagatcaacactgtctacactacctgcttttccagcagatccacactgtctacactacctgcttttccagcagatccaccccgtctacactacctgcctggccagcatatccaccctgtctacactacctgcttttccagtagatctgccctatctacaatacctgcttgtccagcagaaccaccctgtctatactacctgcctgtccagcagaaccaccctgtctatactacctgcctgtccagcagatccaccctgtctacactacctgcctggccagcagatccgccctgtctatactacctgccgctccagcagatccaccctgtctacactacctgcctgtccagcagacccgccctgtctacactacctgcctggtcagtatatccaccctatctacactacctgcctggccagcatatccgccctgtctacactacctcccagcccagcagatccgccctgtctacactacctgcctggccagtagatccacgctatctacactacctgcctggccagcagatccaccctgtcaacactacctgcttgtccagcaggtccacactgtctacactacctgcctgtccagcaggtgcaccctatctacactacctgactgtccagcagatccaccctgtctacactacctgcctgtccaaaagatccaccctgtctatattacctgcctatacagcagaactaccctgtctacactaccagcctccccagcagatccaccctgtctatactacctgcctggccagtagatgcatcctgtcttcactacctgcttgtccagcaggtccaccatgtctacactgcctgcctggccagcagatccaccctgtctacactacctgcttgtccagcaggtccaccctgtctacactacctgcctgcaaagcagatccaccctgtctacactacctggctggccagtagatccacgctatctacactaccttcctgtccagcagatccaacctgtctatactacctgcctgtcgagcagatccaccctgtctatactacctgcctgtccagcaggtccaccctgtctacactacctgcgtgcccagctgatccgccctgtctacactacctgcttgtcgagcagatctgccctgtctacactacctgcctgtccagcagatccaccctgtctatactccgtacctggccagcagatccacgctatctacactacctgcctgtccagcagatccacactgtctacactacttgcctgtccagcagatccactctgtctacactaactgcctgcccagcagatccaccctgtctatactacttgcctggccagtagatccacgctatctacattcccttcctgtccagcagagccaccctgtctatactacctgcctttcgagccaatccaccctgtctatactacctgcctatccagcaggtccacgctgtctacactacctgcttgcccagaagatccacactgtctacactacctgcctggccagtagatccacggtatctacactacctccctggccagcagattcacccagtctacactaactgcttgtccagcaggtccaccctgtctacactacgtgcctgccagcagatccaagctgtctacactacctgcctggccagtagatccatgctatctccactacctgcctatccaactgatccaccctctctttactaccttcctgtccggcagattgaccctctctactctacctgcctggccagcagatccacgctatctacactacctgacttaccagatccaccctgtctacactacatgcttgtccagcaggtccaccctgtctacactacctgcctctccagaagatccaccctgtctatactacctgcctatccagcatatctaccctgtctacactacctacctgcccagcagatccaccctgtcttcactacctacctagcgagcagatccaccctgtctactctacctgcttgtccagcaggtccaccctgtctacactacctgcctgtccagcaaatccactctgtctacactacctggctgtccagcagatccaccctgtctacactacctgcctatccagcagatccaccctgtctatactacctgcctgtctagcagatccaccctgtctatactacctgcccatccagcaggtccaccctgtctacactacctccctgccgagtagatccaccctgtctacactacctgcctggccagaagatccaccctgtctacactaccttccttgccagtaatgcacgctatctacactacctgcctggctagcagatccacgctgtctatactacctccctgtccagtagacccaccctgtctatactacctccctggccagcagatccaccctgtctatactacctgcctggccagcagatccaccctgtctatactacctgactggccagcagatccaccctgtctacactacctgcctgcccagaagatgcgccatgtctacactacctgcttgtccagcagatccaccctgtctacactagctgcctgtccagcatgtccaccctatctacactacctgcctgtccagcagatccaccctgtctatactacctgcctatccagcagatctaccctgtctacactacctgcctgctcagcagatccaccctgtctatactaactgcctggccagcagatccacgctatctacactacctgcctggcgagcagatccaccctgtctacactacctgcttgcccagcaggtccaccctatctacactacctgcctgcccagcagatccgccctgtctgtactacctgcctggccagcagatccaccctgtctacactacctgcctgcccagcagatccaccctgtccatactacctgcctggccagtagattcacgctatctactctacctgtatggccagcagatccactctgtctatactacctgcctgtcaagcaggtccaccctgtctacactacctacctggccagtagatccacactatctacactacctgcctgtccagcagatccaccctgtctatactacctaactgtcgagcagatgcaccctgtctatactacctgcctatcctgcaggtccaccttgtctacactacctgcctgcccagcagatccaccctgtctacactacctgcctgtccagcagacccgccctttctatactacctgcctggccagcacatccgccctgtctatactaccggcctgtccagcagatccactctgtctatactacctgcctgtccagcagatccatcctgtctacactacctgcctacccaacagatccaccctgtctacactacctgcctggccagtagatccatgctatctacactacctgcctggccggcagatccactctgtctacactgcctgcttgtccagcaggtccaccctgtctacactacctgcctgcccagcagatccaccctgtctacactacctgcctggccagtagatccacgctatctatactacctggctggccagcagatccaccctgtctatactacctgcctgtccagcagatccaccctgtctctaatacctgcctgtccagcaacattagtccttaaaaaaagcaaacacacaaaatcagtgtctatttacaacagccaaatattatgactacgatttgaaataaatttgtagacccatgtaaataaattttaaaactcaatgaggatataaaaatgacatgaataaagcctgaaaatcatattattagaatggaggacatagtgacataaaacctcagtgactgtagactcagggcaacctagacttaaaagtcccatgtggtcttttacatgtaaaaaatgagaattagtctaaaagtcaattttgtctaaattttgatttttggtgagtatacagtcaaaatagttgtgaaaagaaaaaaataaagttgtcaaatttcatgtaacctatgttatttggaaatttaaaataagttatataaatatttataacaatgttaaacaatttcataagtggactgaataaaacataatattttatcatatacaatagctcctgccttcctgaggaaaacataaaatcaaagggcgtgaaggaaggattttggtttcactgcagaaacataataagacaccgaagtgtgtgtttgtgtgtgcgtacatatatttaaactacagaatataaaatagcatctaatatacatcaaaaatgagtttcatagaaaaattcattttacatatatgtctataaaataataaaatttattcagcctcacaattactttgtgaactggaaataacaatgagttgtcattttatccaaatctaaaaaaaaacatacatacagtatcaagttctggttaaagtagtagatgtactttacgtggtacataagagtatctatacagtttgtgggctgcatcttgctagaatatattacattataaaatgcaccatttatttactctgcgatcaaacccccaacttgccccaagtggaggaaccctcagacatttgcagaggagtcagtgtgctagtaagcagcattctttacaaatctatgaacatcaaggtctccttggaacagatgctctgtgaacaatttataaaactccctcctgttagacacttaggttgattccatttttaaatcaattactgaataaaacacactccatcgtgtggatgaaatgctaccttaatttgtcaaagctatcattttctaaacttttctttttaattcaaatcattaataatttgtgaccagatcaatactgattcattgttttaagcttcaaatgcattatacagttgggcagaacacatttcctctcatcaatcttcttttccaggatttgtcaggtattcctgacattaattcactactaatatgcacagtttctctaatcatggtcaacaaagatctgacagtgcattgtccctaaacgatccatacttgcctcactgacaccatgtggcccacttcccatctataatctatgtctgggtgtgaagcccttcccatatgatcccccgaatggaacttcacaagttcgaattcactgggtcacagtgtgatagtgtgaagatgggaggacgttaagggaaggctatgggtgagttgggaaatgtgttaggcagggtcagagattaccacatcctaaaaacaacacttaaggagggagatgacaaaacaatcaatgaataacatgactttttccagtgaaagtgccatatctaatccttttccatttttgttctctgagcttctttcttagggaagatccttcttgagaagcccctgctgagtattaggaaaatgcatttcaggacctctcatcaacacatcctctttctttaccacaaccacatatatgggggcataactcaacatgtgtaaaagacaatcttctgcttttcactgaacctccaggaattcaggacaataaacgtctacatggagaccaacaggtgagtttttctgccccttctttcataacaccgttcttccctagtgaagtccacacacatccttacatggcagctgtgggtatatcaactggtctgaccccttttagtcacagagcctgaagtctctgctagtacctgctgagcacagggtcatgggtgagaatgggcaagtctttttctttctctggttcctgaacttcccaggctctctcacttctggatcctgaatacccaaaaaccaagcttccttcccagaaccaacacctcctcctcattagaaagatacctttgttctgtgcttactttataaagtcttgctctttccctatccactgccttgtgtcagtatgtgtgtgtcttggggccggtggaaaggtgaacagaagccagtagagagtaaccagcaccagcttcacaggaatggcatgaccttgatacgatagcggcagttttcccttaacatccctgccccctaaagacttcagatcatatgtcacactcttaagtaacagcgatttgtctttcacggttttaatcatattgattaaaagcatttgtcttctccagaacatcacattaagtcatcaaaaaatataaaccttaaaaagatgtaattattggaactgaaaaacataaaaggtgagctttggaaatatctttgagcaatttattcgttatgaacacatgtaatctgttggaacaaagttctaggacaatccaggtcatccttcaatatttgcagaaaacatcacaaagaaaacttgatacttatacttagttggaaactttatgccacagccattaaatacagagatcatacaaaggaatagaggaagctgttgaatactaaactaactcaaatcatcaatatccttacggagtgcacactgaattaatgtaaaaagcatttagtaaacaaaaagtattttcaatatacaattaagactgaaaagtattgaggcctcataagctgaacctgacacaataaatttaaaagggaaactaatttggaaatcagaaaaccactaaggaatttgggaattaggcttctgctgccctctctgctactgacggtcaaggcctcctcattgtattctgtcctccatatctctgctgattcccattttgtctatttccatttaccccactactgcttgctcaggtcactctccttcactgtcggtgtttgttcaaattcctcagacccatccacttcccatctaaacttccctccccttttctcgctcgttggctctacctccctcctctctgttttctcctcactctcctgccccacctcgacatccacagcgaggcaatgaagaagcccctgccaaggaggagcccgcttctcagtgggacaccgggaaggtagacacccaacagtcaccgctagtgggaggcgattgtgcagaagcacgagggttgttacaggatcgggcaggtcccctaccccagtctcggactcagggtcctgtctgaggcggccaccccgaagcgtggggtttgcggagacgtagggcctggcggagggaaggacggggaagcatctcagggaggactggcgtctgccgaatcccagggctgccctgaggggccaagaggggcgagggtggggacgatggaagacaagccacatgccgaatggggacctgaggccgcgcgcgataggatgggcggacggtgaagagaactagggtggaagggccggacaggggcgacctcagtgacggaaccggacacagacgcagatctggcagctgagcgacaggcttcggagcatttccgggcgtcgcgggactccccgccgacaggagggcggttgccgagcctgtgacatccgcggagaccagcagaccccgggtgtggaggacgccgcagggaggggactgcgtggctgggtttggccacaaaaagcggagggcactcacccgagcggaccttggctccggataatccgtttccgggtcaacaaaaaacgtcgcgcgaggggcggggcgcgtacgtgcagggaggggaggcagagaaaaaggcggggccgggccgggccggggcggggtctcgggcaggggcggggagcttaccgacctcccgcccccgctgcgcgcgtttctggccctgccagtgtctccgccggttgaaagcgcgtgtctgcgtcgggttctgttggagtgcgttcggtgcgccgtgggtccgcgctgcttccacccaacttcctgttaggtaagaggcgcgtgaggctcctgtgccgggggcggtgctgctcccgagtcggcgcgcggcggggacgcgagtccgtaggtgctggcgggagcgagagtcgggtggggaccctcgcgagcccgcactccgcctctgggtagcagcctcttcggccccacacggcgtgacgcgcgctcgggctccgcgttcgcgtcgaggcagaggcgtagtaggggtcgggcccagggctggaggggccgggaccgggcggggtgccgccctggacaccgcgccggcagctgttccgcgcgggttcatgtcattcctattttcaacctgtcctgctccgcacctgagatgatttataaattcggtacctttgggacaggcgtggatgacatcccataatttacttcgttattaatttctaaatgtaatacataccactctctaaaagtattttttaatttgaaatatatttgtatatatgtacatatatatttatttatttctgaattttgtctccagtacatataatgaggcttgtaaagtggatagtgttcaggacataggtggattttgcttttaagtagtaaagacttaattggtgacttactggggctatttgataaggatttttttttttaaatgaacattaaaaacagtgaaattgtatttccggatttcattagcttcatttatatcttaattggtgaaaactgtaagttaataactcatttttatttcctttggagattcttaagtttgtgctaccaatgattatttccaaaaaaaggcacacttctggttttcccagaactaatgctagcttctcaatcttttgagtttacttgatattaatgtttgacctcaaatcatgtcacatttttgaagaaaactttctcttagccagtggaacataaaccaccctggagttcatatagaggaggggttcaaatgcctctgatagtgtcgtgttaaaactcatggccaaacccaaggtcacatagctttctttccatgttttcctctagaatttgtatagttttgtcattataaaatgggtcttgtcctagaccccaagaacaggtttttggatttcacatgggaaagaccttttggcaagtcacagagtatagtgaagttaagatagtttattagcaactactcagctacatagcagggcgtcctcagaaagcaagaggaggaatgcacctgttgtaaacatataatttttttttgaaacagtttctctcctgtcacaatggcatgatctcggctcactgcgacctctgcttcctgggttcaaggattctcctgcctcagcctcccaagtagctgggattacaggtgcgtgccaatatacccggctaattttttgtatttttggtagagactgggcttcaccatgttggtcaggctggtctggaactcctggcctcaagtgatctgcctgcctcggcttcccaaagtgctgggataacaggcatgagccacccggcgcccgggcttaatgtttgtttatataggttattaagaatcagtttgtgacaggctattagtattgttacttctctttgttactgtcgattttaacatcaatttatgtgtgtactattacctttaaagtaaaacttatttttaaactaagaatgctgagtggtgtgctgtgtgggtgtactgtgctggtgttctatgcaggtgtattatgcatgtgtgctgtgaaagtgtattgtgggggtatattatgtaggtgtgccatgcaggtgtattgtacaggtgtgctgtataggggtggtatgcaggtatattgtgcaggtgtgctgtgtaggtgtattatatgggcatgcagtacaggtgtgcagcatctgagctccgtcttcaccttaatcccgaacactcttttcacctctcacctgcactgcagtgctgtttcctggatcacacttttttgtttgtttgtttaattcctccaggagaatgagtgtataggaaataaggatttctcttcacattttacttgactaacagtttctctggttatagaatatattttggatttaaagctctctctgaattttgaaaacactgtttcattttccgcttgcctcctatgttgttctagagaagctcaatcgcaatctcgtcccccatcctcaagcgatacacttcttttttctttattatcttgaagcattcagggtcttttcttcatttttggctttctgaaattgcaggacaatatgatgtaggttcgtttttatctctgtgctagctcttttcatttggaaacctgtgttgcgttctgaatgctgtggtctgaaagtgtaccttcaaattcatatgttcacacttaatggccaaggtgatagtattgagaggtggggcctgaaggacgtggctaagtcacaagggcagagccttcacagtgggatcagtgcccttaaggaagggctgagggcctgggtttgcctttttaccttttcacctcctgccgcgtgagggcccagccacaaggtaccatctgggaagcagagtcccaacccttgccagacactgagcccactggtgctttatcttggactcccagcctccagaactgtgagagataaatttctgttttttataaagtactcagtctcctgtattttgttggagcagtacaaatggagtaaaacactaagacattttctggaattctttgattgataattttttcttctcagtcttttatcttgtctcttccttgaacacattatttctggtgttgaacattccagaccacttctccaattttcttatacttttttctcctatttttcaccttttagatctctttttgttgttgatttactttctgtgaggtttaccaactttatctagtacaagttttatggaatttaaaaattgtttcagagtttaagttcccagatcctctttttttaactgttcatttttcatgacttccagttctttagtggtgacgtatcttttctctctgaagacagtatttacagttactggaattccttcctgctctccacctgtctttggtctgttttccttttcccgttttgatctctgtccttcatggtgcatcctcctgttgactcctgaccatctgttcacatggggctgctgtggggtgaccgggccacgcagtctcccttggcagctctcagctgtctgtatccgtcagcattttctcttggtctggtcaggttttcccagaggggacagtccgttctccagcctgggacagaggtcagggacacatgtgctccctccctgggttggctctttatatggtgagtggcaactggttttggacctctctcttgcaggctgggtctgtgggatgtaattagaaagcaactttatttctattcacttacatttattcattggaggaggagtttctctttcctagggtacacgtggacatgcctatgacttttctgctttgtcttatgtttaaaaatgtccttcagtcattgcaggtcacaagcaggctatcagctcagtaattaaaataattcggttcttcatagtgaatgtaattctaaattagattttaagttgtaactccctgcttcagcaatggtgatggggcctagaaaccagagcacctgagctccatcctacagggggccataccgggatctttccattttcagaggcttctctctgacagtgaagtgtgatgacagacttgggggcagggcaatggctagcttctgaaagccgctggcactttagtgataaatttaaattaagtgacgggtagtgaggtgtttgtcaaggaaagtgccgtccaaatgctaaatactgattatttctgcagcagtgactgcaatacctcactcaatctctgtctttcttgaagaagtcataaataaacacgatgaatctatgtagaagcggtaagtcagaaaaatctgtgtgtttcattacataaacaacggtttatcattaattgacaggcttggattgggagttgttaatgaaactgatgagatgttggacagatgagctccctcttatttcgaagagcttatctagggctgagtcatgggacctgatagcgtcttgtggtgctgtcttcttgtagatatatccgtgttttagaggatttagttttttaaaatttctcttagaatgtgaattttacaaaaaagcacttcccaaatggatgattatttgaaaaatgaattgtcagacaaaactgacacatcagttatggagaaaacccttcaagaactggctttaaatgtgttttagtgggagccacagtgtggagagaaacagaagagggaggagagggcgccccttgtttcttctctccacagccaggccttcgccacctttctcagtgtcttcaagaataaaatgcctccgttgttggttttagctgcttttctccctcggggtaggtaaagtggttccaaaacgacaagcatcctgtaaagtcggaagagctgtgtcaacattaagctgcgtgactttggctatgagggaaaaaaggctggtgagtgcagagaagacagagctgtggcagggctcctcccgccaagtcgccatggagaggggctgtgaggtgtccttaaacggcctggtctccagggtgactcaggaagggctgagagtggtcagctccctcacctgctaaacccgcagcgccccgctcagcacacaccctccactctccaaccttgcccaagtgctggtccgtcacggcaccaggacagggcatggagacttgggctgattcttttctctcccttcctccctcttttttttcttctctcactcctccttttcctttcctgctgtttcctgctctcctgtttctgtcctgcagtgtctggagctccagagaggctggccctggggtggggtccacatggacatgggcgtaagcaggtttgatggtcatgggcataggcaggttcgatggccagagttctttcagctcacagtaagttttgttttgttttgttttgttttgttttgttttgttttgttttagatggagtcttgctttgtcgcccaggctgtagtgcagtggcgtgatcttggctcactgcagcctccaccttagagcaatcctcttgcctcatcctcccgggtagttgggactacatgtgcatgccacatgcctggctaatttttgtatttttagtagagacacggtttcaccatgttggccaggctggtgtccaactcctgacctcaggtgatccatccgcctcagcctcccaaagtgccgggattacaggtatgagccactgcacctggcctcagctgacagtaggttttagagccagatatttacacactaacttgccagaaacatatatgactttattattctaattgattttaagagatattatgaactcaaatccaaagttacgtcccacctatcatgacaatttcattaaggaaaaagtcaaaccattttggaaatgatttaagtgagcaacttggaaaaattttctacattcctaacttactttccaggggatcgttcctgacttaacatctatcaggtgtcttagcttagctctctttttacttcaggtttttcttgcctcctcagtgtgctgggagtcccactccactcaaatgccctcaggtctaataattaacttcattgcaggctcctggcaggcctgggtgggcggcagctgcattgtgctcctgaagaagatttaagttgggtttggtgaactggtagaatttgcattttgctgtttctttccctctcccagaatttgtacctttaaataggttttttagtgtcattaagtatatcaaaaggaaacccagtggggcaaattggccgggctccatagaggtggccttgtctaagcctttcatcttatcgataaggaaagacaggaccagagaagtcgccgactgtccctggtcccactgcttggtttggggcaatttcctgaaaataatatccaagatgcaaagcatatggctctggtgagacatgtgtgaggagctgagaatgagacggctgagtgtcgggggcagatcacgaagggctgcgctcaccatcaggaggtctggacttcgctgtgaaagacacaggccctcatgtacgtccaggatgcggtgacagcgaggcttgcaggagacaggtccctgctgtgtgggggtgaagctggaggcaagatgatgcctggagctaagagatggtcacaggaaatccggcaagaattaacgaggactggacagtgacaggcaggccaaagagtgagaggaacttcactggcaagagccaacagggcttgttgatttaggagaggagacaaaggactgaggggtttgggggctggggcctgggagggtggagaagccactgtctgcattatgggatgcaggaggagaagcattcagttctccacacaatgagttccctgagaggtgtctcagtgggatcgtggtgcagttggaaatgttcatgagaaagatgagaagcggcaccagcagcaaacatccaggaacccagaaaccatcagcacaggtgcctgctgagtcccatagacccactaatggcccaccaggaccaaccaggaagcaagtgtggagctgggagtgagggagctgggtgtggagatcagggggaagactgtcatctaaagggcgagagtgggaaggatggagtcatctgtagctacagggaaccaccattagtcagtccttgtgatgaaggtgcaagatgttcctgcttccgcgcacgtcgctcctgggctgtgggcaagtttggaactgctgttgttccccagcatagtctcaagcgagtggaatgacggtttcctatagaagcacagttcctacaggaaagaaggcgtggttaagagcatgagggccaaggaaaaggaggggattagagatagccagcagtgagggagacggttccagacacgagccgagtgggcaaagcagggaattcaagagagagaggagcatatattacgcaaattttaaattttttggtagcaagcaacctagcaaaactagctgaatccaaaggggatttattggctcacatcataaaaatctagtgaaagattctagctgaagtcataactagatatacgagtttaaataattttgtcagaaactgtttctttgctgctcatccacctatccatccacccatctatccaaccctccctccctccatccacccatccacccacctacccactcacccgtgtctttatccattgatccacgtgcacatccatcctttcatctctactttcctccatccctctcccttgcctccctccccatccatctgcccatccctccatccacctcttcatctctcctttcctccctcccccatccctccaccccctgttcacccacccattcatccatccctgcatctttccgtccacttctctatcttcttgtctctgcttctctttgtattttgttctcactattctctatttcataaggcttcctgaaagcggcatccatttattccttgtagcaagatccctagagaaagactcataatttatctctcagtgttcataaactctcagggcaagttttatttggcctgacttggatcacctgccaatatctgaacggattgcacacccaggtaatggagtattttaatcactgcagaccccccaccctcacctgaccagtgccccacagcaggaccacgagcagggccaaggtgtctccaaggtgctgaggagctgagcgctcagccagcccacggccacgatggtgtgcctccgaagccacgcggcttacttcacagccaggatccgggatcaggctatgtcccatgcagcctgatgaagggtaaaaaagagcccaatgcagagtgctggggaagcatagagagagccggggcacctgacccagcctgggacggtcaagggtgactgccgtgcaggagttggcatctgagctgttccttaattagaaagcctggcacagaatgaagaatgcattcctcaaactgagtcagggtgcagggatccacatgaccgtgctcctcttatccttaggaagggacaagagacttctatcctttggcctgcagctgctgaaatgacccttgcaagtactgaatcatctttaatgaaaaaatacactaatatgctgcaaatttggagcttatcctttcagtccaatccatggggaaggtgtgaattaaagaccctgtgcgtgtgctggaggcatcgtggacttttgttcacgatttcctttccttttgatgcttcagttatggtggttgcagctctataagctgtgtgatatgggcaattcctctcaccttttgaccactatttttcttactaatgaaatgaatacatacaagaatacttgaagtttaaataatgaaacatctgatactcacaggcactacagtattggctgaattcttaagtgactataggacacctttaagcatgttctagggcaggataaccaaggacaccatctcacgtgccaggaaatgaggggcctgtgtccaataagtccctggctccatgtggctctgctgttgcccacttctcttggaccctggttgtggtcttcccttgccacggggcctttgctggtgatactccctctgcctggagtacctccataatgtccactgctggggccttgcccatattctctacatgtggcactgcagtgcccccccagccagctcccaggggccagtgcccccagttccttgtccaaggtctttgtcccgcagctaaaacccaatctgctgccaccggctccatccacaggcaaaagttcccgggaataaatgcgtcagggcacagccctcaggagaccttggttacggacatctatccatctcctcgccctctggggtgaatacatctcaggtgcactcttttgggtgtttctttttgcttttgttgtttgcattggctcccagagtctgacagtggcagaaggctccagctgcccacagtggtgactggttttaagcgtaccctttgttggccatcttcctctctcttggaaataaacagcctgcactccaatccttgtcacagggtcagctcctgagggatcttcttggccttgctaatgctggcttatccttcagaatttagcttccattttcacttcttcatgggagtcttcttgagtatagtctcctcgtcatgtctgccgcttcttcctgagtcagggaatatctcttaggccatatctattatagtcgtggtctgacttatatttgtggtcaatttttttttcttaatttttcgtagagacggggtctcactatgttgcccaggctggtctcaaactctaagtgatcctcctgcctcagcctcccaaactgctgggattacaggcttgagccaccaagcctggcctatgtttgtggtctctttgactaaaaatgatcttttcttctaacctgaaatctcctgagggatggaactttgtgtctctttggtttatcccagcatataaatagttacgcatttttgaattaacaaatgagcacaaatttgtatcaaattattatctaggacaagcagtggaaaaaaattctgtaaagggccgggtaactgttttaagctttaagggccatgcagtttctgttgcagttaccaactctgctgttgaagggtgaagacgtgggtaggtaatatataaaggaatgagcatgtctggatgttccaataaaattttattttcaaaaataagcagcagaggagagcttctggaatggtggtgtgaggagcttggcaggccctctatccagggaaataaccatttaacctccgaacattcatttttttaaaactagaaattatcctaaaggcatacagcaggtggataaatatttactcaaataaataatcaaatctcagtaagaacggtaaggatcagtggtatcagagccacaatccaccgctccccaccctcaaagcgcattgtgatgaaagctctgctccaggaaggtccagctaacaagatgctgtggtctgtcttcccggctcctggtctagggctgtggtttcaccccaggaaggcaggccaccagcatctctcatccctctcagtttgcactgcagaagcaccgttccaggaagttgcaactgagaggactagggctcccctgcttcagcctgtgcttgtcctcagagggtgggagccccatcccaggtgtggcagactgagcacatctgcctggattgccccacaccaagtcactcacagtgtggaggttccatgtctggaggggcaagctaggaagacaagaggctaccatgcccacccagctactggctcatgcagcaagggtgtcgctctggtggaactggatcacggtccccaggagcagaggagacctaagagcagagcatgtccctgaggtgacagactttacttggagaacagcatgcggaagttcaagcccaaggaagttggcaaaaatagtggagattttgttgatgaacaattaagagtgggtgaaatggtagactagatagaacttaaacagagggaacaaggaagagagattgttgagaagagctccggggtctgagcagacttgaaaagctggcaacactctgcccctgcaaaagagcctgatgttcactggatgagtctatggagcaatttgtgccccaggcatcataaaaaatgatagagcacttgcatttagtggatgttaacagctgtgtgtgacaccaaagagagacagaccagcagaagcttaacagagagcccagagaaaaccacagataccacaggtggtcggagagactgtgtgctagtccaaggctgtgccctctgaggagcaatatcagagctacgtccctaatcaaataaacaagcaatcaaacagaaatagcagcccctgcgggtcggggtcagaatccagatttgctatgatatattacctaaaatgccagtttccacaaaaatgcaagaaaacaggaaagtgagacccatgctcaggaaaacagaaggcaacagaaactatgacaaattccagacatcggattaacagacaaagacagccagtgtcaaaacagccacagaaacatattcaagttactaaaggagaccatgttaaaagaattaaaagaaattatgatgacagtgtcccatctaataaggaatatcaataaagaaataaaaattattttaaaaaacaaaaaattgtggagttgaaaagaacaataactgaaatgaaaagttcactcaggggcccagcagtaaattggaacagtcagaagaaagaaccagcagacttgaagttatgtcaatagagattatacaacctgaaaaacagagagggaaaaataattaagaaaaatgaatagaagcttgggacatccttaatgagagtaccagaggagatgtgagagagaaagaagcagaaaaaaagttccaagcagaaaaaatgtccaagaaataatagctgaaaagctcccaaatttgctgaaaaatgttaacctacacattcaagaagcccaaaaagctctacacaaagagacacacctagacacacacacctggacacacacacctggacacaaacacctagacacaaacacctggacacacacacctagacgcacacacctggacgcacacacctggacaaacacacctggacacacacacctagacacacacacctagacacacactcctggacacacacacctagacacacacacctggacaaacacacctggacacacacacctagacacacacacctggacacacacacgtagacacacacacctagagacacacacctggacacacacacctagacacacacacctggacacacacacctggacgcacacacctggacacacatacctagacacaccagaatcaaaatgttcaagacaaagacaaggagaaaccttgaaaggaacagaataaaatggctcaccacaaagaagggaacccagtaggattaacacttgatctgtctgtaaaaggatggaggccagaaggcagtgggataacatattcaaagtgctcagaggaagaaactattaatccacaatcctatatccagcaaggccatctgtcagacatgaaggtgaaataaatttcaagataagcaaaaacggagagaatttcttgctagctgaactgctttatgagatattaaaggaattcttcaggctgaaaacaagtgaactcatacgattttcaaatccacacaaaaaagcaaagggcagtagtaaaggtaattatgtactttttaaaaaaggtgtaaatgcatatattttctcctgttttcaaaagcaactgcataggacaataagtatggaattgtattattggacgcataacatacagaaatgtaatatacttgacaataacagtacaaaggaggcaaatgggaaaaactgcactggagtaaggaaatggccacatattgtataatcccatttatatgaaatgtccagaataggcaaatccacagaagtagaaagtagattcatagttgcctgggcttgcgatgtgggtgcaagaaagaaggaaatgagtactaatgagcatgtttcccttagggaatgacaaaaatgtgatgatttcacagctctatgaacgtactaaaaaccattgtagtattaaaaaaaaaaaaaaagaacaaaagaaaagaagagtagaattttgggtacataattgtaaaatcaatctttagtggaaagctctgttatccagaaactcaaaattagctacataacttccccagaaatattcatccgcagcaaatattcatcagagacagaatccaaacccaggtctgtgtgaatctaaagtttattttcctccacctgccttaacaacaaattattgaataactcaaggacacaatacctcgaaagagtctgaaacatttctgtgatgaatttacttatgaatcccaatactcttgattctagatgatgtgttttgttcagcatctgtttcagtcatatcaagtaaaaccacttcccccaggtaatatagttttcctttttactttttcccttggcctcagcatttacagccccgtgcagactgttttaacaaacgcgttggtgaggtgtggtagaatcacaggcaaaggcgtgctttgctgtgctgtgtaggtacatatcaaacgctcaccaagaaattataaaatattattcatagcagtttttttcttcagtattttatgggctaagtgcaatctggcttttgataacaacggctgaataatatttgagtttgccagctgaaatgtcctaaatatcttattgattcatttattgcctcttcaaataacaaggcaacaagacagtgtcagaatgctcagtgtttttacttttttgtctatcatgggatggtgtcagtttcagtaaaaacgatgtctcttattttggtccacattgtaggaatctcaccagtgacacgcgtttgtgaaaagctgtgaatattcagtgccacagggttaaacctcggtacagaagcgagaccctgctgggcagagaaagggtgacctggaaggtgtgtgagggccccgcccatgggcccctgtgatggtcatggcctcaagaatcacagtccaggtgaggccctgaatatccacagccaggaccagttccctctgctcttgggtgccaaggccaccgtcagccaggagaggcctgcagaatcagcctgtgcacctctctgacgataagcagagatgctggtttagagacttgctactcacggggaagtccttgggcctcctgtactcacattacctggaacttcttggaaattcagaatctcaggccccaacccagacggactgaatcaaaatcttcattgtggtaagaccctcggtgacacacaggcctgggaagcacaggttagcgtgtcaccttgggcaaagctctcagcattgtgagcctctgttttctactctgtaaaggaggcatgaatatctacaacatcagtttgccatgagtattgaaaaataatgtcttagaagcacagggcagagcctggcatgtagtttgtgctcagtgcacagcagacaagaaaccacatgcaccagacctgggcggccgtcggcagcccaccctgagcaaccatgggtggccctcttgtctctcgggacaagaaatgcttctttagaaatgcttctttcctttctaaaatgaaagttttggacagtatttcctttcatttaaaaatttcatctgtgtatttgatggcctctgttgtttctttcctgaaactcctgctaacatactgggagctgaagaagggctccgtgaaggcgagtaggggtgcctgtccctcccagggaggagcttccctcctctcacctgctgcacgagccctagtgcttcaccaactccagcctcagtgccctgacactgggggagggaaaggaagcgcacgcaccagccgttccacccaccgaagttgtttggtcccaatctgcaaaatcagttaaacgtcttcctgcctggcagcagatcaaagggtgaggggtctgggacagacagagacggctagagaatggatggtgaagtgctcagaggccctgtgggctatcccacactcggcggaagacagcaacaccatcaaatctccaccctttgttatccatgacttaaagaaaagtgaacagggaggtggacaactgtgcaaagactggctggagtcaaatcctgggcataggtgaagcatcgagaatgcttgtcacacgtttgaatgtgcagggggactctgactggaagctcctagcagaggctgaagacactggttaggtcctggtgcgtgccttgggatgcatcccaggcaacgggcccaggagcttgaggtcatgtccacctggctcaccagggagtcctgcaccattcttcaaacctaactggaagagacactgatccttcctcccacctaagggctcccagagccacaggtctccgactctcctgcaacacctcctgctgcctgttcccaccgcccatgattcactcagtcaccatcctcagcagcacccgacagcctctgtgtgtctgtgtcactcaccattaccagccccctgggtgcccaatgcatgtatgttagacagaacaaatgcacggcggccttcagcagcaccgaccgcgtcaacccctctgtgctcacaccaggagtgatcagcgcacacgccctcccacaggatgggagaaggtgataacagctgagctgggtgtccagaagccagccccaccccacagccactactgagaggttatgagatcatggccttatcccgagtaatgctgctgcagtgaactgggacttttttcctctgaattcaaaggtggggcagtctaggcacctggatgcaccatctgctctgtcccggcctggtggctgctcactgtgggatgctgtgcaattagacagttactatctttccctggttgacggattagagtttcccttttctgagcatcttgttttgaagtgatccgaagtgtttagggttaaagagcgtgattttcccaaactgtccaaagaaatagaagcaggtctgcaagaggggggtgcccagagccttgagatggaagcgagatggggtgagacctggggagctctccaggccgccgggaagctgcacgtcatcctctggacctctttgctgactgtgtgctgtcaccacagcagccgccttctctcatctgtaaacaggattttacgtaaatttccatacacttggttgttgacaattaagtagattgtttttaaagatacttgaaatgatatcagaatttcctaaatatatcattaaaacaggaaacttagttacctactcactcgaatcactagagaataccaaataggaataggaagataacacactggtaagaaaaatgtccaaggccaatcacaggagtcaaagctcgtgatcaaatcagctctgcctggggaggccgtgctcatggcaccatttagtgacaagtgggtgactctggggcaagttccaggggtgtcacccccaaggcagcagctcaggtgcagccaccatggaggcagtttcactgaggggccctctgaggcccctactctgagattctaagacagggtttgaagaatgttccagcatttgaacacatgaaccctatgatgtcctgctgtgagagagaacaatgtcccaattttgcccaggtgatttgaacatctcggtatggatctgttatgggttgaattttctcctgcccaaattcttatgttgaagtccttacccctgatgggactagatttgtagacagggcctttaaggaggtgattagcgtagtgaggtcaccaggtgggccctgatgcaatctggcatcctcctaagaggacatgaggacacagacacatacagagggacgatcgtgtgaggacacagaggatggcatctgcacgccaaggagagaggcctcaggaggaaccagccctgcccacaccttgatctgggacttccagcctccagggttgtgagagagaaatgtctgttgtttaagccatgcagtctatggtgctttgttatggcagctccagcaagctaacctgggatctaaaatgatacttaaactggttcagtctgattcttaaactggttcagtggagctaggccaggctccctctgagcagatgttggtccctttgcaggcctgctgtgtgtgatgattgctaaccaggttatgacagtgatctttaagtaagtgggaatcttgtgagttttgaggttttgtttttttttttaatgaaatctacatgggatgtttcaaaaatagcagcctctgtatacatttgtcaagcaggaagctgggtctgcggggagtagggtggggctggttctcccacacgcttgccactttcaggcccttgccttgcatgggctgcggtggttctgccagtgtggattcgaaccgataggtttcgctgtaccttgatcagcatcctgctgccgagaaagccaaaaagggctggagcaaccctcccgtgtgccatgtgagcctgtttcctttctacagtcaccagttcacgcagcaagtgtcagagcattcctgtaaggcccggctctccacaggggccaggggagctttctctggcagggtcttcttcactgtgtgtaggatacggcagcctttgaggctggggaaccgaagttttccttttattctattttaattaatttaaattacaataagtattatcactaagtttatgcaaacacgtgagggaatgctgatttagagctggtggcgtaaggtcacagagctcccacgaatctcacatggaagccttgtttctccaggttttttgtagtttgtactgaatcacacaccatgctgcttccatgttttttcagggatttccaacacagattttcctgagtaccctggattaatctccttttggataggtccatgggggccctgctgctttttccccttagccctgggcgaggtcatcatagagggggagtggcaatggctcacaaggtactagtggaaccccagtaagttatctcagagcccgcttagaacacaagtgctacgtcccccaaaagctttgcaatgagtatctgatgggaacaaactcagtcaaggacaggcccaggttggggcttgcaggctgcagattcagaattgtttatgagatgggagccatactttctaacaacaagacctgaatttctcaatttaatccaagtcgtgacttaagttagcgcccttccgttcctctattacatttctgttcggcatggatcaaattgcctacaaggtggaacagatttcaactgcaatctctgaaccagaaaattcacttattctcatgaaagtttgtaatctttggagagttgcttaaacacttaaaaccatctttcctctttctatactccaaacttacctgctgcaatttcttgctaagaagcaaagtgctatttgcctattcctatctctctttaccatcagacactccttaagttaagagctagataattcgctcagcctcaggccaggccgagcctcactctagaagtcacattcctgaggtgtagggggtcaaaatgcctctcattgttcagaagcaggtgaggggccagccagggcacatcctgctctccaggcttggttcagataactgtcagcccagttttcaagagcacacaccaaaaatgcaccaaagcttacatccatacaaacacccgcacatggatgtttatggaagcttatttgtttttattcataatcacccaaactcagaatcaaccaagatgtccttcagtagatgaatggataaactgtggtgtgtccaggcagtggaatattattcaacgcaaaaagaaatgagctatcaaggcatgaaaaaatatgggggaactttaaatgcataaatgagtgaaagaagccagtctgaaaaggctacaccccgtgtgcttccaactacaggacatcctggaaaaagcagaattaccaacacagtgaaagataaggcctggtggtgtggggaaggatgaacaggtggagcacagggatctttaaggcagacaatctactctgtgtgatactgcaatgatgagttcatgccactatatattttcccaaacctatagaatgtacagcaccagtggtgagccctgatgtgagctgtggactctgggtgacaatagtgtgtcaatggaggttcatggactgtaacaaatgcatcactctggtgggggatgttgataatgggggaggctatgcatgtggggaggtgggtacatgggaaatctctgtactttctgctcagctttgctctgaatctaaaactgctctaaaaatcgtttatttaaaaatacaccaaagcaatgaggccgggcatgcatacagccaaagccaaatgatatttgtgtgagtcaggtaaatttgagatctgaaaaatgatcactccagggaggctgagctgtcatggggcacttattgagaacctactttatgcccatctggtgcttagaattacgaattagctattattattactaaacaattcaaaacaaagtcacttatctcagggcgctttcaatcttgttgccatcgaagctaacaaaagtggaaacagaacaaagctacatacggcacatttcccagaacatgccaggtggagcctggccctgttgattgtgtgtggctgtcacttgcaggagggttccatggacaagtgagtttgggaaatgctgggttgggcaaatatcaacaggcttccttactgcaagatttctcatagtcaaaacatactttaaatctccaagaggatgatacagagagccatgtttcccataattagttggccccagaaacagtttcttctgggaacattttgtaagattagtgctccttgaaacacactgagggagaggctaaactgagtggtagagattcatagactatttggattctggccccagagtataaaaggccagggggaaaggactgtgttcctgagatggtgaggtggagaaggggacgtgtttctccaccacccacagagagggctgagaagccctggcacacgggctgaatctgggaggtcagaaggtgaggtgagaggacaggaagacagcccacgagacttccaaaggaaatggtgagtcttaccatggctctctgggctgatggcagggcccggcacaaggtaggaactgagtgtgagtgcgggatgcacccaggtctgaaatgctcaggaaggaccctaggacatgagcaacctgggctggtcactcatggaacctgaatggctggaaagaaggaagggtgatcctgctaagacagggcgttgtgaagatttcctttccctccgaactaacatctcactcacttctctcagtttccatcattatcttctatggagttcttcattcccacatctgtggaccttaaaatcctaccgttgagtgcctgccttggatcagcagtcagttcgttaccttggttctcagacgatgcttgcaacaacgccatgcgattcgcccactcttgggtaggtggagacattggggctcaggtgtgggtaagtgattgtgtgactccttgttaagcggcagaaccgggactcaaattcacacagatctgattccaaaccctgtggccctaagcatagtgttattagacaataagccctctgcagggagatttccagtgctgatggcagggtctgtcatgaaggaggactctgctgaatttttctttgaaccccaggaagtgcctggcacagttctctgaagaaattagaatgcagccagtggttactaaagaaatgaataagtcaagtaaatggacagagctgtgtgctaagagttcttttgggacacagaaatgggtcagaattggaaatgtccagaaaatactcttggataattatgaaagctacatataggagctcaggtttaactccatatgaaatgaagagtcacaaaagaaaaggaggaggagcgtgttcaggcggaacctcaagcttgagagtgctatgaaatatgtttgagactcagaaaacagttcctgaaagaaatgacacattaatgaatgaaggtatagttatttggagaaaatgaacctagatataagagtaaccatatcaaaatgtgtttctttaactgcggtcttcagaacctatgaggttcattggtatattcttgggaactatgtgtgtttgagaaacatatttctggcgccaaactgacagtcacctcaaatc

SEQ ID NO: 440 - DNA, 284880 bp, Homo sapiens
tttgtttaatatattagatttgaccttcagcaaggtcaaagggagtccgaactagtctcaggcttcaacatcgaatacgccgcaggccccttcgccctattcttcatagccgaatacacaaacattattataataaacaccctcaccactacaatcttcctaggaacaacatataacgcactctcccctgaactctacacaacatattttgtcaccaagaccctacttctgacctccctgttcttatgaattcgaacagcatacccccgattccgctacgaccaactcatacacctcctatgaaaaaacttcctaccactcaccctagcattacttatatgatatgtctccatacccattacaatctccagcattccccctcaaacctaagaaatatgtctgataaaagagttactttgatagagtaaataataggagtttaaatccccttatttctaggactatgagaatcgaacccatccctgagaatccaaaattctccgtgccacctatcacaccccatcctaaagtaaggtcagctaaataagctatcgggcccataccccgaaaatgttggttatatccttcccgtactaattaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaataccaccaatcaatactcatcattaataatcataatggctatagcaataaaactaggaatagccccctttcacttctgagtcccagaggttacccaaggcacccctctgacatccggcctgctccttctcacatgacaaaaactagcccccatctcaatcatataccaaatttctccctcattaaacgtaagccttctcctcactctttcaatcttatccatcatggcaggcagttgaggtggattaaaccaaacccaactacgcaaaatcttagcatactcctcaattacccacataggatgaataacagcagttctaccgtacaaccctaacataaccattcttaatttaactatttatattatcctaactactaccgcattcctactactcaacttaaactccagcaccacaaccctactactatctcgcacctgaaacaagctaacatgactaacacccttaattccatccaccctcctctccctaggaggcctgcccccgctaaccggctttttgcccaaatgggccattatcgaagaattcacaaaaaacaatagcctcatcatccccaccatcatagccatcatcaccctccttaacctctacttctacctgcgcctaatctactccacctcaatcacactactccctatatctaacaacgtaaaaataaaatgacagtttgaacacacaaaacccaccccattcctccccacactcatcgcccttaccacactgctcctacctatctccccttttatgctaataatcttatagaaatttaggttaaatacagaccaagagccttcaaagccctcagtaagttgcaatacttaatttctgcaacagctaaggactgcaaaaccccactctgcatcaactgaacgcaaatcagccactttaattaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttgcaattcaatatgaaaatcacctcagagctggtaaaaagaggcttaacccctgtctttagatttacagtccaatgcttcactcagccattttacctcacccccactgatgttcgccgaccgttgactattctctacaaaccacaaagacattggaacactatacctattattcggcgcatgagctggagtcctaggcacagctctaagcctccttattcgagccgaactgggccagccaggcaaccttctaggtaacgaccacatctacaacgttatcgtcacagcccatgcatttgtaataatcttcttcatagtaatacccatcataatcggaggctttggcaactgactagttcccctaataatcggtgcccccgatatggcgtttccccgcataaacaacataagcttctgactcttacccccctctctcctactcctgcttgcatctgctatagtggaggccggcgcaggaacaggttgaacagtctaccctcccttggcagggaactactcccaccctggagcctccgtagacctaaccatcttctccttacacctagcaggtatctcctctatcttaggagccatcaatttcatcacaacaattattaatataaaaccccctgccataacccaataccaaacgccccttttcgtctgatccgtcctaatcacagcagtcttacttctcctatctctcccagtcctagccgctggcatcactatactactaacagaccgtaacctcaacaccaccttcttcgacccagccggaggaggagaccccattctataccaacacctattctgatttttcggtcaccctgaagtttatattctcatcctaccaggcttcggaataatctcccatattgtaacttactactccgggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggatttatttttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcgctatcatattcatcggcgtaaatctaactttcttcccacaacactttctcggcctatccggaatgccccgacgttactcggactatcccgatgcatacaccacatgaaatatcctatcatctgtaggctcattcatttctctaacagcagtaatattaataattttcataatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaaaaagatattagaaaaaccatttcataactttgtcaaagttaaattataggctaaatcctatatatcttaatggcacatgcagcgcaagtaggtctacaagacgctacttcccctatcatagaagagcttatcatctttcatgatcacgccctcataatcattttccttatctgcttcctagtcctgtacgcccttttcctaacactcacaacaaaactaactaatactaacatctcagacgctcaggaaatagaaaccgtctgaactatcctgcccgccatcatcctagtccttatcgccctcccatccctacgcatcctttacataacagacgaggtcaacgatccctcctttaccatcaaatcaattggccatcaatggtactgaacctacgaatacaccgactacggcggactaatcttcaactcctacatacttcccccattattcctagaaccaggcgacctgcgactccttgacgttgacaatcgagtagtactcccggttgaagcccccattcgtataataattacatcacaagacgtcttacactcatgagctgtccccacattaggcttaaaaacagatgcaattcccggacgtctaaaccaaaccactttcactgctacacgaccaggggtatactacggccaatgctctgaaatctgtggagcaaaccagttttatgcccatcgtcctagaattaattcccctaaaaatctttgaaatagggcccgtatttaccctatagcaccccctctaccccctctagagcccactgtaaagctaacttagcattaaccttttaagttaaagattaagagaaccaacacctctttacagtgaaatgccccaactaaatactaccgtatgacccaccataattacccccatactccttacactattcctcatcacccaactaaaaatattaaatacaaattaccacctacctccctcaccaaagcccataaaaataaaaaactataacaaaccctgagaaccaaaatgaacgaaaatctgttcacttcattcattgcccccacaatcctaggcctacccgccgcagtactgatcattctatttccccctctattgatccccacctccaaatatctcatcaacaaccgactaattaccacccaacaatgactaatccaactaacctcaaaacaaatgatagccatacacaacactaagggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccctatactagttattatcgaaaccatcagcctactcattcaaccaatagccctggccgtacgcctaaccgctaacattactgcaggccacctactcatgcacctaattggaagcgccacactagcaatatcaactattaaccttccctctacacttatcatcttcacaattctaattctactgactatcctagaaatcgctgtcgccttaatccaagcctacgtttttacacttctagtaagcctctacctgcacgacaacacataatgacccaccaatcacatgcctatcatatagtaaaacccagcccatggcccctaacaggggccctctcagccctcctaatgacctccggcctagccatgtgatttcacttccactccacaaccctcctcatactaggcctactaaccaacacactaaccatataccaatgatggcgcgatgtaacacgagaaagcacataccaaggccaccacacaccacctgtccagaaaggccttcgatacgggataatcctatttattacctcagaagtttttttcttcgcaggatttttctgagccttttaccactccagcctagctcccaccccccaactagggggacactggcccccaacaggcatcaccccgctaaatcccctagaagtcccactcctaaacacatccgtattactcgcatcaggggtatcaatcacctgagctcaccatagtctaatagaaaacaaccgaaaccaaataattcaagcactgcttattacaattttactgggtctctattttaccctcctacaagcctcagagtacttcgaggttaaaatattagatatttcccctgatacagggctcaatctttttctttttaaagcaatatttctcaaagtacttttcacagaacttaagtttcattaagcacttcactaaaagaaaagtctgtgatctaataaatttggaaaatattgagaattagagccccctcttagatatgtactgtagctactcagcttgttacagatgaagtaaacattgtaatattcacccagcttttgagtgatgtctattaacatcacccaaatgagtattccatggaatgcactttgcaaaaacctattattcaagaaaattctggagcatgaaagctattaatgataaacccattcacaaaatcacaccaaatatctaaaatcatgtttaaaatctcctagaaatgggttgaattgcccacttcagagacaaagtgattcttttgtaataacgagttttgtttagtgagtacttattatctcattgaatcctgaggactacctcacaaggtaagtatagctcttttcattacacatgacaaacaaggctcagagaggttaagtaacttgctcaagatcacaaaactgcagagtgacaaaactagaattttgaatctaagctcaaaaggtcaccaaaccaaatttgggtccacccacccagcctatcaaagtcaagcactgatatcggcattgctgagacagaagttgaggaatttattgcaggcagcaagcaaggagtatcaggcagctaatccttaaggcctaatctccctgatggcttatgtgtaagggtttttaaaggtgggaaggcagaggttgcaggcaaggtcatacaatacatggaggctacatattggtttggccaaaaaaggcaaaatatctcaaagtgagggcccacaggataggtgaccattagatgaattcaaagattttctgatttgagaccaggtgcagtggttcacacctgtaatctcagcgctttgggaggccaaggtgggtggataacttgaggccaggagtttgagaccagccagaccaacatggcaaaacaccatctctactaaaaatacaaaaattatctgggcatggtggtgtgcacctgtaatcccagctactcaggaggctgaagcatgagaatcgtttgaacgtgggaggcagagggttcagtgagctgagatcgtgccactgcactccagcctgggcagcagagtgagactctgtctcaaacaaacaaacaaaaacccaaagattttctgatttgtgattggttaagttttggctacaaacttggggtcagcagaaaggaatgttctgctctggcctgtgggtgtgacttcctccaggtccctcaggaagaaatttagaacaaagaacagttgtgagtgttcagtcctcagttcctccttatctgagatctacgagccaacaggtggtattttccatttagcggggtctgggtttctacaaaacaactcagggacatatgttaagatgttatctctagtttctatagggaaacaaacattttgtggctctaattttctttttttttttaattatactttaagttttagggtacatgtgcacaacgtgcaggtctgttacgtatgtatacatgtaccatgttggtgtgctgcacccattaactcgtcatttaagattagtttgtggctctaattttcttgactattgttttaagctattattaccttcttacttatcagggtgctcatctacttcttgaggctagccaggtggctggaattttccttggagggactcaagagtttcctttatttttcatgccttaaatgggtctgttctccctcttcaaagctcaagctcttaaggactatgctattgttagatttttcgtattggagcagtccttccctcctactcaagaacaccccttcttcagacagcctggctgggtcttcatcctgggagagctcatgaaacacaaaccagatcttggccctcacgtgtgtctaggcagagctgagcctgggcaacaccaagcgtgcccccaattttgcatgccccagccaattcagagtcaagatccacgctcagctccttccctgcaaagtgctaatgatgaaggatggggatcaagtcagcaaactccagaaatggtcttagactaggagtcaagccttgagatcctattacacaccagattcattccctgattagagctgctgaattcttttactctcactgcactcatgctaaagtttctttcctccagcctcataaccccagaggaggctgagccatgatacccattgtctagcaataaatatttaaggagcccctgagatatgtcaggcaccatcgcaggtgctgggacaagtgaatgtgaccaggaaagtccctcccctctcagaggttcttttcaagttggaggacagcaaatacagaaatatagagtctaacataacaacagggagtaataaacactttgaagaaaaataaagtggaataagagggtagggttgccatagggttctctgggcagtcttctatggaaaggccacttgttggggcagagaaaaaaaagatgtctgaaaggaggactaccggccccccataagtgcgctccggtccatgcacagggcaatgggcatgtaatttcctatgattaagacctacagtatgtacaatattactgcaacagacactgagactgacttagcattgtttcatagcatccgagttgctctgttggaggaaagtgcatgtgatgggcattcatttgcttccgccatcagacagattctctacctttgtctttcctacaagattccctaggaaggcagggctcagtggctcatgcctgtaagcccagcaatttgggagtctgaggcagtcagatcacaaggtcaggagttcaagaccagcttggccaacatggcgaaaccccgtctctactaaaaatacaaaaattagctgggcatgggggcacgtgcctgtaatcccagctactcaggaggctgaggcaggagaattgcttgaacagagacccgggaggcagaggttgcagtgagccaagatcgcaccactgcactccagcctgggctacagagtgagactctgataaataaataataaataaataaatgattccctaggaagctgactcccactgaatgtgccactcaggagtccctgctctctagattacagttgagtttgctcaatgcaaggccccagcagaaatgttgaaagtaagagcaaatagatagttaaccactctttaagacaacaatggatgtatacttctctggcctcagctcctgtggggaagctccagtgccagtccctgggtgcttcaccattttccgttagttcctgaaccttgtaaactgacccttcactaaattcttcctagttaaccctttgagaatgaaaccatttcctgccaggactctgacagatacaaagaacccacagccgactgctgggtgcgcggcagacctagtgcatggctccacactgccatcttgggggctggcacaggctggcactgagtctggggaagggagctggggctggaggtgtggaggggaagaccgtgcatagttgcttcctgatcagctctttattcgattgagagtgaggcagggaagattagagggaagcttacagtggaattcagggctgaggctgctattcttttgctccttgtaacttcctacagtgttgtcagcatccacatacttctctgtggggttggtctcagagccaggttaccttgtcttaggtccagtggcagcctgactggcttggtgtccttgaacaagttacctaacctctccatacctcagtccctcagctgtaaaatttttttaaaaaaaaagaagaagagtacctactgtatagcattgatttgaagattgaatgagctggtattatacaacgtttagaagcagtgcctgacatgcaaaaggctctcaacaaatactatcctttactaatatcctgtgtgtctgtatcagagctggtggggtggagggacagaaagaagtaggagaaggtaaagagatgggaaaatgatctctaaagtctctctggcactaacacaattctttattatgtgttttgtctggctctttatattgatagctgttccagaagcaatcaatagctattagtcggttttattcttatttttctgtctgatcttacaggggagcaaactgtggcaaagcatgaacttacttctcagaaaattaaccattatgttggcaatcactgtgattatttgaacttcagcatctggacaaatttagtcacatgaaatacagaagagagatttctcatggttaaaatgaagctctctttatttgcttctgctaattaaaaaatcagagctaaagatacttaaacactacagttaaaatgccatggttgtctattggcttaatgaattctcttatgaaatcaactctaaaatgttatccatcataaatcatgaaacacaatttttcttattctctttagagctttacaattcatcttaaagaccagtgtttacactctcttccgtaggttgtacaataacctttggcgagaaaaaataaatgtctggctttctgactcataggtgtgttccctttaacagaaaaagaaaatatgtcctctttaaaactgatgatcattggtcacctcaattttattgaagttcacttctgacctctttagatgtagttctctacataaaactgcccaacagaattctctgtctgaatgcctcctccacaaacaaaattttaagaactaaaatcatcatctttccttccaaatgtgctctccctatgtccccagggctctccatgtgtagagctgagaccatttgccactcagtttcctcacccaattaattacaagtcccaacaattttccgttgtttttttttttttagacggagtcttgctctgtcaccaggctggtgtgcggtggtgcaatctcagctcactgcaacctccactgcctgggttcaagcgattctcctgcctcagcttcccaagtagctgggattataggtgtgtgccactacatccagataatttttgtatttttagtagagaggggatttcaccatattggcccagatgatctcaatctcttgacctcatgatctgcccaccttggcctcccaaagtgctgggattacaggcgtgagccaccatccctggcccagttttgcctttttaacatccctcagctcttcaaatccattttctcttctctaacacctccccattccccagctcgtaatgaactcttaagtagattactacgatcacctcccaaatggtcttcctggctccatcagccttgtgaccttcaagttcattctccacatggatgtcagagtaactttctaaaatgaaaatctgaccacgttactctcttgcctaaatccgcctatggccgctgttaggatcaagtctaaactcccgaccctggaacatcaggtctttgtgctctgttcagtgcttctctacctcacctgcaaccaacaccactcccacatccatattctgctcaccgtgtatcaacatgaacaggaggtgggtgcttcagtccccaggaagacactgggccttttcaatcatctactgctgtgtaataaccaccctgcaaactgaccacatgatttcattttgcaagggttccttccttgggctgtgttcagcaaaagggtttactgagctggcaggtccaagatggcctcactcacaggactggctgttgatgggagccttgatgctcttgggctcaccccttatcctccagtaggttagagcttcttacagtggtttcaggcagcatctgaagacagtaaatgcagaagctccaaggcttcttacattctagcctggaaaatcacatcacattgcttccttcatatttttttggcaaatcaggttgcaaggcttgcccagattagggtaaagaggcaaagaggctccttttcttttctttttcttttttttttttttgagtcagaatcttgctctgttgcccaggctggagtgcagtggcgcgatctaggctcactgcaagctctgcctcctgggttcacgccattcccctgcctcaggctcccaagtagctgagactacaggcacctaccaccacgcctggctaatttttttttttttttgtattttttggtagagactgtgtttcactgtgttaggcaggatggtctccatctcctgacctcgtgatctgcctgccttggcctcccaaagtgctgggattacaggcgtgagccaccgtgcctgaccaagaggctccttttcttgatgaaaggagtagtgaagtcacattgcatgtccttgcaaagggacatgcagaccacattagtgagaatatgtgcctgtattttgcaatctgtaacatgggcataaactaaatgttttccaaagggaatagggcaaaacaaaaaggaccttgaccactcctttggccctgaataaatctaggaagcctaagagtatgactatcctgaggtagaaagagggtcacatgctggataagaggtacctgggctctccacttacaagaagagagcatggttacatttataatcaccattcccaacacgctgtgagtgcaggcagctaccaggaggagaacaaaggaaataaccaggacacccatctctaaacctgttaatttaatcacacggaacacttctatttaaaattcccgagggttaagatgtaagaatgcttatcaaggtaaatgctgttcacactgcttggagtgtcaggcctagatctctatccatcagaaacaacaatatcaataacaacaacagcaacatgatgatggggcaatttctgaaaagcaccatgtattttatcgatacatgtccgttgcagaaaatccaggtgaatccaaagaagaaataaatgtcttccacaatcccatagcccagagctaactaaccactataaagaacccagcgtggttttaactaatggatcaaaagatgctcatcaaaggctctgagctttcctgagtgctaacaggaaacatccagcatcactggtctctccaaggctgcaggtgtctttgcccatagtgcctgttttgtgtcagggaaagaatcaacctgggagccaagcccaggaatcaggatgaccaagacatactggacaaggagggaacaaacccatccaaggacactcaaggacaaatcaagcaaatgaatttaagggagacctgctcatggtctgctttgctgctcagcatggctgggaggcacagtggaagatcatgcatccttcccctgggactcctctgccagagcctgagagctttctcctgcacacaggctaggggtagggcagttggaattgatccatgccttctagctagactgtgggtcccctcagtcttgggcatggtgacagcccagcatcagacagaggtcagtatcaaactagaaaatttaataaatgctgtcagatttgtagacccaagaaaatataaactgccaatcacggaggaaaaaaatctctcaatgatcttatctttatatgattcccttgctgcctggagattgacatttccttggggataatctggtcataggattggtgaaggtggaagggaggcaacctccgaaggtggggccctctgctcacctgggacagggagggcctgaggtaggtgtctgtgtgggctggggaggaggatgggagcagtgcttctagatgtttccactttctcctcattagataataatgaatgggtgatttccctagtcactgcagtgtgaggaaatctacaaaattaatttcacaatacactttacaggataggtggagaaacacatgaagcacaactgcagtgggttataaaaaatggcctttcgagttgagcagtaaattcgttcaagcagccattctgaaggacaaactggctctgtatttaacaggggcattccagcacttctctagctactgggttgacaatgactcaccaaagcctctggtagccaccacaggacgcccagagcacgttttaaagctgaacaccaaactgcggacttcgggagtaagtgaactgactggtttttattttgttttactgcttttaacattacagtaactgttacaggttccagcaggataactgggtggaaatgagtttggtttcacttagtctctctaaagagaaagcaagttggtagactaatacctaataaaagcaaagctgccaacaattgaaattgcctggactgctctgtgtgtcccacatgcatgggtgtgggtgccagtgtgtgtgcgtgtgtgcatgcatgtgcatgtgtgttgggatagagtggtaagaaaatgggaaataataagaatgttcagtccatagcccttcattataaaaaggtgagctgtaataaatactagtgccacatttagccaaaactttactccagccaaaggtgatattttcatgataacatcctgtgattgctttgttcttcgtcttttatgttcttcctagatgggctcagaacatacaagaattaagtacacatcttattttccagtgataatgctaccggcaaattctgttgtttgtataaacatcagccatgtttatataactaaactagtgttttgttttgtcaattcagcaagaaattagaccacatggtggcttaatgctgcattgatttggctatcaatttgttttcacttttctgcaaaatatttaatacattattaaattgaattatgctgatgccacagttgttcttatctcaattgtcttaaaattcatttaatttttttttcctttggtttcattattcaaattttaacttcagttctcaacattttatctgatggaagagatggagtccattactaaggactccattgtgctccatcatgccagagttgtaaaatagatcttttaaaggaaatttactgtgatttttttctatttaagagcttcctctccagttgagcatgtaagaaaattataccaggagaatacagtaaactctatgaggcaagctataaacatgtagcattgtgattagggctggttctccttctagagacatggtaggattgcaatttcataccatccttgaagttagagagagccacgtgactcatttagccaatgaactgtgagcagaatgacatgtcacttccagcagaagctttaagaatctgagagacattcatacgttttccatgtgctgtagccttatacccaaagcctgggtcccaagtgaccatgacaggcagagctccctgttgagccacagagatttagagaatggctgttaacacagcataatccagcccatcctgactaatctgatattaacatgtataataaagaattctatcaatgctgagggaagatgattagttaaggtcctaggttgcaagtctcaaaacctcttctaaggattgtagacaggaaattaaatgacttctagtccctagagttcccaatctcctaccatcccatcctaatatgacagaagtaattcctgagttgcttctgaaaccagagcttccctcagaacccttagcctgccagatggcttcttggagagccctcactcacttttctccttctgctattgctgctcattcattccagcttttaaaaattcatctttatccaggaacctcgcttctagaaaagtcatacaggtgcttccaggaggctacatgggcacccatatttttctagccactttcattagaccaatgcagcagagaagaaaagcctcaataattattatgacatggcatgttaggataccaggtaaattgcatttgtaaaatgtgattttctgttggtgttcacttcggctctactgacatttggtaagtattattgactgactgactaactaatgtggtcattagtcttcataaagaaaggctctctacaaaaacggagggatgccctttttctggcatttaatacgtaagaaattgcctccgatagaaaccagagttgcctgattactatcagcacaggagaaatgtattaatgtgcctttctagtaacaggtttttagaaagtcaaatataaacaaatctgtctatttgtgtgtgtgcatgtggtagtggggagggaagaaaaaaggagggggagagaaagagaaataagaaccaagtttattatactgtattcagggggaaaacattttcccaaggttctaacagaagagcaaagtgccactgtcaatagcctcagtagtgtgagggttgcttttatgtatttatttatttacttatttatttatttttcctttttttttcctttctctttttttcttctttttttttttttggacagagtctcacactgtcgcctgggctggagtgcattagcgcaatcttgactcactgcaacttctgcctcccaggttcaagtgattctcctgcctcagccgcccaagtagctgggattacaggtgtctgccaccgtgcctagataatttttttatatttttagtagagatgaggtttcactatgttggccacgctggtctcaaactcctgacctcatgatccacccacgttggcctcccaaagtgctgggattacaggcgtgagccaccgcccctggccaggattgcttttatagccagtcttcaggtgcccactgtaggaacaatgtcatttagccctcgggattattctgtgccaaatatggataatgactaatattcaacacagatattctcagctcagaagagcaattagcaaattcataaattaagtgcttgcttcctttttagtcaaatacaaacatttgttaaaagatattattttgctttacactttgtctctcagaaataaacagatgcttgaattcccacagtgctgcttgagcctcacaccatgtcatcctgccaggcacccagatccagttctagagtttcacatgatcatgagtgttggttaataagtcactgtgaactgggaggggagatttttcaggagtgccacagggctctccctttaatcacatacactccctgctttcattggaaagtgtataatgatgtcagagtgccccagaatggagctagttggaagactgccgtcatagggatgccttagtgaatcaatcaggttttaatttctggctctcaactttgtagatgtaaaagttgatttatcaatatgtgagaaaggatgaatctttctgaaggttatgtcatcacactcactaagcacacagagaataatgtctagaatctgagtgccatgttatcaaattatactgagactcttgcagtcacacgggctgacatgtaagcattgccatgcctagtacagactctccctgcagatgaaattatatgggatgctaaattataatcagaacaatgtttggtgagccaaaactacaacaagggaagctaattggatgaatttataaaaatatacctcagccaaaatagcttaattcagtctcccttatcataaggatactcttgcctaaagggacagtaatattaaagacactgggaataacctctgtactttggacagtagacctgcatagcccattaggcctcaatgaagtcttatgcaagaccagaagccaatttgccattttaaggtgattctccatgtttctgctctaactgtgcttcacaatactcaagacactgaatcaggatgtttcctggagtgcagggagctgtccgtgttactgagcagttctcagcaacacaaagatcctactgactcctcatcagacttctttctcactggaattttacacctgggctgttaacaccaggccaggtcaaattcaaaggagagaaaaaagctcattatgaagggtaaaatccaaaacactgtgcataaagatatgtgtgcacaatttttatacataaagatttcataaagccaaagcatcaggaaatgaaaagagatacagaaagaaaaatgatggtaaatgagacattaatttacccttctaatctctatcacagcaaaaaggtaattaaaaaatctatatgaggaccaaaaaatacacaaagattatgtagcaaagcctatagcctaaaaaagtaaacattgaaatttgtatgtccataaaatgtttacaaaattcagtacatattacacaccccaccctaaaaacatctaagcaaagtagagaatgtagaaatgctacagattatattctctgattatgacacgacaaaactagaaattacagcatggaaatttaaaagctttctcttaaataattctatgtcaaaaagaaatccaggccgggtacagtggctcatgcctgtaattccagtactttgggaggccaaggtgggcaggtcacttgaggtcaggagttcaagaccagcctcgtcaacatggcgacaccctgtctctactaaaaatacaaaaattagctgggcctggtggcgcatgcctgtaatcccagctacttaggaggctgaggcaggagaattccttgaacccagaaggtggaggttgcagtgagctgagattgcaccactgcactccagcctaggtgacacagcaagactctgtcaaaaaaaaaaaaaaaaaagaaatccaaataaaatttccagaatatgtggaaaatagtgacaataaaaatattacacatgtgtaatcccagcattttgagatgccaaggtggcaggatcacttgagaccaggagttcgcaaccagcctggacaacatagggagactccatctccacacacgccaaaaaaaaattttaaatagccaggtatagtggtacttcttgtaatcccatctacttgggaggctaaggtgggagaatcacccaacctcaggagttcagggcttcagcaagccatgatcatatcactgcactccagcctcagcaacagagcaagatcctatctcaaaaaaaaaaaaaaaaaatcacatgtgggaaatagctatagcacaataaaaataaatgtattaagtatgaacaacaaaaaagctagtaaaggttgaacaacaactatccttaggaaagtggaaataatgtgttaataaatatgaaagcaggctaggcacggtgactcacatctgtaatcccagcactttgggaggctgaggcaggcagatcacctgaggtcaggagttccagaccagcctggccaacatggtgaaatcttgtctctcctacaaatacaaaaactagccaggcttggttgcgcactcctgtaattccagctacttgggaggctgaggcaggagaatctcttgaacctgagaggcagaggttgcagtgagccaagatcatgccactgcactccaactggggcaacagagtgacactccatctcaaaataaataaataagaaagcagaaactaataaattagaaaacagaaacatagaactaatttataaatcaaagcactatgccttgaaaagagggagaaaaattgtgaattaaggaagggaagagatggttggagaggaggtgggagaaggcagagataattgaaggagcaaaagcatctggagaagcaaagccactgaaagatgaacagggctctgaaagaaatgcttgattgctatcttttcaaatgactgcagttcccagtgacatcatttttctcctccctggaagtctgaggggcagttcacttatctcctcccctcccctactcctcaccccacactcaaaacctgtctatgctcctttcattctcatatgacagatttcagatggcattcttatttccctgatttctttttgagatagcttgcatttccctactctatataaagccaccgtttatcaaatgcctacatggaccaagcagtccacaagggcttcacagacagttttactaaactcatgccaaaactttcaggttttatagataaagatctataccttatagataaaggtatctataaggtatagataaaggtaaggtatctataccttatagataaagaaattgaagcttatagagtttaagtaatgttcccaaagcctcgtggctagtaattcaaacctaatttctgcctactccaaagtctatttttcctcatgatactatactgcctctccatggataaagacagagatcacatattaataaaatttgcacaaagtcggcaaattgttgaaagggaaggctaagatgattaataaaatcaagagccagatgatctcaacaacctgaaataactggctgacaaccaatttgaataactccctgcgggtgaagttcaaagtactatttggggtttttttttaagtttggctgggtgcagcggctcacgcctgtaatccaagcacttagggaagccaaggtgggtggatcatgaagtcaggagttgaagaccagcccggtcaacatggtgaaaccccatctctactaaaaataaaaaattagccgggcctgctggtggatgcctgtagtcccagctactcgggaggctaaggcaggagaatcgcttgaacccaggaggtggaggttgcagggagccgagatcgcaccactgcactccagcctgggtgacagggcgagattccgtctcaaaaaataaaataaaataaaataaaaaataaaagtttgatatattcagaatcagggaggtctgttgggtgcagttcatttgaaaaattcctcagcattttagtgatctgtatggtccctctatccgtcagggtcctagcaggaaattgttgcactctcaaaggattaagcagaaagagtttaatgaagggtctctttccagggttaagggaactgctagggtttggatatttgaccactccaaactcatgttgaaatgtgatccccattgttggaggtggggcctaatgggaggtgttttggtcctgagtgtggacctctcacgaatgtcttggtgccatccaagtgagttcttgctcgctctttttttctttttgagatgtagtttcactcttgctgcccaggttggaatgtagtggtgcgatcttggctcactgcaacatccacctcacgggttcaacccattctcctgtgtcagcctccagagtagctaggattacaggtacccaccactatgcccagctaatttttggtatttttagtagagacggggtttcaccatgttggccaggctggtctcaaactcctgacctcaggtgatccacctgcctcggcctcccaaagtgctgggattacaggcgtaagccaccgtgcctacctagttctagctctcttaattcccacaagagctggttgttaacaagagcctggtacaaacccctctctcttgccacgtgatctctgcacatgccagcttcccttccccttctgccatgagtggaaacagactaaagccctcaccagaagcaaatggtggcaccatgcttcttgcacaccttcagaactgtgaaccaaataaacctctcttctttaaaattattcagcctctggtattcctttataacaacacacacacacacacacacacacacacacacacacacacgcaaaagcagactaaaacaggaactaattagaaatggtaatgcaccgagggattggcaccgaggctccccaacaggaactgaggccatggatagaaggacacattcatgttatttttttctaatggttaagtaattatttgctcttactctcaaaatttctgccaaggcctcccatggaccaaactcaactaggatctaggaagcagagaacctgagtgttgcattcagcagaagtcagcttcctagggaatattgcaggaagggtgaaggtagagaatctggtggggaagcaagcaaatgcccatcacatgcactttcctccaacagagcgactcagatgctataaaacttgctaacgcagtctcagggtctgatcacagtaacatacaagccaggttttagtcatcagaaatcgcagtcctattgtcttctgcacagacccaaacacacttggaggtcatgttcaatatgaatacctcacagagaaggaaatttacacacgagaagtacatctgcagaaagccagctggcatgtcaaccattcgaaaactcagggtgttcgggataaagaagactcaggaagacaagtatgaagcataatctgtgacattattgatatcttcctgatatcaatattattgatatcttcctgaagaacataattcctgcctaccatcaacaagcatcaatactttctaccagctattctcaaccctcatcatcggaagagacagacactgactgtgtcaaagtattagtcccatcattcagcaattaactttagctcaatgcttcaaaaattcttcaggccctgtgtaatttcagctatgtacattaatgatgagtacccatacaaccattctgtttcttattttcagtaccatatttaataaatatcagttattcaatactttatttagacattttgttagattattttgaccaatgaagtctaatctaaatgttctgagcatgttcaaagtaagctaggctaacctataatttttggtgtgctaaatgcatttttaacttatgatattttcagtttacgggggtttgttgggacataacttcatcatacatcaaggagcatctgtatatgggatatagttaaagcagtgatcagaggaaaatctatagccttaacacatttattaataaaagtgtaggaattaaattatcagctgaaaaatgtaaaaagtatctaaaagagtaagcagaaagtacaagaaagaacccatagtagaaaaaagtgaaaattaataaaataagaagccaaaaaacagatcaaatcagtaaaccaaaaatcttgttctttaaacaaatcaacaaagttgacaaaaaattagatcttttaatcatgaataaaaaaagagaaagcacaaaaatgaataaggaatggtgagagaaataactattgataatcagcaaataaaaaatcattaaaaacaatgttgttcacatctatgaaaaacattgaaagctagagggaatgggtaattttccagaaaaatacaattcaccacaattgacttcaaaaaaaaaaaaaaaaagaagtacagcacttatgtgagcaatttccatagagaaatacagttgtcatggaattataacacacacacaaacactaggtttagatgttttcacagagaattccaccaaacctttagaaatcagatcatccaaaggcaaattaacaaccctcagccatttgaggcaaaatattacaattgaggcaagatatactgtactgaaaacttgaggaaaaagcaggagagaaagttcctttgggaaattcgaatactcaaaagtgcttacatacaatgaaaaatttggaaatccataagcatggccaaggtgggacacatgctcagaaaaggcctgagaagacactaataactcacctttagtaattcctaggctcacagcaagaaaaaatgaaggctaaggcagaattatatatggctccgctaagtgttgagggagccccaatacagagtcagtaagcaaagtctgggagatgtttttcatatttttttcttttttggctccttgcagtcaaggaaatcatttttaaatcactaaatgctaaatgaacacaagctaaaggaaccgagccgccttcaaacatcaaacataaaaaagaatgcagatattacaaaaccagtttacaaaagttactaaacaaataaaaactacatcccacagtgggtaacaaaaataaccttgaagaagggaaaaatttggtttccagaataaacacattataatatccaaaatgtccagttttcaacaaaaattaagaagcatgcaaataaacacaaaactatggcccatttacagaagaaataaatgagactctccctgagtaagcagatattggaaatattagacaaaaactttatataactgtcttaaataaacttaaagagctaaagaaacccaagagaatgacatataaataaataagaaatatgaattttttaaaaggtacaaaaaaattctgaggctgaaaagtacaataactaattaaaaagttactttttacttagggttccaatagaagatttgagcagctggaaaaaagaatcagtgaacttgatagatcaagtgaaatgattcagtctgaagagcaggaaaatgaaagaatgacaacaaaaaagaatagagcctaaagacctgtgtaacaacatcaagaatgcctacatacagaatcctggtggggagtgaggggcaggaagactatttgaagaaatgtgtttgaaagcttcccaaatttcactaaaaacaaatatatacattcaaaaagctcagtgcacttcatcaaggaaatatacaaagatattcacaccaagacacactatgtttcaaattgtcaaaaggcaaagcgaatgtttgaaagcagcaagagaaaggcaacgcgtcatttacaaaggatcctcaataagtttgacagcagatagtgcattataatccatggatgccagaagagcttaggaaaaaggcaatgcatcatttacaaaggattctcagtaagtttgacagcagagagctcattataaaccatgggtgccagaagagcttagaatgacattttaaagttctgaaagaaaaaaacactgtcaaccaaaaattctgtaacttggaagatgccccttcaagtattaaggataaattacacattcccagattaaaaaaaaaagagagagagaaagagaaagaaagaaagaagagagagaaagaaagggagagaaagaaaaagaaagaaagaaagaaagagaaagaaagaaagaaagaaagaaagaaagaaagaaagaaagaaagaaagaaagaaagaaagaaaaagaaagaaaagaaagaaagaaaagcaagcaagctttaaaagttcatgtttggtaggctgtacttcaagatacacttttaaaaaaaaagactccttcagatacaaactaaaaaacactagaaagtaactcaaaaccacataaagaaataactccagtaaagataactacataggtaaatataaaagcaattatcatattttttgtaagtctttttaaatattctatatgttttaaaacaaatgtgtaaaataatgactataaatctatgttaatgaagcatgatgtataaagatgtggtttgtgaaattaccaacataaagaaattcataggaaactaaataataatagagattttgtatactattgaagttgtttcaatttactctaaattgttccaaattaagaatgttaattgtaaatccccatggtaaccactaagttaatatcttttgaaaatacagaaaaggaaagcagagggtaaacacagtgatatgctacaaaatagcaactaaacacaaaagaaggcgataattgaggaaattaggaacaaaggaggtataagacatacagaaaacaaaagcaaaatggtaggagtaagcccctctttatcagtaattacattaaatacaaatgaattaaactctccaatccaaagaaagagattgacagaatggatttttaaaaaatgatccaactatattgtccacaagatactcactttagatcaaaatacacaatgagttgaaatgaaaggatgggagaaaatattccatgtaagtaataaccaaaggagatctgaggcaaatatacttatatcagacaaaatagactttaagtcaaaaactgttacaaaatacaaagaacagtatatattgatttcaaaattaaacaagaagatataacaattataaatatatgtacaccaactaacagggctccaaaatatataatgtaaccattgagagaattaaagggagagacagacaattccacgaaaattgttgggcattttaaaacccaactttaataaaggacaaaacacccagagcaaatatcaagggaggaattagaggatttgaataaaactataagcaataactatagataacacttctctcaaaaactgcagaatacacattcttctcaagtgaacatggaacattctccagcacagatgatatgttaggccataagataagctcaataaacttaaaaagattgaaatcatgcaaagtatcttcactgaccacaatggaatgaaataagatatcaataacaaaagaaaaactagaaaatttacaaatatttggaaattaaacaacacagtatttaccaaccaatgaatcaaagaacaaatcatgagggaaattagaaaatgtttagagacgattgaaaacaaagatataacaagatgggtgtgatatatcaaaagcagtgctcagagttgtaacacctacattttaaaaaagaaacatgtcaaatcaataaccaaactttactcaataaaccataaaaggaagagcaaacaaaatccagagctagcagaaggaaggaaataaagattagagcagagataaatgaaattgagaattaaaaaattatacagagatcaacaaaactaaaagttggttcttttaaaatatcaataaaattaatatacttttacatagactaagcaaaacatctctattcagctgacttttttttacaagggagccaacattattcagtggggaataatagctttttcaacaaaaagtgctgggaatactgaatattcatatgcaaaaaaaatgaagctggacccctacctcacattatatacaaaatctagattggatcaataatgtaaatatacgagtgaaaaccatacatgcttagaagaaaacatggaaataaaacattgctgtggattggcaatgcattcttagataatacaacaaaaatacaagcatgaaacaaacaaatgtagccaaaatgtaccagaatctgaaaacatgtattatctataaagaattagaggggaatttggtgaaagaaatatgggagaatgggatattgctctgtgaatgcttttgtgcataattgtacatttttaattaagttaatcttttacactctcaaagtgtgatattaagcaagcaaagataagttattacaagactctaaaaccgaatgcaatgagaaacaagtgaatccaaatatatttcaaatgaatgaatgacataatcaaacttaaggggaaaataataattaatctgattaatttttgactgttctcttatttcaaattgacttttgaacatactttgactacatactattgcttgaaaaaataaaatatctgcaaaaaattattaaatcttcatgataggattttttctttttatattagtataaatataacaattctgaaacaaatgtatgtgcattgtaagattaagccaatgagtaaatattaatatatttgtattgctagaaccccagattctcactgtgaaaggacagagatacagatatggaataagacaaggaaagaagcagcccactgagttacattagaatcagtattatcaacataaatatacaatgtgctctctcacatgctctttccttctcttaaaaaatatataatatgtacatattatatattatatgcatagacacacgtgtgtctatacatatcctacatgtacatattgaggattaacaggtgctagtagaaaatattaactttctttgtattaacaggtgttagtagaaagtagtagtaggtgctaagataaaagccataattaaacctcctggtgaatgaacacaccatcacctacaatcttaccaaaaatagaaccaagcacgtgtcctagtcaaacctctggattcaactgtcatttggataaaacgcaaaggatagtgaaaatgtcgatcttcactgagagtctaaccagcaaaattcacagtgtggacaccaagtgacaaaaatcccaaatttttcaacaaatatattgtatgggaaagaaaactttgaaaagaaacctgtatgttagaagggattttaaaaacacgacaaatgaaaacaaatgggcaagactaaatcatagtgtcttggaatgcatgcaggaaggacacagccgtgaaaatgcaaggacgcctctactggaacagtcacgtttatcgtcacttttcaggagaaaggtggctgcaactgaggagagtcacatgcttcagggctggcaaagtcctatatcttgacttatgtgatgattacagggatgtttacaaaaatcaaactataagtttgttttgtgccatgttttgtattgtgtgtgtgtgtgttttgtttttcaacttaaaaataaataaaatcaaaaccaaggcttcattatcaagtagcacaaagtctccaatctataacctcctttgtctggatatctgcatttaactaccattgccagagctaatcctgacaatgcattcatatttttaacactgaaacacagtaaacagggaaaattttgctcctctaaaacagggcatcttcaggcaatcagaacaactcagaaagtttctgtctgttgcataaaactcccctgtgcaaagagttacacaaaatgctgtcatagtaaaggtagttaactaacggcactaattgttcttgggcagtggccaagtggaacttcagagacctggcattgccagccagaaatcacttgtcatgggaattgtctcctggaatcactttggttgtcccagggtaacgcagggaaagtggttaatgggtcacttgggggtggcatcttcatcagtaaatcacatttactttctcctactaagaattttatttttggccatgaagccaaaagtcagctcttaaataacaagggaagcaaataatcattgaataaaaatagcaggaagaaaaagctgtgcaaagaaatttatgtttttaatttgttatatatgtatatttttatcatactttaagttctagggtacatgtgcacaatgtgcaggaataaaatttatgtttttaaaatttattctacattatgaattctacattagaaaaataaaccatagcctcatcacaggcacttaaatacactgaagctgccaaaacaatctatcgttttgcctacgtacttatcaacttcctcatagcaaactgggagaaaaaagcaatggaatgaataaaatgatagccacaaaaatcaaggtgggagaaatacttattatatgtccataaaaaattttaattaatgcaaagtattaacaccaatgattgcagtaatacagatcttacaaatgatagttttagtctgaacaggactatccaaaagttaattttctatagtaacagtttttaaataaaatatcaattcctgaaacacataaaatggtccatgagtatacaacgagtgaaaaaaaacaaattcagagcaaagataaattaagaagtatctaatattcaaacatagtcaaagagagggagatttctggataatcacttaaacccatggttaaacataaatgcacatatgttaatgtttactgaataacttatctgtgccaagtggtgtattaatgattcatttttatttttcactaaatcttttctctaaagttggtgtagcctgcaactaaatgcaagaaatctgacctaggacctgcacttcttaccattttgctcatatttattccctgtgcatttttgtaacatgtatatgttatatatatagaaagagagagaggcagagatggaaagtaatttatggagtttgatgttatgtcagggtaattacatgattatataattaacaggtttctttttaaatcagctatatcaatagaaaaataaatgtaggaatcaagagactcattctgtccatctgtgatagttccatcatgatactgcattgtcaagtcattgctccaaaaatatggtttagctcaacactgagtgactataggaaaccagaaaccaggctgggcgctaaagatgcaaagatgaatgagacatcatctctgccgtccaaaagcttactgtctagtgggagagttacacacgtaaggacagtaatctaataagagctaataagtgaaaactaagataaattaataatacaagattacagggaaggtttccaaagtcaatgaggcctcaaatgaatcttgaaagtgtgcaaggattaaccaaatgaagaaatgtgtaagtttttcaaacaaaaaggaacagcatgagcaaatgcaaggaggcctaaaataaagagatgtgtaaagaggtgtaagcagctttgtactgctgcctgataattagaagaatatcgggagtaacaagagctatagaagagagtcacaattacggaaaaatatttattaaattataagaaatttatagcataaggaatagtaggaccgttaaatgttttaataaagatgatgcttctttttttaatatttatttttattatactttaagttctagggtacatgtgcacaacgtgcaggttacatatgtatacatgtgccgtgttggtgtgctgcacccattaactcatcatttacattaggtatatctcctaatgctatccctcccctctccccccaccccacaacaggccgcggtgtgtgatgttccccttcctgtgtccaagtgttctcattgttcaagtcccacctatgagtgaaaacatgcggtgtttggttttttgttcttgagatagatgatgctttaaattgaccactctagctgcattgtgggaggaaaaaagattttagaacaagactagaaacagaataattagaaaaatgcaactacaatgcagatgagtgattatcaaggtctgaactgaatagtggaaatagagataaggaggcaaattcaagatatgtgcgtgacagtaaaattaacatgacctggtgtttgattgactctgtaaagtgaaaggaaaggatgaataatcaacaaataatatttattctaccaaatgcctccatgccgctttgatgacaggataatatgtaagcttttctatatttcagaaactatatgacatgacgaaaagtaaaaaggggatgggggtaaggaggtatcctgaattgactgagaaataaggaggtattccacagagaatataaaaaaacatatacttagtgttcaaggaataataaaaaagagaacatctatgtgtccaccatacaggatatgaaatagaacatttgccggccatggtggctcacacctgtaatcccagtactttgggaggccgaggtgggaggatcacttaagcccaggacacaggttgcagtgagccaagatcacactattgtactccagcctgggccaccatgtctcagaaaaataaaaaaactagatgtcttggaggattggaaacaaaatagaactttactagtgccttagacgcccattgggtgctccttgccaattgtgttctcctttatttcctgctggatatgaccactgtccttccattgcattgtatgtgttttttaatagactttaatggttctcaagtgatgcattatttagtttggttctttgaaacttatataaatgaaattattttgtagaagttctttcacctttatcagaaggtactttcaccttgattcaataataagtttgcatattacaaccttgttgaatgttggtgtaattcatccattcgtattgctatatgatattccactacatgaatatgtcggacttcattcctcagatctattgttgatgaacacttgaaatttttccagtttttaactattacaaacaatgctgctatgaacattcttttgtaaatcacctggttcatatgtgcaagatatcctctggggtatatatttaaaagtaaaattattgagttattcaacattaccatgaaatgctacactattttttttaacaatcctaccaatttacacttctaccacgaacagataagcattaccattggtcttcatttgtaggaaccatatttgtcttttgctctgggggctttgttttgttttgctttgttttttgcttagaagtgctttggctattagggatctttttttggctccatgtgaactttaggatttttttttaattttgtgagaaataacgttggtaatttgatgggaattgcattaactctatagattgtatgggtgatatggtcactttagctattgatttttctaatccgtgagcatgggatgtttttccatttgtttatgtcatctataatttctttcattagtattttgtagttctccttgtagagatctttcatttatatagttatgcattcctaggtatttttcatggctattgtaaattcagttgagttcttaatttggttctcaacaaattaatctcaacaaacattcaaacagcttgaatgtatttggtgtatagaaatacaactgatttttgtggcttgtttatcccaagactttactgaagtcgtgtatcaagtctaggagtcttctgaagactttagggttttctaggcctacagtcatgtcatcagtgagcagagatcatttgacttcttttctaatttgtataccttttatttctttctcctttctgatagttctggctagcacttccagtactgtattgaataggaatgatgaaggtgaacatccttgcttttttccagtttctagaagcaacacttctaacttttgcccatccaggatgatgttggctgtggctttgtcatagatgactcattttttgaggtatactccatctatacctatattgttgagggtttttatcataaacagatgttggattttatcaaatgcttattctgcatctaatgagatgatcatagggtttttgttctcagttccatttatgtggtgaatcatgtttattgatttgtctattttgaaccattcaagcacccctggaataaagcccacttgatcatgatgaattatctttttgatgtgttgttagcttcagtttgctagaattttgttgagtatttttacatctgtgttgatcagggataaggatttgtagttttcttttgtgttctttttaaaattttccttgttaattttactgcacagtattattttaatgatgaataaagtgttgagctggacatgtgtaccttgttcctcatgttacaatgaaactgtttaatatgtcatgattatttataatgttgagagtagtttttgtgtatatattaagatatttacatcagttctcttctattcctagtttgttattattacaaatagtttcaaatgtgaacaagtgcttttcccacagctattgaaataaccatattttgttcttttattcagttaatgtggttaatttcattgtttggttttctaattttaaaccatacattcttgaaattactgcacttagtcacgatgtatttttctttggagtatattgttggattatatttgcaaacatttttgtttagaattattatgtagtatattagtctgtaatttcatttcttttaatatccctgtatggttttactatcatggaggtaccaccatataaaacaagttggaaagtgttatgtcttcccaattctctaaaaatattcatgtaacattggcattatttctttattaaatatttggtaatatttctttattaaatattgcatccacctagccctggagttctttctacaggaaaaaaaaattttctaaataaaatttctacaatgaaaaaaaaactactcagtttttctagtttttttctgatcatttcataaaagtaggtatttttcataggaacttgaccattccttatgattgtcaaatttattaatataaagtttcatattttatatttattttatcagataaataaaattatatgttttgaaatatatattcattgtaaaatagccatgttaagctaacatatgcattaccttacatgcttatctttttttatgagaacacttaaaaatctactcttagcaattttgaagaatacaagtacatcccctatggagaacagtttgaaggctcctcaaaaaagtaaaaatagagctaccatgtggtccagcaatcccactgctgcatatataccccccaaaaaagaaatcagtatatcgaagagatatctgcactcccgtatttgttgcagcactatttacaatagcgaagttatggagtcaacctaagtgtccatcaacagatgaatgaataaagaaaatgtggtacttatatacaatgaagtattattcagccataaaaaggaatgagaccctgtcatttgcaacaacatagatgaaactggaggtcattatgttaagtgaaataagccaggcacaaaaagacaaatactatgtgttatcacttatatgtggaatccaaaaagcaaacaactgaactcatggagatagagagtagaaggaagtataccagaggctgtgaagggtagtgggggttgggagaggtgggggatggttaatgggtacaaaaaaagaaagatttaataagacctagtatttgatagcacaacagggggattgcagtctaaaattcaattatacatttaaaaataactgaaagagtataattggattgtttataacacaaataataaatgcttgaggggatgaatatccaattttccattatgtacttattgtacattgcatgcctgtaccaaaatatttcatgtacctcataaatgtatacacctgctatgtacccacaaaaattaaatttaaaaacaatacattgttatccactatagtcaccatattgcacaatagatctgttgaattcattcctcctgtacaatgcaattttgtaccctttgaccaacatctacccaatcctcctggtaaccatcattctactctgtacttctatgtgttcagccttcttagacctccacatacaagtgagattatgcagtatctggctttctgtgcctggattattttactcagtataatgtcctcccggttcattcatgttgtcacaaatgatactttttttattttttaaggttgtatactattctattgtgtatgtgtaccacattttcttcatccactcatgtgtcgatggatacttaagttaattccacatcttggctgttgtgaataatgctacaataaatatgggagtacagataactcattgacacactgatttgatatctttttaatatatgcccagaaatagcattactgaatcatatggtaattctatttttacagaatcatttatactgtcttttacaatggctgaaatagtttacattctcaacaattacaaggttttccttttctccacatcctctccaacacttggtatcgtctgccttttctgtaacagccattctaacggatgtgaaatggcattttattgtagttttaatatgcatttctctgatgatcagtgataattagcatttttatatatctgttggccatttgtatgtcttcttttgagaaatgtctatttagatcctttgtcaatttttcattagggttccttgttttcttattattgtgttgtttgagttcctaagatattttggacattagcctcttatcaaatgtatagtttgcagataatttctcccattttgtaggttatcacttcactctgttgactttcttttgctgtgcagaagctttttaggttgatgctattccatttgtgttttgttgcttttcttgcctgtgctttagagtcatatcataaaatattattgcccagaccaatgtcttggagttattcccctgttttcttctaggagttctatagtgctaggtcttacatttaagtctaacttattttgagtttatatttttatatggtatgaaataagggcctaatatcaatcttgtggacattcagttttctcaacaccattttttgaagagactgttctttccccatgtgtgttcctggcacctttgttgaaagtcaattgactataatatgtagatttatttatgggctctttattctgtgtaattggtctatgtgtctgcgtttatgccagtaccatggtgtttcgattgctatagctatgtagtataatttgaagtcaggtaatgtgatatctcctgccttgctttttttgatcaagattattttggcttttcagagttttttgtgattccatacagatttgagagttgtttttctatttctgtgggaaaatgtcataggaattttgatagagattgcattcaatatgtacatcactttggatagtatggacatttcaaacatattactttttccaatccatgaacatgagatatctttccatttatttgtggcttcttcaatcgctttcatcaatgttttgtagttttcagtgtaaagatcattcacctctttgtttaaatttacatctaagtattttttgttgctattataaataggattgttttcttgatttctttttttgtatagtttgttgttgatgtgtagaaatgctactgaattttgtatgttcacattgtatcctgcaactttactaaattcatttatgaattctaaattttttggcagagttattggtgttttctatatataagatcatgtcaactgcaaacagaaacaatttaacttcttcctttccaattttcatgccttttatttctttcttttgcctaattgctctggctaggacatccagtactatgttgaatagaagttctgagagtgggcacccttgtatgaagtttcccacaacatctcttatctttttattagctatatattaatacggatgtttcttcttcatcaggagtttgaaaaatatgtcttttctctatattgttcttaatcagtcttcctagaagtatttcaatttcaaaaagtagcaacaactgtgggagttcagtcaggctggtgggaaaaattttaaagatagttttaagaaatcgacacaaaccttcatggaaggctgggggtgttgtatagcttcagtaatagatctgaatgaaggcggcctaatccttccttgagtaaacagcttaaagtaggtgcaaaggaatgtaagggagtttatctaaataacttgtttactcatgtggtcctgaagccaacctttgatcattcacaggcaggatggctctctctcgggggagggtgaccaggttaattaccctctatttgtgttgactaaaagcccctgtcatttaatgttttttcaataaatgctggcagggctagctagtcagggctcgtggctgccagaactctttctgtgcacggcccagccccctagcggctctttcactgaataattggtgtctgagtacattattcatccctcgtgcagctggggtctgcaggacagacccccacaaacaacaatttgcaaaagcaaacttccctgttttgttttttttcccgagatgataaattagaggcttttagtgtgcctcggccacttagaaatagcaagagagtgcacaaaggtcaactctgtgagctctacgtcaagaaggaaaatgggaatccaccagaatcatgaaggacatcatagatcccaagaaggagaatgtgagcaaacagtcaacatgacagcaaccagcttataaaagtgagcgaagtcctagtatgtgagagaggcagagagcctccctctgtaactgacattttcactgtgaatctgagcaaccccagccaagttgttgcattttgtttctcccaaggcctggagtcaacatggggagaggcttggagatgctgtgaagcaaagacactgggaacagctgcagacattttcccagaccaggaagtaagagcaagatgccattttcaatctggatgcatgcaaagtcagctttttttttttctttttgtgacccagcagaatgcctgcacaggcattttagtctcaggccaaagattggaacaactgctttggggcttggtagggaccttcacagccatattgtgggaaacacctcagcagtatgtgctggaattgtgctttcccccatcgcagcctcggggcaacagaaaagctgctacagctgtaatttctcccaggtgatgaaacttgcagccagggccagcttggagacctacaaccagtctgcaggtgtcattgctgggtgccccagcctgttcccctgagaatgtgatacagcagggctttctctgcttcacccccaggcagaaattcaggcattggagcacctgtctacctggaccagcatcctgagctaccccaccgtttgtaaacataggttgtggtgcagtggggccctctccagtctatggccaggcagatttccaggtatgtggagtacccacttgactggatcagcagcctgagcttccccaaccttcctgtgctgagattatagtgcagtgaggccctctcatctccacacataggcagacctccaagcaattagagcacctgctcctatggagaacttaaatttacaagaaaaaaaaaaccatcaaaaattggccaaaggacatgaacagacaatcctcaaaagaagacatggatgtggccaacaaacatatgaaaaaaagctcaaatcactgatcattagagaaatgcaactcaaaaccacaatgagatactatctcaaaccagtcttaatggtgattatcaaaaactccagaaacaacagttgctggtaaggctgtggagaaataggaatgtttctacactgtttgtgggaatgtaaattagttcattcactgtggaaggcagtgtgaaaattcctcaaagatctagaaccagaaatgccatttgccccagcaatccctttactggatatatgcccaaaggaatataaatcactctattataaagatacatgcacagggctgggtgcagtggctcacacctgtaatcccagcactttgggaggccaaggcgggtggatcacctgaggacaggagtttgagaccagcctagccaacatggggaaactccatctctactaaaaatacaaaaattagccaggtatagtggtgcacacctgtaataccagctactttggaggctgaggcaggagaatcgctggaacccaggaggcagaggtcaaagtgagccaagatcataccattgcactccagcctgggcaacaagagcaaaactccatctcaaaaaaatatatatatacatatacatacatatatatacatatatatacacatatatatatacatatatacatatattatataggtaaatgtatatatatgtgtatatatatacacacatatatatacacatatatatacatattataactacatatatatacacacacacatacatatacatgcacacatatgtttattgcagcactatttatgatagaaaatacatggaatcaacccaaatgcccatcaatgatatattggataaagaaaatgtgatatatattcaccatggaatactatgcagccgttaaaataaatgagatcacgttctttgcagggacatggatgaagctggaagccatcaccctcagcaaactaacacaggaacagaaaaccaaacaccacatgttctcagtcgtaagagggagttgaacaatgagagcaaacacgtggatacatggaggggaacaacacacaccagggcctctcagggggacaggggtaggagaccatcaggacaaacacgtggatacatggaggggaacaacacacaccagggcctctcagggggacaggggtaggagaccatcaggacaaacacatggatacatggaggggaacaacacacaccagggcctctcagggggacaggggtaggagaccatcaggacaaacacgtggatacatggaggggaacaacacacaccagggcctctcagggggacagggggtaggagaccatcaggacaaacacgtggatacatggaggggaacaccacacaccaggacctctcagcgggacagggggtaggagaccatcaggacaaacacgtggatacatggaggggaacaacacacaccagggcctctcagggggacagggggtaggagaccatcaggacaaacacgtgggtacatggaggggaacaacacacaccagggcctctcagggggacaggggtaggagaccatcaggacaaacacgtggatacatggaggggaacaacacacaccaggacctctcagcgggacagggggtaggagaccatcaggacaaacacgtgggtacatggaggggagcaacacacaccagggcctctcagggggacggggggtaggagaccatcaggacaaacacgtggatacatggaggggaacaacacacaccagggcctctcagggggacggggggtaggagaccatcaggacaaacacgtgggtacatggaggggaacaacacacaccagggcctctcagggggacggggggtaggagaccatcaggacaaacacgtgagtacatggaggggaacaacacacaccagggcctctcagggggacggggggtaggagaccatcaggacaaacacgtgggtacatggaggggaacaacacacaccagggcctctcagggggacggggggtaggagaccatcaggacaaacacgtggatacatggaggggaacaacacacaccagggcctctcagcgggacagggggtaggagaccatcaggacaaacacgtgagtacatggaggggaacaacacataccagggcctctcagggggacggggggtaggagaccatcaggacaaacacgtgggtacatggaggggaacaacacacaccagggcctctcagggggacggggggtaggagaccatcaggacaaacacgtggatacatggaggggaacaacacacaccagggcctctcagggggacagggggtaggagaccatcaggacaaacacgtggatacatggaggggaacaacacacaccagggcctctcagggggacagggggtaggagaccatcaggacaaacacgtggatacatggaggggaacaacacacaccagggcctctcagggggacggggggtaggagaccatcaggacaaacacgtgggtacatggaggggaacaacacacaccagggcctctcagggggacggggggtaggagaccatcaagacaaacacgtgggtacatggaggggaacaacacacaccagggcctctcagggggacaggggtaggagaccatcaggacaaatagctaatgcatgcagggcctcatacctaggtgatgggttgatgggtgcagcaaaccaccatggcacacatttacctatgtatcaaacctacactttctgcacgtgtatcccagaacataaaataaaatttaaaaaatatatacactgattcatgatctcctttctctccttctgaaacactctttaaaactttttagcatttccccctctgtcttccatgtctcctaactacatgtttcttattttccatttccttattcctgtgttcattttggatagccccttctgacctatattacagtttactagttcactcttcaactgcttctaacatactaatattctgttaaaaccattcatttgggtttaaatttcaattatgttattctctatggacattctatttgttttcttttaatcttcttggccattctctagagtttcctgttccattatgatatttttaattttttgttttactttaaacatactaaatatagttattttattttctgtatctgatactttcaataactgcagtcttcgctagtcttttttctgtgctcttgctcatagtttttttcgtttgttttcatgattagaaaaacagagagagaagaaggagagtaaagggaggaggaggaggaggagaaaagaagaaagcagagaagaagggacagagaaaaaaaggaagttggttctaacgtttctctaacaactgtcttcagtgaaacgctcccaccttgtggatttttaggttattgaaattaaccagtcttctgggtgcagcacaccaacatggcacatgtatacatatgtaacaaacctgcactttgtgcacatgtaccctaaaacttaaagtataataaaaaataaaataaaaagctacacaaattaaaaaaaaaagaaatcaacctaattcctagattaccacctcttgattcaaatgctttaaatctaggcttttcatctgagtctttctttttagttattctgtttatcttcaaaacactcctgctttgaatcattcaaaatctacctccctccctctgtttgactaccatcaatttttttgctcattcctaatgcattaatctattagctgtgaatatccaaaaaccctcatttcactgaatctttgacagacccctttgcatcctcttgttcttctaattatttcctcagacactttatgttctcttttctttacaagcatgccatagtttatatacaatgtgtgtattgtttttatatatacctatatatagcctctttttaaaagcactgtacaccatgctttgaaatatattctaaaatcaggtagcatgaaaatggaaacataacatactaaaacatatgggatgcaacaaaagcagttataagagggacacttatagcaataaatgcctacatcaaaaaagaaaaaaagatctcaaataagcaacctaatattatgcctaaaggagcgagaaaattagagaacaatacaagcccaaagatagcagaaggaaacaaataacaaagatcagagcagaaataatataatagaaactgaaaatttcaataaaaataagaattgttttttgaaaagataaacaaaattaacaaattcttacatagactaagaaaaaagaaaacaaactcagaaatgaaagaagagacattaaaactgataccacagaagttaaaaaatcataacatactactataattaattattcaccagcaaattagataacctagaagaaattgataaactcgtaccaaaactgaatcatgaagaattcaaaatttagaacaaatcgtgaataaggaaattaaatcaccaatgaaaggtctctcataaaagaaagacccaggattgaatggctcagtggctggattctaacaaacacttagataactaacaccaatccttctcaaacgcttccagaaacatgaagaagaggaatacttccaaattcatttttcaaaaccagcattaccctgataccaaaaccagagaaggacactataataaaaataaattgcagaccaatactcctgatgaacttagatggaaaaaccctcagccaaatattagcaaatattatttttaagaaaacacagcaaaaaaattcaccatgcttaagtgggattcatccctgggaagcttattagtcttatttgattcgtgtaatcagaaaatttctatgtctagtgaagagaaatgagagcaatagagactcatagcacctcaacaaatttccaggcttgagccagttaacaaatacaagtccttcaaatacaaaaagactgtgaaagaaaatagaacagatcaatgaaactaagaatttgttctttgaaaagataaacaaaactgacaaaccattagctagactagaaaaacgagagaatactcaaagcaataaaatcagaaatgaaagaggaaatattgcaactaataccacagaaatatagaggatcataagaggccactataaacaattacaagccaacaaattggataacctagaaaaagcagataaatttctagaaaaatgcaacttacctagagaaagtcaagaagaaagataaaatctgaacagaacaatactgagtatggagagtatatcaataataaaacatctcccatcaaagaacatcccaggaccagaaaacttcattgctgaattctaacattttaaaaaataataatacaatccttctgaaattcttccaaaaacttgaaggagaaagagtatttccaaactcattttaaaagatcagcattattgttttttttttaaagtgatgttccccttcctgtgtccatgtgttctcattgtccaattcccacctatgagtgagaacatgcactgtttggttttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacatttggattggttccaagtctttgctattgtgaatagtgctgcaataaacatacgtgtgcatgtgtctttatagcagcatgatttataatcctttgggtatatacccagtaatgggatggctgggtcaaatggtatttctagttctagatccctaagaaatcgccacactgacttccacaatggttgaactagtttacagtcccaccaacagtgtaaaaatgttcctatttctccacatcctctccagcacctgttgtttcctgactttttaatgatggccattctaactggtgtgagatggtatctcattgtggttttgatttgcacttctctgatggccagtgatgatgagcattttttcatgtgttttttggctgcatagatgtcttcttttgagaagtgtctgttcatatcctttgcccactttttgatggggttgtttgtttttttcttgtaaatttgtttgggttcattgtagattccagatattagcactggggcctgttgtggggtggggggaggggggagggatagcattaggagatacacctaatgttaaatgatgagttaatgggtgcagcacaccagcatggcacatgtatacatatgtaactaacctgcacgttgtgcacatgtaccctaaaacttaaagtataatttaaaaaataaataaataaaaataaaaataaaaaggcaaacaaggacactataagaaaagtatgggccaaccaatatccctgatgaacatagatacaaaagtcctcaaaataagtactagcaaacagaatttaacaacatattaggagaacatttaccatgataaagtggatttatcctccagatgtttcagcaaacacaaatcaaatgtgataaaccacattaacagaatgaaggataaaaaaatagctatctctatatatgcagaaaaagcatttgactaaattcaaaatcctctcatgacaaaacctctcaacaaattgggcgtagaaggcatgtaccttaacacaaaacaggacatatataacaagctcacagctcacatcatacccaacaatgaaaaagtgaaatcttttctgctaagatcaagaacaagacaaggatatttattctcactacttctattcaacttatttctggaagtcctagccagagcaattaagccaaataaagaaataaaagatattcaaattgaaaaggaagaagtaaaattgtctctgtttgatgacatattatatataggaaaccctaaaaactccaccaaaaagctattagaaatgataaatgaattcaataaaattgcagaattcaaaatcaatgtacaaaactcagtagtttctttacactcacaacaaactatatgacaaaaataaagaaatcaatctcattcacagtagcatcaaaaaaactgtattttttttgtttaggagcacatttaggattgtacttaggagtacatttaaccaaggaggtgaaagatctgtattctgaacactataaaacattgatgaaaaattgtagatgacacaaatacatggaaagatattttatgttcatgggtaggaagaattaatattcttaaaatgtccttactgcccaaagcgatttataggtttaatgcaacatttatcaaaatttcaatgtcattcttcacagaaatagaaaaaacaatttgaaaatttatatggaaccacaaaggaccctgaataactaaagcactcttgagcaataagaacaaagctgaaggcctcacaatctgacttcaaaacgtattacaggaaaagaacaaaagaaggaagaagagggtagaggagaagtgcagcaagggtggagggaggtgcccgcgctgggtcggaggagcaggagtatggagggaagactcctgggtggcatggagctcttgcacctctaggcactgcccagccctgtgtcagccagggctgaacccccacaggataaggaagcctgtgtgtgtaccaacaatcaaagctacatctgtgacacaacaggacactgctatgggcagtctcagtgttgtaactactactatgaacattggtggttctggctcgcgtggaccatcaccatcatcctgagctgctgctgtgtctgccaccacagccaagccagccctcaagtccagcagtagcaacatgaaatcaacctgcctgcctatccagaagcccgcaattactcagtgctaccattttatttcaccaaactatttattaccttcttatgaggaagtggtgaactaacctccacctgtttccctccctgtctgtccattgtggatgagctctgagccctgttttcctgtgaagattctttgaattgcggccattctattcacatgaactctcacatctggagcacagatggccctctcaaggtaatttattgtatgcattgactgtttaccaaacaaatgtcttactatgtactcaggtatattcagcagcattgtcgactgcagtcccctatgcttgccagaagatactgtattcaaagtagaagtttcacagtgatgagtaatcactgcaattttcccattgctccatggactctcagaggccggtgttctgttccctgtaaatagagatgtactctgaacctttctgcctccctcagctgttcctagtccttggtatcagcccctggagatgtccacaaccacttaggacaaaaggcaaaagtggaatttcagacaaaactttgataggatcttcagtgataaacttggactaactgtggcccaggtatcagcactcccaagaattgccaggaggaagctttggcagacaccacaggtatggcaaggcctatctccctctgctgaatccaacaggggcaagcaagctggcatgtggcttgaggtgacccgaatatgtcagcacccctcagatgtctttctttgcacttttaaaaaaaatctcagaatttgctggcaacatggccaaataggaacagctccagtctgcagctcccagtgagatcaatgcagaatgcaggtgatttctgcatttccaactgaggtacctggttcatctcactgggactggttggacagtgggtgcagcgcacggagggtgagccaaagcagaatggggtgtcgcctcacccgggaagtgcaaggggttgggggaattccctcccctagccaagggaagccccgagggactgtaccatgaggaacggtgcactccacccagaaactatgcttttctcacggtcttcacaatccacagaccaggagattccctccagtgcctctgccaccaaggccctaggtttcaagcacaaaactaggcagctgtttgggcagacaccgagctagctgcaggagtttttttttttttttcatgccacaatggcaactggaatgccaacaagacagaaccattctctctcctggaaagggggctgaagccagggagccaagtggtctggctcggcgggtcccacccatacagagcccagcaagctaagatccactggcttgaaattcttgcacagcagtctgaggttgacctaggacactcgagcttggtggcgggaggggcttccacattgccaaggcttgagtaggcagttttacccccacagtgtaaacaaagccaccagaaagtttgaactgggtggagcccaccacaactcagcaaggccacagcagccagactgcctctctagatttctcctctctgggcaaggcatctctgaaaaaagggcagcagccccagtcagagacctatagataaaacccccatctccctggaacagaccacctaggggaaagggcgcctgtgggcacagcttcagcagacttaaagcatctttgaaaagcctgatggctctgaagagagcagcagatctccctgcacagtattcgagctctgataagggtcagactgcctcctcaagtgggtccctaacccccgtgtatcctgactgggagacacctcccagtaggtgccaacaggcacctcatacaggagagctctggctggcatctggtgggtgcccctcttggacaaaacttccagaggaagaaacaggcagcaatctttgctgttctccagcctccgctggtgatgcccaggcaaacagggtctagagtagacctagggcaaacaccaacagacctgcagcagaggggcctgactgttagaaggaaaactaacaaacaaaaaggaatagcatcaacatcaacaaaaaggacagccactcagtgacctcatcagaaggttaccaacatcagaaaccacaggtagataaatccatgaagatggagagaaaccagagcaaaaaggctgaaaattccaaaaaccagaacgcctcttctcctccaaaggatcacaactcctcaccagcaagggaacaaaagaaaactggatggagaatgagtttgatgaattgagagaagtaggtttcagaaggtaggtaataacaaactcctccaagctaaaggagcatgtcctaacccaatgtaaggaagctaaggacctggaaaaaaggctagaccaattgctaactagaataaccagtttagagaagaacataaatgacctgatggagctgaaaaacatgccatgagaacttcatgcagcatgcacaaggatcaagcactgattcgatcaagcggaagaaagatatcagagactgaatatcaacttaatgaaataaatcaagaagacaagattagagaaaaaagaatgaaaagaaatgaacaaagcctccaagaaatatgggactatgtgaaacgaccaaatctacatttgattgctgtacctgaaagtgatggggagaatggaaccaagttagaaaacactcttcaggatattatccaggagaacttccctaacctagcaaggcaggccaatattcaaattcagaaatacggagaacatcacaaagacactcctcaagaaaagcaaccccaagacacatagtcatcagattgagcaaggttgaaatgaaggaaaaaatgttaagggcagccagagagaaaggtcaggttacccacaaagggaagcccatcagactaacagcagatctatcagcagaaattctacaagccagaagagaatgggggccaatattcaacattcttaaagaaaagaattttccacccaggatttcatatccagccaaactaagcttcataagtgaaggagaaataaaatctttacagacaagcaaatgctgagagattttgtcaccaccaggcctgccttaaaggagctcctgaaggaagcactaaacatggaaaggaacaactggtatcagccactgcaaaaacataccaaattgtaaagacaattgacactatgaagaaactgcattaactaacagcaaaataaccagctagcatcgtaatgacaggatcaaattcacacataacaatatcaaccttaaatgtaaatgggctaaatgctccaattaaaaaacacagactggcaaattggctaaagagtcaagacccatcagtgttctgtattcaggagacccatctcacgtgcaaagacacaaataggctcaaaataaagggatggaggaatacttaccaagcaaatggaaggcaaaaaaaagcaggggtcgcaatcctagtctctgataaaacagactttaaaccaacaaagatcaaaagagacaaataagggcattgcataatggtaaaaggatcaatgcaacaagaagagctaattatcctaaatatatatgcacccaatacaggagcacccagatgcataaagtaagctcttagagacttaaaaagagacttagaccctcacacaataatagtgggagactttaacatcccactgtcaatactagacagatcaacgaaacagaaagttaacaaggatatccaggacttgaactcagctctggaccaagtggatccaatagacagctacagaactctccaccccaaatcaacagaatatacattcttctcagcaccacattgcacttattctaaaattgaccacatatttggaagtaaaacactcctcagcaaatgcaaaaaaaaatgggaatcataacagtctctcagatcgcagtgcaattaaattagaactcaggattaagaaactgactcaaacccacacaactacatgtaaactgaacaacctgctcctgaacaactactgggtaaataaagatattaaggcagaaataaataagttatttgaaaccaatgagaacaaagacataacataccagaatctctggtacacaattatagcagtgtgtagagggaaatttatagcactaaatgcccacaagagaaagcaggaaagatctaaaattgacaccctaacatctcaattagaagaactcaagaggcaggagcatacaaaaagctagcagaggacaataaataactaagatcagagcagaactgaaggagatagagacacaaaaaaaccttcaaaaaaaatcaatgaatccaggagctggttttttgaaaatatcaataaaatagatagaccactagccagactcataaagaagaaaacagagaagaatcaaacagatgcaataaaaaatgataaaggagataccaccactgatcccacagaaatacaaactactatcagagaatactataaacacctctacacaaactagaaaatctagaagaaatggacaaattcctggacacatacaccctcccaagactaaaccaggaagaagttgaatccctgaatagaccaataacaaggtctgaaattgtggcagaattaatagcctaccaaccaaaaaacagtccaggaccagatggattcacagccgaattctaccagaggtacaaagaggagctggtaccattccttctgaaactattccaaacaacagaaaaagagggaatcctccctaactcattttatgaggccagaataattctggtaccaaaatttggcagagacacaacaaaaaaaaagaaaatttcaagccaatatccctgatgaacatcgatgcaaaaatcctcaataaaatactggcaaaccaaatccagcagcatatcaaaagcttgtccaccacaatcaagtcagcttcatccctgggatacaaggctagttcaacatacgcaaatcaataaacataattcatcatataaatagaaccaatggcaaaaaccacatgcttctctcaatagatgcagaaaaggccttcgaaaaaattcaacagcccttcatgctaaaaactctcaataaactaggtactgatggaacatatctcaaaataataatacctatttatgaaaaacccacagccaatactgaatggtgaaaaactggaagcattccctttgaaaaccagcacaagacaaggatgccctatctcaccactcctattcaacgtagtattggaagttctggccagggcaatcaggcaagagaaagaaattgtctctgtttgcagatgacatgattgtgtatttagaaaaccccatggtctcagcccaaaatcttcttaagctaataagcaacttcagaaaagtctcaggatacaaaatcaatgtgcaaaaatcaagcattcctatatgcaaaaaacagacaaacagagagccaaatcatgagtgaactctcccattcacaattgctactaagagaataaaatacctaggaatccaacttacaagggatgtgaaggacctcttcaaggagaactacaaaccactgctcaaggaaataagagaggacacaaacaaatggaaaaacattccatgctcatggataggaagaatcaatatcatgaaaatggacatactgcccaaagtttttatagactcaatgctatccccatcaagctaccactgactttgttcacagaattggaaaaaactactttaaatttcatatggaaccaaaaatgagcccgcagagctaggacagtcctaagcaagtagaacaaatctggaggcatcacgctgtctgacttcgaactatactacaagtcttcagtaaccaaaacagcatggtactggtaccaaaacagatatgtagaccaatggaacagaacagaggcctcagaaataacaccacacatctacaactatctgatctttgacaaacctgacaaaaacaagcaatggggaaacgattccctttttaataaatggtgttgggaaaaccggctagccatatgcagaaaactgaaactggatccctttcttacactttacacaaaaattaactcacgatgtattaaagacttaaacataagatctaaaaccataaaaaaccctagaagaaaacctaggcaataccattcagtacataggcatggacaaaaacttcatgactaaaacaccaaaagcaatggcaacaaaagccaaaattgacaaatgggatctaattaaactaaagagctcctgcacagcaaaagaaactatcatcagagtgaacaggcaacctacagaatgggtgaaaatttttgcaatctatccatctgacaaagggctaatatccagaatctacaaagaacttaaacaatttacaagaaaataacaaacaaacccatcagtgggtgaaggatatgaactgacatttctctaaagaagacatttatgcagccaacaaacatatgaaaaaaagctcatcatcactggtcatcagagaaatgcatatcaataccacaatgagataccatctcacgccagatagaatggcgatcattaaaaagtcaggaaacaacagatgctggaaaggatgtggagaaataagaatgcttttacactgttggtgggagtgtaaattagttcaaccattgtggaagacagtgtggtgattcctcaaggttctagaactagaaatatgatttgacccagtaattgcattactgggtatatatccaaaggattataaatcattctactataaagacacatgcacacatatgtttattgtggcactgttcacaatagcaaagacttggaaccaaccaaaatgcccattcagtgatagactgcataaagaaaatgtggcatatatacaccatggaatactatgcagccataaagaaggatgagttcatatccttttcagggacatggattaagctggaaaccatcattctcagcaaactaatccaagaacagaaaaccaaacacccgatgttctcactcataaatgagagttgaacaatgagaacacatggacagagggaggggaacacaacacaccggggcctgtctgggggtaggggctgggggaaggttagcattgggttaaatacctaatgtagatgatgggttgatgggtgcagcaaaccaccatggcacgtgtatacctatgtaacaatcctgcatgttctgcatatgtaccccagaacttaaaatataatttaaaaaaaaatctcaaacaactcactgaagtgtctcaaagctgaacaagttttaccaaaatgaatccttctcagttaactgatcaaatggatgaatcctgaccctctgaagtctctttcctgagttagagcagggaactgctctgagtgttaactgttggattcactgcagtgtcctacaatattttacaagaagatgaacaggcaacctgcagacctaagcttgattcccaagtcacagtctgacccctgctacaggaggttaccctcctcaggaagagatagaaatagggaatttgaaggaatagtgaggggaccagggagatttgattgagtctggtttccaggtgaattaaaaggaagggtgtcatccagggtttgttactacagtcaaaagaataaataaatcaatgaagaaataccttcattgtctgtggttttcatgcagatatactcatggaggttgtatctctccaaaaacagacaaatccaaggctgtgaacaagcatccgcatttgaattccattaaaccaaaatctatgttgaacgaagtgaagtctgtacacagcattgcaaatgtgaacacattcctgtgtgaggcacatcaccatttgtcagttattgtgaatatgtgtatttttaagcaataagatgcagctggtcagttttctgggcaatcttggtgaggcatttcctgtgctgtggttgttctctaaccactgtgagaaacccaaataaaaatcgatcccccccaaaacaagtacgtatcacaaaaccatagtaatcaaaacaatatgacacttgcacaaaaacagacacattgaccaggggaacagaataaggagcccagaaataaactcatgcatttatgaccaataaatttttgacaaaggtgcccagaaaacgtaatgaagaatagacatttgtttcaataaatggtgttaagaaaactagatatccacatgcagaagaacacgaatgtgtatggtgtgtatccttatctcacaccatacacaaaaatcaattcaaaatggattaaaggtttaaacataaaactgtaaaactactagatgaaaacataggggaaaagttccacaatgttggtttggtcaaagatttcttggatatcacccccaaagcacaggcaacaaaagcaaaaatatatgggattgcatcaaactaaaaagcttctgcacagcaaaggaaacaatatggtgaagagacaacctacaagttgtgagaaaatatttgcagagcatacatctgatgaaaggctaatctccaaatatataagggactcaactcaatatcaagaaaacaaataaccaagtcaaaaaatgggcaaggtcctaaatagacatttctcaaaaaaaatacaaatgactaacataaaaaaagtttgtcatcctaattatcagggaaatgcaaattaaaatgacagtgagatgccacttcatacctgttagaatggctactatcaaaatgataaaagataacaagtgttgaagaggatacagagaaaagggaaccctcgtacactgttggtggaaatgtaaattaatactattatgaaaaatagataaaagttactcaaaaaactaaaactagaattactatatgatccagcaatcccacttccttgtatatatccaaaggaatttaagtcaatatgctgaagagatatctccaggctcatgttcattgcagcattattcacaatacccaaatatgaaatcaacacaggtgtctatcaactgacaaatggatgaagaaaatgtagtgtatatatacaatggaatactactcagccttaataggaaggaaaacctgatatatgtgacaacatgaattaacccagaagatatcacgctaagtgaaataagccaggcacgaaaagacaaatatcacatgatctcactgatatgtggaatctaaaaaagttgaattcatagaagtagagaatggaatggtgattatcagaggctagtagttgggggtagacatggaaaaggtagatgttgataaaagggttcaaagtttcagttagacaaagtttcagtgaactattgcacagaatggtgactgtaataaataacaaggtattgtatgtttcaaaatgactaacagagtagattttaaatgttttcaccacaaaaaagatatgtatgtcaataagatagacctaatctttccacaatttaaacatgtatcaaaacattacattgtaccccataaatagatacaattattatttgtcaatttaaaatttttcactaatttatattgttattgttgcaccaactcctttccaccaggcagattctcataaagactattttctcttttacatgaagcatttcctacacacctcttaatcacggtagcattgacgtcattccaccagattctatctccagtgttaaaataatcaagaacccagaaatctccaccagggggcaaccaatgcgtatcaaagtttcccactttcctttagatttacttatgggtaacttatgggaaaaaatacttaagtacttccctttttaaagaaaaaaattatatgaattctacaaaattatggcagaaaatttaagaagagcagatgcttcccaactcattctaaagggccagcattaccctgattctgaaacgaaaaagctttacaaaatccaagatccattcctgactaaagataaaagaaattttcagcaaactgtgaatacagaaaactttctcagcctgttaaagagtacctatgaaaaaaattatagctaacattatacttaatgatgaaatatttaatatatttcataacaggaacaagtcaaagatgtctactctaactaattctactcagcattcaacaaaatgaatatagtgaattcatactagaattttaaaagcaaatgtctttattcactgacaacataatcatctataaagaaaatcctacataacctataaaaaactgatggaacttataagttttgcaagtttacaggatataatgtcaaacaaagatctattatgtgcccataagctaagaataaacaattgtaaattgaaataaaaatgtcacttaaaagggcatcagaaatataaaacttagagataaatataaagtacatatgcataaagtacctgttcaccaaaaactacaaaacattgctgaaagaaattaaatgggcataatatagatgtagagatgtgttgaatttatgactcattttgaacaaggaatatattcatcatatattcatcagataagaattatgttacaggtctaataacattcaaatcaatacataatgtctcatagttcctgaatctaaaatatcaaagaaagaaacataaagccatatcatgtttaatgagaagggcttattatatcatttatgagatcctcttgtaaatcactagctgtttgcatactctctttattgctgccttcatctccttattcctgaatgtatagacaactggattcagaaaaggagtgagaactgcatcaaaaatagccagaaacttgtccatctgtgaattagggtgtggccgtgtatacacaaacatgggtggaccaaagaacaaaaggaccactgtgctgtgagctgaaagagtggaaagggccttggatgaaccacctgaggaatgtttccaaacagtaaacaggatgaagacgtaggagattagaagtatgaagaaagtacccacacagataaacccactgttaacagtgaccatgaactgcaatctgtaggtgtcggtacaggctagtctgagaagccgaggaaggtcacagtagaagctgtccaacacattagggccacagaaggctaaattaacaagaaatgccagttggaacagggagtgactgacaccaagggtccaggcaacagccagaaatgaaaggcacattcttgggctcataatggtcagatagtggaggggcttacatagggccacatatctgtcaaaggccatggctatgagcagcaccatctccacaccaccaacgacgtggatgaagaagatttgagcgatgcagcctccaaaggagatgactttgcgctttctgaacaggtcataaatcatcttgggagaagtgacagagcaggctcctaagtcaatgaaggagagactggccagtagaaagtacatgggggagtgtaagtgagggtcagtggtcacagaaaacacaatgaggatgtttccagtaatgcttgccacatagagcacagaggaaaacactaggaggaggagctggatctcccatgaatgagtgagtcccagaaacaaaaactcagataccactgagtgattctctccatccattggtccagccaactgggctgtggctaaaattatgagaactaagaaaatggggaggaaattgtgattatgaagataataatatgtactaaaatcaatattgcaatgtcactatgaataaatagtatacagttattctgttcctcacatattaaaaacaaaaaatcaacataatattatcacaacatgtgagctgcaacctgatttaaacccatcatcaatactttcagtgtaatgtctgatctaaaattaacagattaggtaagaacaagattcctgactatccatgaaattcatcaggtgtttaaatgacctgtgatattaactattcctcatttccaacatattccatttgtacttatacatattcttataatttccttcccttcccagtttgcacccacaattctctgacagaaagtagacataagaggaaaacatgattaacagatggattatcactgcagtaagaggtgcctgggacagacttagttgaggtaggctgtggattgagagaatatagagactggggtatgtgaaatcggaaagcccacaactgtagcagactagagtaagtggactttcacaagaaatagaatcaccaccattatctaccacattttctcatgcttactgctatttaagtgcctcagtttctatacaatctttcacaattacgaagccctaaatggcttcccatcctgcaatgatttcataaggagcctatgccacctgtcatgtaaggctttttccatgcctaataaatatgttttggagggatttcaccagtgtttctgctaagatacatgcataaaatggccacagaggttgtgagaaatctctgcagtttctctttgtctatacacatgaaagtattgaagaccagcacttggattagttaagataatgttttaattcatcactgtctcctcctccccttggtaccagcttttatgttcattgcattccccacccttttaagtactcagtacctcctgcatggtaacctattctgatatttgatattatcatgcttaatttgactgaatccattcggatattttatctttaagaaatttgtagttttatacttttaatttatgataaaattagattaatatcaaacattaacaagtgacttttaggaaggtatatgagctttcttattgacttcaaactataaagtacaaactgtgacactagaaatttagtcctttaacacatattgtatttatatgtgaagtggagggtgagcagaaaacagtgttatatttctctgtgtccagatggatactcacctcaatcattttcctatagtagaaagtagttcctgaaaacacttaatagagattattttagaagttgctgaggtacaaataaaactgctatgctgacatcatacttttttgcaccaacaactccagttcttctgacacaaaggaccatcttcctagtgccataatttatcttagaccccaaaactcacagaggcacacatcatatctctaatacttgctcaccaccactggcatgagtctctctctatcctcttctacgtgaagtgattatactgtcacctctggagctaactgtccacagtctcaagatgcacactttttacaaccagaagcctatggactgggtgagggagcagaaacagccacaggtactgcccatcagggtaatgtaagtcagcatgcaaacaactgatcagatgaacatgaatagcaaggtgctgaggcactgggaagagggaccggaaaactctataattgttgaaaaagactcaagcccttgggaagggaaatgcctacgaaattatataaagaccattttatccaagttggtcatcattcagatgaaaaccatgaggcccagaaaagtaaactgagtttccagaattcacacaattgatagaataggaaccagaattcaggcctcttgcttcctattccagaaagacaaattgcaataataatcaaataatatgagcaatcatccagtaaaaataatctagtaaaaacagcaaaactcaaaagagtgatttttcctggttaagaccaaaactaaccatagattgctatacatagtatctattataaatactgaattatatagcagcctgacaataaatacataaaatgtgtacacaaagattattgaacctgtacaatacagtagtaaatagtaactttatatttgcaaagtgactgatcattactatcagaatttgtacccattcttcatattttgttggtcatataaccagttactacaactgcaaaaacaacctaaggtcatgtttctgtgaagtccatccttttggtctttaaattttattatcctcaaaggtcaattatgatctcaatcttttcttgtaattttactgacaattctccttcacactgatttgttctttctctaattcctgtaaatagaaagaaccaaaaaaagttgaaaaaacatgtattgtacatataacaaacaatcatatgtggtatacaatatatatcaaatgagtattaagataaacattcaaagagttttaaagaaaaaagtgttatagatattggagggcagaagagacgattgccattaagaacaggtggaggaggttatgccaaggacattgacctgaccctttaggaattagtgaaaattgaataggagaagaatgaggtatacaatgtgtgaaaaatacctaaattgatataacaggaggagaccttttcatatcaattatcattacttctgtgtatataaccatattagatacccacaaacgaatagaaagtggatagttcttgattgacaagtaagactaataatcccagatcatagtaaggtcttaacttcaagtcaataatctttattacttatggttcattcctctccctcatgttttccaataattttaaaatgcataattaaaacaattctcatttaaaaacatagtagccatgactaatgatcttccagtgggaaggtactaagactttacaacatgtttcttgctggggataagacagcctacagccagcattcaactcatttttctaaagtctatggatcaatttgaaatacagaaaaagtagaacagagataaagttaaaaaaagattaaaaatatgggaagaatgggagaaaggggagattagaagatatgaacaatgatttaaaaataaaagagcctcaaaggagaagagaaactgctaagcaagactaaggtaggatgaaatacagtagtctctgtttctgagaacacaggttaaaaagaacataaataaaataaatttatcacctttaatacactcattcaaggatgctactgagtttgactttgggaatttctcacctttaatacactcatctggggatgctacggactgtgacattgggttgcatttaaagggggagagaaagggcagttgcttctattatcgccctgttggactcacagagtttctttgaaaagcacagatgataataaatggaaatattgccttttatactatacaataatatacacatgcaattcactggaaaaagtatacttgttactatgatttgaggatactaccatatactaatcaagagaaacacatgtacagaacaaagaaggcacatgaaatttttactagtgtgtgttttccttgtgttctaccaccccaggagcagcttctgctactgaagatcacagtagagttatttccaaaagttgtgggtctgcagggtggacttatcacatagctgtttgccaaaattcaaaagtccagaaaccatttccaaattttcacctcttttatcttcaaatcctaaaactatgaaaattcacaaacttagctccatacattatggtagaaaggttaataatttggactttgaggttgaccaggcctgatttttgaataaattcacaaacttacctccatacattatggtagaaaggtcaataatctggactttgaggtcgaccaggcctgatttttggatccaggctgcaacactcacttgctgtgttaacgtaacaaagttcctagaccatgctgagcttcagtttacttgttattgaattagggatatagcgttcgaaggaagaagttctagtatttgattgcacagcagagaaattatagttattgaactggggatatgtagatagacataataaattttagtattcaattatacaatggagaaatcgtagggaacaataatttattatatattctaaaatagctagcagagaaaaattataatgttcccaacacaaagaaaagataaatattcaaggtgatgaatatccaaattactctgatttgatcattacacattgtatacatgtatcaaaaatatcacatgtaccccaaaacatgtacaactatgatacatcaataaaaaacaacaaaaaaaccaaaagaatagaaatcaaaaataaatacataaatacataaaatagggataataatacctcccttgtttgcttgctcccttgctccatttgtaagaaataagtgatataatataggtaaaaatacttaacctcatgcctaccacatagtatagcacaataaatgttatttattataatctgaggcctacctacataagtgactttcaagtatagaaaattatttctcaaattttaaatactccctgattctcaggtatggtaattagacctggctttaggtaaagctctcatgtctacacttggatttaatcacttaagtatatttcccagtgccccccccaaaaaaaattgctcctaggtggacacactaatcaaagacttcctgagaaatgcaggaagaagttttgtcctctgaccacgctacgccctttccttgatggtaagccccataatctaaagccataagtttcaattcctcacataaaaagaaaaaaaatgtcttttatgaccacttcagataacactggatatttcccttgtcattaggaatgagaaatgggaggaaggtaaacttgtagacaggagaattggtagatgcttgaaaggatttctgaaaactgtgcctatccaggtgtacaaatgtgttgaccagccaaggcaaagcagtcaaaccatacaataccttatcctcaggaaaatggacttttctcccaaattgcctttttcatgaaaaatataaaattctccagtttcaacctcatgttaaatttcacatgtgaagaaaacagtcatgcacatcagaaaattaaatggcgagtcaagaccaaattcctagtcacagttatgttctgtttccagtattaccttctcacttattcattttgttaaagtggagccaaaatagaagtgggtgtcacacatcaagaaagactgaagtcgtacaaagccgatccttatccaacgtgcattaaaatatgcatcaggcatgtgtgatgcatacagtagaagtggaacaaatcaggccaggtgcagtggctcacgcctgtcagcccagcactttgggaggccaaagcaagcaaatcgcttgagatcagcagttcaagaagtgtaacaaatcctctacaatataagtagagtgaaaagagatagctacagtgatgagggaaggcactatagtgatgtggcatttgagtatagccataaaagaggataaatattacaatacatgaatatagggtctaaagaagtcttttcaagtagattgtaaaatatttcaaaaatggtaagtttggtgtatgttgaagcatacagattgtctacatcctaaaaatcattttggtgaataaaggaaaataagaaaggtagtcaatattcatttgttgcctatcattagaaacttctcaaaggtatatgagaattattaaataaatttaggaagccagtgaaggtatgggtcccgggaattgaggatgaagccagtaattagggaagatgccccatctataagtgtgatgtatcaaatggaggaaaagaaaaacggagggaaggagttcccttaagagaagattgaaatagagcagacttggggggctacacagaggaactgggactacacagttccagctttaaggctatagaaacagaaatagaaatactggtaagtaaaaacccaaaggattggtgacttatcacagctggagtgaatacgaaggagcatgaactcaaagaaaatatcaagatttaagcaagaataaataggacaatggtaggtccatttttagaaattagaaagttgaacataaaatatgtcagggtggagaaaataatcacgtgtattttaagcaaataagagtattagatattgagatgctcaggtgaaaacatatgacaggatatatgggggaaaagtacaaattcaacatgtaattgtatagtaatccatataaaaataatagacggatgtgtaagagtgcataaggtccctgaaggaaataatacacaggaaaaaaagattaaaaagcaaagacccaactatagaaactatccacattgattatgtaaagtaggaaaaggaatcaataaactagacagaacatcacagaggtaggaggacaagtgctggcctcgaggagccaacacagaagcaggtatcaagaataaaggaggagaagagagaacaaagagagagagaagagaacttctgtggcagaagatcaagtgggatggtagaataaaggagaagaaatacaagaaaattgaaataaaatttacagaaatgttctacattgtaagtgggcagttttgacctggcacattgttggcacacattataaatgtcaaatgtattaatgaatgaatgaatggataatataatgaatgtgatggagttgtcaaaagctgaattaattaaaagtccccacgagaggttagatgacaaaattttcagaaactttccatgccactctgttgtgacatcaacagtgctggacccttgaaatcaaaccaaaaggattccaccatgagaatgaaaagggctgagaaggggaatgctgggtgacacagaaggtgacaaagggcgaaaggtttctaggcatttgatagactgatggacgtccgcgctgaccataaggcacaggccacacaggaaggaaaatgagacccaacgcgaagaaaagtagggctaaacagtcgggaaaatgtgggaagaaggatgaatagtcatacgatcaactcagattcctccctgacattcttctacagctttattctcgtcctttgggagccgagatgttcattttcctacattcttagctgcctacacacggcgacttttctccacggtgcctgatccctgctgcatcctccttctctagtggcaacagcaaatggccacacagaaggcagacattgcacccaactgaggagaatgtaattcactcattgccagtcacagaccttggctcaccgatttactaagtatagattttatttctatccctcacctacctgttttgccaagggaactaagaaaagagcatcatcaaaaattcagataggtatagttctcacaagatgaaccagatccagtacggcatcactgcagacatacacacagagctgcataaaacaggaagagagctgctaatcacagccccagagggtagtggccaaagtgatgccttggagatccgagaatgccagactgagatcacacggcctggggaattaccgcctatggtcattttggttttcccgggatagccatgttaattgggtgaaataaagcatatttgattttcttatgacaaaaaagggcttttgccattgtctacagatgatactttaaatctttattttatgactaaaggtgaattccagagcaacattaaatgttgtccctttaaatttttaatcatttacataacgattaccataatattcaatttaaacataaaatgtaattgaaagtatgagattaatatgtggacatgaaatcatataatgttccatggaaaaaatagaatgtataaggcaaagaggtttaaagtaacatcaaaactaatgctcactatacaaattctatgaaatcctcataattacactgtgaagcaggtgttgttagagccacataatctcaaacaaattatttattatctaaaattacatagatattaaaaggttaggccatatatgaatttaggattctctcaaaaattttttctctttctcctacatcaaacttccctaaattatagaaaagtcacaatgttaccaaacatattcacaaaacacatataatcttgaatccaaatttcagttacagcagaaaaaataaaactctagatcaatctcaatcgtgtaaataaattcagatttccaatctaagagtctcaatttgacatacttctttctctctcttctttcaaaccaggagaaatataaatatgagccacaaccttacaaaagctagaaaatatttacaattccacacaacaacacatgaagaaaaccttctggacatcaaaagtttaaaccagtcaagactgaacaccaagataaagtgcatgcctctgaagagcttgagctagtcaagaagcccagaaatccctaaaagaggtgtgtatactgaggactgaggatcaaaacctgtgatctttacttggaacagaaatattgcagcatgtgaaccctccacagagtgacagagggaaaggagtttaaagggaaacatgcaaatgtatcacctttggaataattaggacacgtgtgtggtgtaatgaaagaaggcaaaaagatggggaagaagccagacagatggcaattttcattctattatgaaaagaaaaggataagtcacaagtcacatgatgaaattaacaactatgaatccactctaagccatagtcaatcctatagcctaggagtcattctaacagatgagagtgttttggagacaagattccaaaactcgtctgccttccatcatacttactacccccagctcctcctccacaatatcctttcacaagtatctagaatattcaaagactaataatattatataattatttataataattgtattacaaaaataaaacttgatgacctttataaaaatactagaagaaaaagggaaaattacataaggtacagaacatacaaattataccatgaagcagtaaaaaacaggatcaaattttctatgttttttaaaaatatgccttctctaaaatgttttctctctgaaatgatatttagaagacataattgaaaataaatacaaaataaagtgataaaaaataatctggcaaaattcaggatgtaatgagtaaagacaaccatgaaagaaatgaagatcaataaaagcaggaaaaaaagtgggaagtggagagaataatgctgctaaaaacacagataagaatataaatgacaggcttaaatatatcctgagcaaaacgaaatagaaaacacaagaaggtgaaatgtaacattaaagtcaggtccaacaaatgagaaattagtgtgaaagagctcacaatatctggttaaaaaattcaaagataaaagaaaacttttctgaaatgaagaaaacattgaatctaatggttaaagggcttatctttatccagaaaaaatgtgttatagtatgaccacatcaaggcagatgcaactgaatttaccggacttcacaaacacaaaataaacaacccacaaaaaaaaaaaaaaatagagtccccatgaggctttaatgaagacaactattagaggccaggcgcaggggctaacacctacagtcccaacactttgaaaggccaaggcaggagaatcacttgagcccaggagttcaagataagaccagcctgggcaacatagcaagaccccatctctatcagaaaaacttaaaaaagaaaactatccactaaaaatgaatagagataacatgatacaagtgagcattctgaagcctaatatcaaaatgttctggggtttgcggttaaagaacagaatgcaaatgttacaaaccataactgtataaagactaattatattcataacaaaaataagaagagaaagatagtagaaatatattctggtccattcaactttcacagtgggagagaatcaacaaattatgttatgggtgattaaatattattttaaaagataaaggtcattattagaaaaattaaaaataacaaaatcaaataaagttggatgacgaaggtgggagaggaaagtgggtttaaggggtaaagtggaactatattaaaagagtcaatggagagcacccttggaaataacacaaaaattaaagaactaaatataatttatacagcacataactaaactataaatcttcaaattaaaagaaaataggtacatacaaaatatcacatacagagaaatattaataccatgaaaatattaaaataaaagcataaaattaattcatttatttaccctattagtattttttgaacacctatgtgccaggtattgtgctgaatgccagtaagatatagttcctgcatcttggagttttcgtggaggagacagagattaatcaaacaatcacacaaatgtaaaattgcaaccataaaaattactctgaaatacaatgaaaattactataagagagggatttgatgtgagtcagagaagtttcccctaagaaagcaacactgaagctgagatctaaagggtaaacagcagttaactgagtggagaacaaaggttttcctgcagggggaacaatctgctccccgaggccagagtggggccttgggagttgtgcctgaaaccacattgtgaggaagtgaggggaagcattgtgcagataatgctgaaataagtagtggaagatgcttcctaagagaatgagaaatccaagactactaagcagaagaatgatttgaccagatttcacatttgtaaatatcactatggttacaatgtatagaatggattttaaggaattcaaattggatacaggtgagtcaattagaaagcaacatgcttgctaaggcaagaaatttgattacttaaactagatatgggagttttggaaataagtagataaatttgtcatatatttgagataataaatcaccatgacttgatggtagacttagttggagatgccctcactaatgcaccatctaatgcttcaagtctaataattattcaattcctccagagccaccaatccaatggttctaccatatttatgctgtcattcactttactgatatccttcttaccttacctcttttcccactttatattccatgatcaataccttgctccctcgtaatgattgtactcactcttccaaacaacaatcctgataaatcctactctctgccttctacatcttgataccacacagctatatgtggctagataaaacaatcacactgacaatcatcctatactttctgaatccatcactcttctactttttcagatcttttctttctccctcatccttaccatgtaatgaactcattttgcatgtcaagggctaaaagttgaatattttaaaagttctcattttcccactactatataaaccaacaaatatctttagtctgcattcacaaataacataacaaatgagctcttcatatttctatccgtggtgaattaagatgactagaaattttgtggcaccatcccgttgaaaacgtggggacatattctttctccttgaacctgggtgggctctttgactgctttgaccaataaaatacagtgaaagtaaaacttccagttttgatgtccagatgttaaaagccttgaagcttccatttctacatcttggaaccaacgtgtgtgggtgctgagtcagtatcgaagaattctgcttattctgcttgcattagtccattttcatgctgctgataaagacatatccaagaccgggtaatttatgaataaaaagagtttcatggaatcacagttccatgtggatggggaggcctcacaatcatggcagaaggtgaaaagtatgcattacatgggagcagacaagagacaatgagagctgagtgaaaggggaagccccttgtaaagtcatcagctctcatgagacttattcacgaccataagaacagtatgggggagccaccccatcattcaattatctctcaccaggtccctccacaacacatgggaattatgggagctacaattcaagatgagatttgggaaaggacacagccaaaccacctcattctgcctctggcacctcccaaatctcatgtcctcacatttcaaaaccaatcatgccttcccaatagtccccaaaagtcttaactcacttcagcattaactcaaaagttggcagtccaaagtctcacctgagacagggcaagtctcttccacatataaacctgtaaaatcaaaagcaatttagttattttctagataagataggagtacaggcattgggtaaatgcagccgttccaaatggtaaaatttacccaaaacaaagggactaaaggctccaaacaagtccgaaatccagtgggacagtcaaatcttaaagctccaaaatgatctcctttgactctatgtctcacatccaggtcatactcatgcaagtggtgggttcccatggtctcaggcagctccacccctgtggttttgcaggggagagccttcctcccggttgctttcacaggctggcattgtatgcagcttttccaggcacacagtgcaagctgtcggtggatctaccattccggggtctggaggacagcagccctcttctcatagctccactaggcagtaccctagtggggactctgtgttgggggcttcaaccccacatttccattccccactgccttagcagaggttctccatgaagacctcacccctgcagcaaacttctgtctggagatccaggcatttccatacattctctgaaatctaggtggaggttcccatacctcgattctggacttccgtgaatccacaggctcaacaccacatggaagctgccaaagcttgaggcttgcaccctctgaagccatggcctgagctgtaccttgaccccttttagctgtggctggagcagctgggacacagagcaccaagtccctaggctgtacacaggcaaacagcagaggggccctgggcccagcctatgaaaccattttttcctcctaggcctctgggtgtgtgatggaaggggctgccacaaagatctctgacatggcctgaagacttagcgattaacatttggctccttgttacttatgcaaatttctgcagccagcttgaatttctcctcagaaaatggatttttcttttctatcacagtgtcatgctacaaattttctgaacgtttatgctctgttttcctgttaaaactgagtgcttttaacacacccaagtcactcttgaatgatttgctgcttagaaatttcttctgccagataccctaactcatctccctcaagttcaaagttccacaaatctctagggcagggacaaaatgctgccagtctctctcgatagcaagagacacctttactccagttcccattgagttcctcatctccatctgagaccatctcagcctggatttcattgtctatatcattatttgacattttagtcaaagccattcaacaagtctctaggaagttccaaactttcccacattttcctgtcgttttctgagccctccaaactgtttcaacccctgcctgttacccagttccaaagtcgcttccacatttttgggttatctttacaacagcaccccactctaccagtaccaatgtactgtattagtctgttttcatgctgctgataaagacatacctgagactgagtgatttatgaagaaaaagacacttaatggactcacatttccaggtggatggggaggcctcacaatcatggtggaaggcaaaaggcacatctctacatgatggcagacaagacagaatgagagctaagtgaaaggggaacccccttataaaatcatcagctcttgtgagacttattcaagaccacgagaacagtatgggggaaatactcctgtgattcagttatctcccgttggatccctcccacaagacacggaaattatgggagctacaattcaagatgagatttgggtggggacacatccaaaccatattgctgctgaatagatcatgtagacaggctctcaaactacacggagagcaagagaggcccaccttaccacaacatttcatccaatccactaataaaacaggcacatcactgaagccaccttcaactctccagactacccagctgccagctgaataccacagatggctacagttaataccacatggagcagaatcatgtagctaagccctgcttgcgctaatacaagtccacaattttttttaagtttgttgttttaagctgctaagttttgaggtggtttgtggtacgtggaataagatgtcactctaatataatataaacttaaactatgtggcattggctttggaatcagacaatggatagaagccagaaggatttcacaaagactgttagtgaaaagtgaacagacttcaaggaaaatgatagcaaaacctgtaaaagcattctgggaactgacagtaaacactgaatggtccttaaggagactgaaaacttgaaagagcttaagaagtctactggaaagggctttaaggataatgagaaaaaatcatcagtggaggctgaggaaaacgcaccaaagtcatattctgatgggagaattagaaaacgcttgcctggaatgatataaaaaataggaaaaataccgaaaaagtttgtggatctggctggggagatttttggtgtcaactaaagaaaaaaattaagcttttaagaaattaaagttagatttatttaggggtctgagaacaagagactgaggattacagcctaggagaagtcttccagagaggttctgtcagactgctctggtgaaggtctttagcccacagtttatatgcaggctgtacatatacaccatggaatactatgccgccattaaaaaatgatatcatgtcttttgctggaacatggatggaccttctattatccttagcaaactaatgcaggaacagaaaaccaaatacagcatactctcagttataagtgggagctaaatgatgagaactcatgaacacaaagaataaaacagacactggggtctacttgagggtggagggtgagaaaaggaagagaagcagaaaagataactattgggtactaggtttaatacctgggtgatgaaatgatctgtacaataaccccctgtgacaccagtctacctatgtaacaaatgcccctaaacttaaaataaaagttaaaaaaaaagaaaattaaaatctccttatcatctacctggtaatatgaaaaacacaaatctttcattcattcctttcaactgatgaggaaaatgaggcatcgggagttagtaaaagtccacattgagatatgagacccaccactggctggacgcagtggctcacacctgtaatcccagcactttgggaggccgatgctggtggatcacctaaggtcaggagttcgggaccaggctggccaacatggtgaaacccccatctctactaaaaatacaaaaattagctgggtgtggtggcaggcacctgtaataccagctactagggaggctgaggcaggagaatcgcttgaacccaggaggtggagtttacagtgagccaaaatcacgccattgcactccagcctgggcaacaagagcaagactctgtcggggaaaaaaaagaaaaaaaaaaaccaccgccatcattttgcaagtgttaccactattgtgtgttaatattgtagaagtattcctaattatgatttctttgtattcctaattgtaatagctttgtatttgaaaaattattgattcatactctatatgttattattttgtatgtgatgacaacagaatatattatcatgctccttttgtgaatctcattcataatataaagtataaatttgtgattttgctttaatttgaaatattaacttcaaatatgttatcacaatttgatacaaactattgacagtaaatctgtggattaagtaatgtcttagtaggtattgggaaaatttgaaactagtaacatggaggactattgtcattgtttatttcaaagccagttaaaattctgcaaagcagtgtacataaaaataatttcaagaaatttataaaataccgagattatggtgtataaacaactttagattctttgtttaagaaattctgccagtttgtaatatatgcttcattcaaagtagctaagggctgtacctggctaatagtaggcacctaatatttgttgaaaaggaatactgagtagctgggacctcctgagtagctgggaccacacacatttaacctgtatttataaaattactgtttagagaataacatttgatggaatcatgcttttactttctgcttacgactcaattgtttgtactgacattaacatcccaaatccttagcatggcctacaaggccctgagcaatgtggcacctgctgaagcctgctgcctcatttaataactctttgtctctttcccagatccagccactctaacattttttagctcctggaccaagacaagctcttcccagaacctgacctttgtacctgttctttattcctggagtatttttcccctgacaaattacttatcatctatcataattcaggttaaatggcactaactcagggaaggcttccctaactgcctcccttctccaaccaaattaggaacaattatatggccacatagtatcgaatcaagtttataattttaaaataattgggagattttgttgtttaacacttgttttcactataagactgtaattacatgcaagtaagaaccatgcctgtttgttcactcctgccacagtcagaatagtgcctggaatatgcagtaagggctgaacaagcactaaataaatgaacaagtgaataaatggatattgtctcatttttagaacagagtactgaatggatcatgaacactatctggtatgtcacgtaggtaatttacaagggctacaatttcagctcagatttaccttttcctggatacaggtcttgataggtctcttgatgtcatttcacttcagattcttctttagaaaacttggacaatagcatttgctgtcttgtccaaattgttactaagaatcaagagagatatctgacatgaaatgacattggaaaacattaaacacgattgaaataatgctagccaatatggttattattagaaaccaattacattttcaacttaaaaatagtaatacttattgcagactcaaatgtgcttattctaaaacaagtaaatgtttgcctatggtctgagattctaatccacggagttcattctaatccacattcaacactatcatgtaccagtgggcctcataacccacctagccctgtgatttttcaggttcacttttctaaacttgtgaattaaatatttattttcttagttcagaagaggaaaaaaactcttgtaattgttgcccatttcaggagaaatcttgcatatgaaaacaagagataaatatacacaactgagggctgtggtttaaacaaaatcttgagaatgttttttgaccttacacatttgtgctttagtataacaaaatgatatagacaaaggtaacttttaatagaaccagtcactaaattaaaaaaatgacaaattcttctgcttagctaagcaacagagaaggtaaaatactaattcaattcatcaatttaagcaatactcattaagagccaagtatgtgctcactgaataagctgctaaggtttggtggttacagagtgtgcggtgaaatgatgtctacatcacagtccaacattcacagagtttaaaagcctaccaagaatcaagacagacacaaatacctaacatagacatttgtatatgataagagagccagagtacaatttaggagaagaaattgtatggaaggaaggttcatttccattagaccagaaaagacagcacatttgaaggcctgaataagaaatattctggataagatattgtggctgctaccagaatggctcttgatgatctctacctcttggtatttatacccttatataatctctttcctatagtgtaagctggtcccaggtacttgtttctattgaatagaatagaacaaaagaaatgagatgccacttctgagattagattataagatactgtgaatttcttcttgtgccctctccctctctctctttctcttgccctctcatttgaatgaagccaactggcatgctgtcagtggcccagtgtaagtcctgttacaagaaattgatgattacctgtagccaaccctaagtgaagaactgaggtcctcagtcctacaaatggagagaaactgaatctagctaagaaccatgtgagtgagctgggaagaagatccaccctcagttgaaatttaagatgacatattgagcagacatactgagacacactgaaagtaagagagcaggaggaaacaaaaccagggtcatacaaagaacacaactgattttgagattctcacataagtattacaccttcagtgagcacgtgtactagaaatttaaaaaataaataaaataaaccttcaaagtgagctagcaaataaatttccctatggtctcagctctgagtggagagagaaaatgttccctgtggagtttatagccagaatccagctctcaaacaggtttcagcctgaactcacacaatctgtgtggcttccaaatttgcaagctgagaatttaattcaaagtggtctcaggttgatagcagtccaaaatgctaggtaggaaaaaaaatcctctctggacaaataaatcatcaaagcaagctcataagagcaggtttcaaaggtcatgagcttctaacacacacacaaaaatcacacacacaaaatgggggtagcagcaacatgggtagcgtattcaaacttgaaaagactttaaatatttgtattattagatgtagattatgaaacacatattttaatgtggttaatttttttaaggaatcaaaactatgagtaaagaccaagaaaattgtgctggatggccacttccaccatggctcccctcctatttaagtctgggtactgtgtcacccgaagtcttcaggcacattgttccaggtctgggtttgcctatgaaagaaactcatgagagctggaaatgaggagtgaagaggaggtcttcaaataaagcaggcttaaggattagacatagcaggtttgacagatgtgatggcttgcagaatcctttatgagctcccactgtccatctggataagatttacagacctttcagaaattcctataagcttgggttctgtgcccacactctagactgtcaggctaagatctctgatataaaacagacctcttctgattttgtctagctgcttttctaatatctattcaccaagctcttccaataatagcataaggccctaattaatattaaacttttatcattataatacataggatgtcttctgttttcctgatcaaattctgactactattaaaatataaagaattgtccagaaatatataaaaaaagaatcacacattgatcttctttaaatgaaaatataacaattgtatggactaggatgattacagttgttcagttctgactgttatttgaagaaaaaagcaataagaagcctcagcaacttaacagaaggagctgccatttactaggagaaaagattgtggatgagagtgtagcaaaggtcagaattctgtgaagcttgagatgtttattataatgaattatcttttatactcactacaatttcctaacaattttggggtttatatttttgaaagagatatacctttaattttctttctttgtactattgttaggtaactttgatgtgcagattatactacagtgaaagttgccaatgacaaggcaaagtcacttacatcagacccaaagcaaagtggagccgggtcatgaaaaaggggatcttgtgtgtctgtccacgataagcactatcacaaggactttctataaactcacaagaaatttctgcccacccagcacactctgtttgtccagctcatcctgtaggtgtctctataataggacctatcataaaaaattcctcaagactgcagcatttcagataagccaccctcacaagaacacttgcctagcaatggctgtttctgccagtaagttaacaccagctcctgcatcagaccctgtgaccaatgatgtttgtttcaaaacagcttgcatggacttctttttgtctttacatattttccttacctcaacctcttgggatgcacctatgattgatcatagcacaaatatctcagattataatccttgtttatttccaaataaatttatttctttggagatccactttttctgttattatacattgacattgttattatgaaattggttgggtgatgtgtcttattttcttgtctccagaagaatttctgtaacagtgcaattaaacgttctttgcatgtttgctagaactcacctgtaaaattgtctgagcaaccaaagcctggtttttgtgtttagtttttcttttgtgattggggaggggggtttatcgtactgattcaaggtgtgaaggtaacatcattttgattttatacatcttcttcagtccatttaagcatgttacatagcgttgtttgttcttttcatgatattctttacagtagtctcctaaatgttccctctgcttctgccatgagcccctacaatctatttcaactcagaagctatagagtttgtttaaaacatgtaacatattatgccacctttcttactgtaaaacatcccatggtttctcgtagtatttatagtaaaagtgaaatttttatgatggcttgagaaacttttcccattagatgcccaagtgctggtctggtctgatcttctcatcttcccttgggtgattctgtggcagtcacactagcctccttgctgctccacaaaaactccagcatgatcctacttcaggatatttgccattgttactgcatctgcctggaaccttttctcccatataaacatagagattgctcttgcctgtccttcaagtctattcttaaatgtcccattctctgtgaagctttcctgcccaccctatttaaattacagacttcactcccaattccccatctactttaagagtcttcatttatcattccttgacaaactgtaaatatacatgttcacttttttatcgtctgtctccaaatactggaatgttaagttctgtaatgtcagatatttctgtttggttcactggtgtattcttaaagcatgttacatactaggtatactcaatgaatatttgttgaataaatatcacattgggcttattccagaaattcaagcttgtttcaatagttagagcaatctacaaatgtaattccttacattaactaattaaaggagctaaatcacatcaccaccacaataatgcagaaaaccacatttgatacaactcaatattcatgtctgcctaacaaacatctcatgatactaggaaaagaggaagggatatattattttcatgtataaagcactaaccattgtagcatgccaatatactcaaaattcaatgaaattcctatcaaaatcttagcattcctcttagccctcaacaaagcatttctaaaatgtgtatagaagaccaaagggccaaaagagtcaacttctgaagaagcgcaaaaagaaagttgaggaaatcttaaaacatgttattgagcttaaagttgcaaaaataaactcatgtgccataattcatgagtagaaaaatagactagtggaataacataaaaataaaaacaatgcttacataaaatgttgtaactgatttggatgtcattagaaatcagtaagtaaatagatggacaatgtaatgaaagatgctaggcaaataatgtggtagggagaataatggccctcaaagatgcccatgcctaaccctggaacctgtgaatatgttacactgaatgcaataaaggcttatcagatgtgattaaggatgcaaaccgagatggagagatcttcctgggttacccagatgggcccagtctaatcacatgagttcttaaaaatggagaacctttcttagctgagtccagagagagatgtgacaatgaaagaatggtcagagaaatgtgacattgccagctttaaaaagagagaggagaggcaatgagaaaaggaatgctgatgttctctagaagatagaaaaggccaggatatggattctaccctagccaccataaagaaacatgcctgtcgacaacttgattttagttcactaaaattcatgcctgatttctgacttgtgtacactgtaagatgacaagtttgtgttattttaggtcacttagtttgcagaaatttgttacagcagtaatagaacaagtggttatccatatgaggcaaattagattggatacctatctccaatagaaatcaattcaaggtgaattccaggaaaatacttaaaacatttagattaaaaataaatgagaatttttgttacttttggtaggtcatagaaccaagaaaaacaaacattaaggaggaaaaatgaacatatgactacatcaaaatataaagcttctctatttggaagatatcataaggtgacaaatcataaactgtaatatttacaacatatatataagtgaataaatatacatttagaatatatatgaactcccaaaaatcaacaggaaaaataagacatagaacaagcaaaatgcataaacaaaagaaggcaaaacaaaaataatgactcataattatatgaaaagaagctcatcttcatagatgagcagataaatgcaaattaaaaccaccctgagatgctttttacatccatgagcctgataaaagttagagtctaaaagtaataattaacaaagatgggaagtaacagaaaatcttgtccattactggttaaagtataaactgatacagctactttatagaatattacattatagaataaagttgtgagtatgtatatgcagtgactcagcatattcattgctagtatgtactcaagagaaacttacaggagtggactaggaagtaaatacaaaatgattacaacattgtttgttatatcaaaaaataaaaaagacacccaattttccagcaaaaaaaataagtaaaaataaatcctggtgtattctaacaatggaataatatatagccattaaaataaatcaactattactgtacatatgaatgtaagtatcagcaaaacatattgtttagtgaaaaactaagaagctgaagaagaatatatacaatatggttacatttatatgaagtcccaaaacttgcaaaataaagaaatgtatttagaaatagattcacatgtgagaaaactagaagaaaattaatgaaaggataagagggatagcagtaattctgagtagttgagggaatttcaattggaaaaaaataatatcatattctttaagtcaggtagtgggtattagcatttgttttaccatcgttctttattcttatagctacactatatattttcaatgtatttaatatattttttgcataattaaatattatgcaataaaaatgagaaaacaaaaaagtagaaaatgataaattacaataaagaaatggagaaaaaattataatctagttgagtaatggtatattacatagctattttcttaagtagatgtatgtacatgatgtatgcacgattgtacatacatgttcttaattatatataaatatatatgtacatatttttaatataaaatactaaacaaagtacaccaaaatattagctcctatgttagtgagataatgttttgtttttttgtattttaagttttacatagtaggtgtatttttctgttttcatactgctataaagaactgcccaagactgggtaatttataaaggaaagaagtttaattggctcacagttcagcacagcttgggaggcctcaggaaatctacaatcatggcggaagacaaagaggaagcaagccagcttcttcgcaaggcagcatgaagaagtgccgagcaaaggggaaagaatcccttataaaaccatcaaatctcgtgagaactcactatcacaagaacagcacaggggaaactgcccccatgattcaattacctccacctggtctctcccttgacctgtggggattatgggggctatggggattacaattcaagacgagattcaggtggggatacaaagcctaaccatatcagtaggcatgtattgaattttaaactcagagaaaaatactagtgtttttataggattcttactaaagaaaaaccagaaagtaataaaccatctacgctaagacataaaattcagttgtttagttacaagatagaatgtggccttgtaagaaagcaaattaacttctaacatacaaagccttagagaagattcaagtgactgacggatcttaaacagagctattattacaacttgaactgcagtaaaatatcctcagcaacatagatgtgtatgtttcactagtcagagcaatacaaatttaacgaaactccattggtggtgtttttaatcagacaatttctgaagatgtcctggcttattcacagatgcaagccaaatctctagaagagtaccataataagaaaaaaaagaatacaggcaattgagagctgttccaaagtttagggagtttttgtaaggaattaataaataaaaatgttcttgaaagagagaaattaatatgcagttcatactgccagaattgcaggcaatttatcaaagtcccctaatcctccaaaatcgctatttttttttttgacacacactttacagtacagaagaaaatgtctccggcaataaatcacaaagttaaaattacctagtctacaattaactacacagtgatggtaaatcattttctaccaaaagaaagaaatgtcttgtctattcaggttctgctctacttaaaagttttccttgttggcgagcaagtggttagaaaatcatattttatacgtacattcagcttaactatcattcagctcaggaagatgactcagggccttatccataccttcaagtttgctcttagcaagtaattgtttcagtatctatatcaaaaatggcttaagcctgcaacatgtttctgaatgattaacaaggtgatagtcagttcttcattgaatcctggatgctttatttttcttaataagaggaattcatatggatcagctagaaaaaaattaagaggaaaatcacatggaaagttatatattatatatctattatatataatattatatatctattatatattatatattgtatatctattacatatatattatatatgtattatatatattatatatctattatatatataatattatatattatatatcatttccaaattccccagcgttcatatttgtcagtgcaagtaaagagccttactgctgatgaggtttgaggtatgaccatttggccagaatttatgaactctacatgtcgcttgatgtgtgcctcagggtatactttttttttttttttgagacggagtcttgctctgtcgcccaggctggagtgcagcggtgcgatctcagctcaccgcaagctccgtctcccgggttcatgccattctcctgcctgagcctcctgagtagctgggactacaggcgcccgccactatgccctgctaattttttgtatttttagtacagacggggtttcaccgtgttagccaggatggtctcgatctcctgacctcgtgatccacccgcctcggcctcccaaagtgctggaattacaggtgtgagccaccacgcccggccagggtacacttttaagcagagacactactttgaaggtcataaaaaatataataagagataaggctaatttcctttaataataataaaatcctttaataaaaatataaaggaataatataataattttatttaataaaatataataagagataaggctaatttcctttaataaaatatagtaactacataccaacagaattccaaaaaaagaaatggagaggaagggagcatgggtcattaatcttgtcaaaaatataaaattatatacgaggaattcctagaaactgttttccttgtctgcggccattgtgctgctgctacacaactaccgcaagcagcccttcacgccctcctcccagtacaaagctaattgacttgtgagaaatgttaagcttggaagagtcagcatcgctgcacttattttttattctactctgacattagaataatccttgagtgggggaaaggttaaaaacccccctggataagtgttactaattaatgatgattgttttaaacaatgtttggataatttttccttgtcccttgacataaacttgataaataactgagaagtgagaaggagattagtgggttgattaaattccattcaggtacttaaagttagctccaaaaatttagctatttgtaaattgtcatgcattgttaatgtataagagatgtagatttcatttatctttggtggagcgagatgaagcagtgaatcattgaagactgaaagaaagaaaaaggtcttttcccttttctttaagaagcatcattagttaaaaacatgttagttgataccagagaactatatttaaagggacagcaataagcaaattgattactctggtgattattggagtgacattgccttttagttgtactttcacaaaaattcacaatatttgccaaagtcaagttatccattacactattaatttgtcattcttttgtttatatagtcaatctctatctcaattggatctatctcaactgcttctaaacaagccaccatagtctctcccatttcaacaatctcttccaagtaccacttcatttcttcttttcatatttttgaaaacttttgaaaaactacctattttcctcctccatttcttgttcattccattctagtggacatggaatctgttcctcctccaaaacggaatttggtaacccttaaattactaaacccaaaacaacatgttgtctttatctttacctctctgtggcatttaatgataagaccactactttcttctcttttacccttctttcttgaattcagtcaaacaacgtacttacatttttcgtcttattctccatcttagaaaccacctcagctttctccattcagctataaaattgtgcttttcctcaaagattaatctgcctctcctctcactctatactatctctgttagctaattttatttgtgcacattgcttatactgggcattatatacacatatgcatgtgtgtacatgtgcatacacacactgtatgtggacatgtatatatatatatgtgtgtgtgtatatatatagtatatatataaattacaataacataaaggtggcattttaaattagtggaaattaccctgatttgatcactacacattctatacatgtaaagaaaatatcactctgtatcccaagaatatgtacaattatggtttgtcaaatgaaaaagttcatacattgaaaaattttagataaatatcaaactttctctgaaactgtaactgtaaaatgtaaaaaacagtaattgctatattgcttatttctgagtagaagaatatgagacatttccctaatcattatgtgtaattacaattacatagaagaatatgagacatttccctaatcattatgtgtaattacaattacatatatatatgtaattgtaattacacataatgattagggaaatgtctcatattctatatatatagacagaaagagagaaaatatatgagggagagaaggaatctttccatctcctttgagttccacggtgttgagagtcaggacaactgcaattgcttcatcatgcctgcttgcaattatagggcttttgaaccatttgttccctccttagatatcctcatttttttcagattcttgcttagaagtcactcctccgtggacctcctctgacatattaaacattgcagtccattataagctgcaagaggacagggatttttgcctgttttattccctactgtatcaccaggggctacagcaatatctgacaaacagtgggcatgtaatgaatatatgttaagtgaagtaataaattcaatcaaatcacatcacctgtttaaagcacttcattggcttcacattgcacttagaataaagagaaattctttttatacaatataagttcctgcagaatgcagacactttctacttctccagcctcttttcgactcctctcctactagcttctgtatttaagccacattagacctttcttcagttttttatatagactttgtcgcatcacacctcagagattctgtacatgttcttcctcctgcctagaaaggatcgtccctccactttcgccaactaatccctgctcaacttttcatctcagcaggaggcccattctctttggcaatcctctggcctccagcccatttattatatgctcacatgtcaacatgtacttcgtacagcatgtaacacaattgcacttttatattttaacaaattatatttcccatattgaactgtaagtctcctgaaagcaggaattttgttcttgctcatcatcaactttttcaacatccagtgcaccatttagaacttagatgtagtcaatacaggtttgtggaatgaaagaggaaaagaaagaattaatattcctttaaattaggatggcaaagatcgtatatagaaaattggctaagttgtggtccattcatgtttgctcccaattaaggagcacagctatgaaaaggaaggcttcaaattaataaccaatagatttttttaaaaagaaaactggccaggtactgtggcttatgtctgtaatatcagcatgttgggaggccaaggcaggattacttgagcccagaaattccagaccagcctgagaatttggcaaaactctgtctctacaaaaaatacaaaaattagccaagtttggtggcatgtgcctgtagtaccagctacttgggaggctgaggtggaagaatagcttgagtctgggaggtcaaggctgcaatgagctgtgattgcaccactgcactcaagcctgggtggtagagtaagaccctgtctcaaaaaaaaaaagaaaaatcactaagcaaaataagacatgtgaaggatcatgtcaaaggtaagaaaaattaggggaacattaaaagctttcttcccaagccactaaatcaacttgactaacaaaattaccacttgatttagcattagaaaattacattacatatcaaacataaacccattaatcaaatactaaagaaatttctgagttaaatggtataatgttagcttatgccagagctgaccttgaaagattgttcaaatatggctcagtgtgattgaaagttctgtgtgaatatgtttttggaaagatccaacagcaacaccttagtgtatgtttttgaaataaaatgtatctgagtagcagcaaagttattctcaaatttccattttatagctggagatgtcataccgtgacgtatatgataggacccaatatggatcaatcccttttagaagtcaatcaggaagaggggagcagttaaaacagttgcttggtttacaaacattagaacaattttcttattcacaccatctgattattgtattttattttttccccaacgtttagactacacaatgagttaagaatgataaaaataagctcaccaatatactatgtacatatttaccaaaatctgtgcatgcttatacatataaacacagctgataatttattagttaggctcatttgtaatttttgtcactatagaccagttttttatttaaattgaagattagtatacattttaaatgattagtcaaaataaaaaatctaaaatgtgctctaaatacctcttaggtcagaaaaaaaaagtcaaaagctagagtatagagaaattaagaaacgccctaaatttctaatctgacaaaaattcatacaagatttaaatattttaatggaaaatagaacagaactaattattgaagaaattatagaaaggaaacaaaataaacagattatatggaggatttttagaagataagtaaataaattaatatactaggaaaaaacaagggaaatatacttgataaataaatacaggtaagagttcttttgaaataatgataaaatagaaaatctctgtcaaaactaaaaggaaagatgcataaatatataaataaatgataaaaaatgttgcatacatatatgactttttcagaatcaaaaaatttaaatttctgtaataaaatttaaatgtttataaatttaaaaaactagaagaaagaatgttgactgttcacaatacaaataaatgacaaatatttgaggtgatggatatgctaattatccttatttgatcattgggcattgtatacatgtatcaaaatatcactctgtatcccatgaatatgtacaattatttgtctcaaaaacaaacaaaaaaaaagataatgggagaatgttgaaaactcagagagaagagcaactctcacagatagggatccagataacattagcagctgatttctcggcagaaaccttgaaggccagcaggcagtggattatatatttaaaataatgaagaaacctgtcaattgagaaatatatagctggaaaacttatccttcaaaaatgaaggagaaattaagacatttccggatttttttttaaaactgaaaaaaatccatttatccctgaatttgacattcaggaagtgttaagtccttcaggttgaaataaatgaactctaggcaataactatgtaagtaaataagcaagctgtatgaatatacaaagctctctggtaaaggtaaatacataaacaaacataaaaacagtcctattgtaattttggtttgtaactctgctttttattttctacataatttaaaaggcaaatgcataaaatgtaattgtaaatctgttagctggtatacaatgaataaagatataatttgtcacatcaataacataaaaagagtagagctatatatatagcagtagaattttggtatgtgattgaacttaagttgaaataaattcaaattaaaatgttataactctaggatgttatatgtaattctcatagtaaccaaaaatgaaatatatatagaatataaacaaaaggaaatgagactagaaacaaaatgtgtcactacaaaaaaatcaactaaagataaaaaagaaataattgagaaaatgattggcaaaaatcagtaactctgacgtattaaaactttccatgctacataaatctgaaaactctatttcacataaaactggagctgaaagaaacaaatatttacctataaagttaaaagttatatagggaacaaacactaattttttttagaaaaaattataaaaagtaaaaatatgccttatactaccgtaatttcatgttttacagctctgggaaaatagaaaataaaatgttctgttagcatgaatccctctgtgcccccaaaaaaccctatggattgcatcattattacctaaaaagtctattctcaaatgcagcagagtgatattttttacaaggtagatattaattttagatatggaataatattgatgatttcaattttataacactgggttaagatgaaagaatgagaagataaaggtccctcagcaatataactcacaaacatgttcagaagcagtaagaagttacattaattatcttttgaaagtcgataatctacatctttaatgtatgcatatagcatagctaatgtactatcgctgggtccatttattcaatgaataattgccgctatgtgtcagacatttttctaggcctaggaatggatacataagtgaacaaagcaaagattctggttcttgtagagtttccattaaaagacaatttagtaaaacttttcttcccccaaattataaaatctgtaagatgatttaacaacatgtgtaaaagtcattgtgggccaggcacggtggctcataccaggtgtggtgactcatagcactctgtcacccaggctggagtgcagtggcacaatctctgctcactgcaacctctgcctcctgggtacaagcgattctcctgcctcagctttctgagtagcaaggactacaggtgcacaccatcacgcctggctaatttttgtactattagtacagacggagtttcaccatgttggccaggctggtctcaaactcctgacctcaaatgatccgcccacctcggcctcccaaagtgctggaattacagatgtgagccacaatgcccggccttattttctacaactttggtaactttagcatataccccaaatctgtaagacataatattataattcaaatgcaactcatggcttctctttgtactctttctctagcttttgaattatttattctaataccagttttaattctgacacaaaatcatgggagttctaatcaaaatccaaccttttatcataaaaactatgaagaaattatgagtagaatttaaaaaggaaaataggcctattaattagatttgtctttgtagcatttaactctataataaataatattttatgcctatgagtccccaacaaagcctccagcttctatttagatacaaactgtaaaagtcactactggatccacaagcaagactatggtaaataaatttctccacctaaccagcttcttttacatgatgttacatgtttcttttgttttttcattttggcaaatattgattgtcatcttcgtgtttgtctatgtcctaagtgctgggatacagaatctgaaaagatggacacaggacctgccttcaagttcacccccttttttttttttttttgagatgcagttttgctcttgtcacccaggctggagtgtaatggtgagatctctgctcactgcaacctccacctccagggttcaagtgattctcctgcctcagcctcccaagtagctgggattacaggtcccagccaccacgcctagctaatttttgtatttttagtagagacagcgtttcatcatgttggtcaggctggtctcgaactcctaacctcaggtagtcgacccacctcggcctcccacagtgctgagattacaggcatgagccaccacgccctgctaggagttcacgctttagttggggaaaatatacaataagcaagccagtttttaaaatgagaactgcaattagagttaaatgctacaaagacaaactcacaggaagatgggatgtagaatgataaggctctcagaatagtaagagaaactattgcttcttacgatgtttgtctttctttgtatcggtgctcagctgagtctgcagtgcttcagaggcagctttcattttataaaaatctatgatttctccttccagttgttttttctcttcctcgagcttccttatctcctcctgttgaatcattttaagatgctcgaacttgtcctgcagctgtgaaaccaatgtgcagttgtgacaccaaagcagtgtggctgaacacctaaaagaatacgctttttttctgattatcaaacaaacccaaatcatcacagtagagcacgatcttaataacaatctcaaaaactcaggagtaaacactcagatatggaatttttcttttctttcttttttccttttataagatggagtctcactctgttgcccaggctggagtgcactggtgcgatctcagctcactgcaacctccatctcccagttcaagtgattctcctgcctcagcctcttgagtagctgggactataggcatgcaccaccactacaggcgtgtgccaccacacctggctaatttttgtatttttagtagagatggggttttgccatgatggccaggctggtctcgaactcctgacctcaggtgatcctcccgctttggcctcccaaagacttttttttttttttttaatatagagacaagttctcagtacgttgcccaggctggtctcaaactcctgagctcaagtgatcctcccacctcagcttcccaaagtgctgggactgactggatgcagtggctcatgcttgtaaactcagcactttgggaggccaaggtgggaggatcgcttgagcccaggagttcaagaccagactgggtgatataacacaatagtcaacttcaacaggagagagaatctgtaaacttgaatatagatcttccgaaattatccagtcagaggacagagaaaaaaagaataaaagagagaaaagaaggctgggtgtggtggctcaagcctgtaatcccaacactttgggaggccgaggcaggcagattaagaggtcaggagttcaagaccagcctgtccaacatgacaaagccccatctctactaaaaatacaaaaattagccgggtgtggtggcacacacctgtagtcccagctacttaggaggctgaggcaggagaatcgcttgaacccaggaggcggaggttggagtgcaatgtgagccgagaccacacattacactccagcctgggtgacagagcatgactctgtctcaaaaagaaaaaaaaaagagacagagaaaagaaagccaacaagacaccattaagcaaaccattgtcaggttatgggagtttgagaaggaaagtagagaaaggagaataaagcttatttaaagaatggctgacaactgcctaaatcatgggaaagatttagacatctaaatccatgaagcttaaagattcctaaagaggttcaaaccaaatagatactcaccaagtcacaatataatcaaatagtcaaaagttaaagaaactttgcaggtcaggacagaatcgaataatacattcaaagtgctgaaagaaaaaaactgccagcaactaatactatgtctgacaaagctgtccttcagaaaggaaaaagaaataacgtgtttcctcgacaaacaaagctgagggcattcaggaccactaggtctaccttaaaaaaatgcttaacggagtttttcaagtaaaaatgaatgaagttgggagcggtagctcatgcctgtaatcccattttgggaggctgaggtgggtggatcacctgaggtcgggaggtcaagaccagcctggccaacatggcaaaaccccacctccagtaaaaatacaaaaaattagccaggtatgaaggccactgagatcgtgccactgcactccagcctgggtgacaagagtcaaactacatttcaaaaacaaaaaacaaaacaaacaaaaaaaacaaaacttgaggcctggccttctgctcctctccaacctccccttctctgggcccaagccaccttggctgaggagggggcgaggaggtgtgagcccctgccaggaaccccctgcccggaccaagtgctcggcccccaggcctgcgttcagtgaggcctcccgtggcgtcagcatgttcgtgtggaggaatgtggaaggtcactcttcggccgtgttctcctggtactccatccccttcctgacccctccctgcagccacacgaggcccagcaacctgccagtcactcagagtctctggcctccaaccagagaaaacaacctgccaagttggcagccgttgctcatgagcgtccaccaagtgggacagggagtgttgaccctgggcggccccctggagccacctgccctgaaagcccagggcccgcaaccccacacactttgggggtggtggaacctggtaaaagctcacctcccaccatggaggaggagccctgggcccctcaggggagtccctgctggacagtgagacagagaatgaccatgatgatgctttcctctccatcatgtctcctgacacccagttgcctctaccactcagatgatgtcaggcccagtccctcagtgccctgcgcaaggaaaaggactcatcttctgagaaggatggacgcagccccaacaaatcagacaaggaccacatccggtggcccatgagtggcgctcatgatcttcagcaggcggcaccaggccctggcggggcgcaccagggtcaccccaaccaggataaccggaccgtcagccagatgctgagcgagcggtggtacaccctggggcccaatgagatgcagaaatacaacctggccttccaggtgaaggtggcccacttgcaacaaggaccgaaagaagtccagctcagaggccaagcccacaagccaggggctagcaggagtgtaacaagggctcgtgggagcggagcatatcagagacgggcactgccactgcccctggggtgtcctctgaactcctgtcagttgcagcccaaacactccagagctcggataccaaggagcagcttctatggggcagaacggctgcacacagtcagggaacctggctcagcctggcccaagccttctcccacagcggggtacacagcctggacggcagggaaatagaccgtcaggcactacgggaactgacacaggtggtgtctggcactgcatcatactctggcccaaagccttctactcagcatggagctccaggccactttgcagcccctggtgagggaggtgacccgtgggcagccctgctgccgcccacgtgagctgctcattcccagcacatggccagcgaggtcatagcgagtgacgaggagcacacggtcatccatgaggaggagggggtgatgatgtcattgctgatgatggctttagcaccaccgacaccgatctcaagttcaaggagtgggtgaccgactgagagtggggacaactctggggaggagccagagggcaacaagggctttggtgggaaggtatttgcacctgtcattccttcctcctttactcctgccgccccttgctggatcctgagcccccagggtcccccgatccacctgcagcttttggcagtctatggtcacaccctgtcctcctcctacacatactcggatgcttcctcctcaaccttggcacccacctccttcttactgggcccaggagccttcaaagcccaggagtctggtcaacgcagcagagcgggccccctacggccccaacccctggggatgggggcccagggacgccttccaaggtggcctgtttcctcccaatggatcctgccaccttctggtgcaagagacctgaaagtgtgggtgacctggagctaccaggctcctcagtcatcagggtccctcccaacactaaggctttcctaggcaggagctgggctgagccacccggggggcagagcctgaagagaaactgactgggctttcggggtcggggcagagggaaccccacggacatggatcccacactggaggaccccaccgcgcccaaatgcaagatgagaagatgctccagctgcagtccaaagcccaacacccccaagtgtgccatgtgtgatggggacagcttcccctttgcctgtacaggtggagaagccgaggacaggctcagggaaccggagaccgagaaggcgctgtcctcttcactgcacgtaccctggaccagtgccggccctgatcatgcagctcttccaggcccactgcttcttcctgtccactaggccacagccgccctccaggcccactatgcacacatcttcccctccaaggtttgttctgcccctgccctgactcccagccctgtgggggtcctgaccgcacctcacctggctcagactcttgacgctgccctggctgccccaccactgcttctgcccgagagtcacgtgaggctgagagtaggggcaggggcagcagtggtgccagttggggggcggtccagtgggaggagcctcagcctcgcaggctgctccgtgggactgatgactgcatgatcttctgggcacctcacggatcttcaactgcaggtgaaacggatgctggtggtgggtgcagggccgctgggagctgctgcatggttcccagaggctggactgaggcaggtgccaactgaagctgctggggcagcatgggcaggatgttctgcacacaaaccttggagaagaagatgtgtgcatagcaggtccactgctgctgcccctgccctgactcccagccctgcctgaccccacctcaacctgctcaggctctggcacaaccctggctgccctgccactgcctctgccccagagttggggccttgacagcctggttggaaggggacaccccagccctgcctcaacacctgggggtctccataactaccacaggcaggtgggcaaccccaaagatcccaggactcacagtaccccctgagaacatggacagtatgtgggggtagcaatggagggcaggatggttatcttctcccaggtgaagccatttaatcctttcagtttgggacggagtaaggccttcctctttttttttttttttttttttttttttttgagaccgagtcttgctctgtcgcccaggctggagtgcagtggtgcgatcttggctcactgcaacctcttcccgccgggttcacgccattctcctgcctcagccttccgggtagctaggattacaggtggacgctaccacgtccggctaatttttgtatttttagtacagacggggcttcatcatcttggccaggctgatttcgatctcctgacatcgtgatctgcctgcctccccctcccaaagtgctgggattacaggcgtgagccaccacgcctggccaaggcctgctcctcttatctataccccctacccctgcagctgtgccgggggaaagctgggcagtttccctcctccgagcccctgtacataccatgaattgtgggaccttcagagcttttcacttttcggaaaatagctcctgctggggctacaagatggagtgtgaagagggccttgggccacagggaggcgcctgtggactagggggagttcatgcaccccttctttccccagaggggctggactcaggtgagtatgggggtgggggctcctgcacttcgacacaggcagcgggagggttttctccccattccctctgcactcccaacttgagctatactttttaagaaagtgattcaccctgcctttgcccccttccccagaacagaacacgttgatcgtgggcgatatttttcattgtgccaaaaagttgccatgaccgtcattaaacctgtttaacaccaaataataaggaaaataaaataaaaaattcgggcttggcgcagaaactcactccaaataaattacctatcaaaatatttacataatggtggaaatattccaaaattcaatattttgggatttatacacaaaagataaacaaattagaggccaagaggctgccggaagggaaaaacggggcctggaatggccgacgtgaggaatgagctgggcctaaagaggccactggcaggcaggagctggacctgccgaagtggccgaaaggcaggagctttggactggggaggccgcagtgaggcgagagctagctgggcgtggagagtctgctgtgaggccgaggccgaggccgggcccgtgcaggccttcgagaggcaggaggccgggcctgcaaaggccgactggagatcaagttctgcgcctgaagaggctgccaaaagtcaaaagcggggcctgggaaggccgccgagagccatgagctgggctgggccgaaagaggccactgggaggcaggaggagctgggcctggagaggctgactcgaggaagttttgcacctggagaggccgtcgagaggacggagctgggcccagggaggccgacttgctgctcttccaggcccacttccaggccgacttgaggacgacttgggcctgcagaggccgccgggaggctggagctaagcctggagagactgacttcgggacgatttgggcctgcagaggccgccgggaggcccaagctgggcctagaggagcccaccgaccggaggccatttggggcctgcagatgtcatcggagggccaggagctgagcctggagaggccaccgcgaggcctgagctgggcctggggagcttggcttagggaagttgtgggcctaccagggccgctgggagctgggcaggagctgagtccaaagacgttgttgggacctggagtcgggccagagtccggcctggagatgcagccgggaggaagagctgggcccggagggggcgccgggaggctgcaagtgggtctgagaggccaacttgaggaggcctggcctctgcctcccgcattgcccagctgttcctcctggctgcatctcccacctcccagcaaacaagctcttttggctcagctcccgcctgcgtttgtagaccccgaagtttctgcaaccaagctcttcagacccacatcccttctcccagtgactgaacagtcccagctccggctggagaagggcgtctgcagaccccgctgttgcctcccaggggagtctccaggcccagctctcgccccaccgcgacctcccaggcccaagtccctgcctacctcccagcagcccgagtgcgatcctgttcctccctcacggtggcctgttgaggcaggggatcacgctgacctctgtccgcgtgggaggggccggtgtgaggcaagggctcacattgacctctctcagcgtgggaggggccggtgtgagacaaggggctcacgctgacctctgtccgcgtgggaggggccggtgtgaggcaagggctcacactgacctctctcagcgtgggaggagccagtgtgaggcaggggctcacgcctctgggcagggtgccagaggcatgagttgggcatcaacaggccaccgtgagggaggagctgggccgcacgcgggctgctgggaggcaggcagggacttggccccgggaggccgccgtgggggcaagagctgggcctggagaggcccctgggaggcaagggaggggcctgcagaggctgttctccaaccagtgctagaactgtacaggccaccaggaggcaggaggtgggccctcagagcttggctggagaaagttcggggcctacaaaggcggttgggagctgggcaggagttgagccaaaagagcttgcttacttgctgggaggcagggccgggagagcctgacttcaggacaacttgggcctgcggcggtcgccgggaggcccaaccttggcgtggaggagcccaccgaccggagaccatttggggcctggagatgccatcggagggcaggagctcatcctggagaggccaccgtgaggcctgacctgggcctggggagcttggcttgaggaagctgtgggccgaccaaggccgccaggagatgggtaggcactgagtccaaagaggttgttgagaggcaggaatcgggcctggagacccaaccaggaagaagagctgggcccggagagaacgcccggagggtgcaagtgggtctggagaggccgacttgaggaggttctgggcccggagaggccgccggaagggaaaaactgggcctggaaaggctgttgtcaggaatgagccccatgggcctgaagaggccactggcaggcgggagctgggcctgccgaagcggccgagaggcaggagctttggactcgggaggccgcagtgaagcaacagctagctgggcgtggagagtccgctgtgaggcagaggctgggcctgtgcaggccttcgggaggcaggaggctgggccttgtcgaggcctgcagaggccaccgaaagtcaaaagcggggcttgggaaggccgccgggaggcatgagctgggctgggccgaaagaggccactgggaggcaggaggagctgggcctggagaggctgccgaaaggcaggagcttcgcctgaggatgccacagtgagacaccatctgggtctggagggtccactgtgaggcagaggctgacctgtagagtccgacagtagacagaagttgggcaaaagcctgatttgaggaagttttgggcttcaagagtcagccacgaggcaggcactaggcctggaaatggactcacagtcatgagttgggcctaaatgggccactgtgagggaggagctgtgcctgttgaggctgctggcaggcaggcagaaatttggcctggggcagctgccatgaggcaagagctgggcctggaaaaagcccctgggaggcaagagcagggcctgcagaggctgttctcaagtcaaagctgggcctgttgatgccaccgggaagcagaaggtgggcctggagagtttgacttgaggaagttttgggcctacattggccgccatgagctggacaggaactgggccaaaaaaggctgttgtgaggcagcagttgtgcctgtagacccagccaagaggaagaggtgggcctggagaagcccccatgaggcagaggttgggcctgtagacgctgacaggaggcaggagctgggcctggacaggtcaacttgaggagattttgggccttcataggccaccaggaggcagcagttgggactagagagtctgacttgagtaagttttgggcccggagatgacgtcctgggacaggagttgggcgtggagaggccaccgtgaggcataagctggatgtagagaggccagtgtgaggcaagacctgggcctgtctaggctgctgggagacaggcaggaatctggccagggaaggttgccatgagacaaaagttgggcctggaaaggcccttgtgaagcatgagcttggcctaaagaggccactgggtggcaggagctaggtgtgtagaagctgctgaaaggttgggagcttggcttggggggtccacagtgaggtagatgctgggcgtgaagaatctgctgtgaggcagactttgggactgtagaggctgacgggaggcagaggctgggcctggaggggccaccaagatgcaggagctgggcctggagaggctgcaaagaagcatgagctgggcctggtgaggtcgacttgagaaagttcagggcctggagagaaggctgggaggcaggagctgggtctaaagaggccattgtaacgatggagctgtgcctgtggaggctgttgtgaggcagtagcctcatctgcggaggctgccgtgacatagggtatgggcctaaataggccattgtgagtcatgagcttggtctgtagaggctgactggagaaagttctgggcctggagaggctgccgggaggtaggagctgggccaaaagatgtaagcacatttgcatttattaggcactttatttccattattacactgtaatatataataaaataattatagaactcaccataatgtagaattagtgggcgtgttaagcttgttttcctgcaactgaatggtcccacctgagcgtgatgggagaaagtgacagatcaataggtattagattctcataaggacagcgcaacctcgatccctcacatgcacggttcacaacagggtgcgttctcctatgagcatctaatgctgctgctcatctgagaaggtggagctcaggtgggaatgtgagcaaaggggagtggctctaaatacagacgaagcttccctcactccctcactcgacaccgctcacctcctgctgtgtggctccttgcggctccatggctcaggggttggggacccctgctcaagtgcatccaaagcgacccttcccacaccagtcttcacagtggtcaagggcagcaaccacttagctcccaaggcatgtgcctcagctggcatttcgtcacaatcaacagtaagtggtagcttgagtcactgtgaggtcacctactggaaatcaccagcaccccatttcccactggcaaagagctcagcactgccccctgggaaaccaaacctatgcccaaatcccatctgtgtgggtctacctcctgggacccttcctaacatattagtcagagtccaatcaggaagcataaaccactcaaaagtttaaagtggtaaaatttaatacagagaattattcattataacaggtgaacagcataatgagagattggctagcacagagtaaagagaactctagagaatatgggactagcccaggccaggcatggtggctcatgcctgaaattccagccattacagaagctaatgcaggaggattgcttaaggccaggagctagagaccggtctggacgacacagtgagaccctgtctctatccaaaagaagaaaaaagttagctgggggtggtggtgcacacttgtagtcccagctactcagaatgctgaagtttgagcctgggaggtcaaggctgcagtgaggcatgattatgccactacagtccagccggatgacagagcaagaccctgtctcaaagaacaaaaccacaacaaccatttacagacagaaaagaaatagagctaataagctgaggaaagatgttgaaatgtgacaagtaaagtaatatgaggtcttttgtctatttaaaataatcaaacaaaaaatggcttacgaaattataataccctgtgctggcaaaggtgcagtgaaatgggcactttcttatactatgaggggtggttaaattgtgtataagccttccagggtaaagcctgtcaattttttaaaataatggagacagggtctcaccatactgccatactgcctcctccaactcttggcctcaagcaatcctcctctcttagcctcccaaagtgctaagattatagctgggaggcacccaaaaccctgtcaatttacatcaagggtaaggagaatgtccattcaccatgactcacagtaatcttacttctggggagacaattcaatctaagcaaaaggtcatctgtacacacacagtaaaaatctgggagtaactgaagacagagttggtaagtgaaataagaaacagttataagaaattaaactatggtatcaataggcacctggtaaaaggtcagttgatgttagctgctacttttttgttgttttgagacagggtctcactctgtcacccaggctggagtgcagaggcctgatcatgactcactgcagtctcagcctccctgggctcaagtgatcctcccacctcagcctcccaagtagctgggactacaggaacatgccaccacactaggctaattcatgtatttttctgtagggatggtgactccccctttgtttccaaggcctatcgcaaactcttggcctcgagccatcctcctgcctcagcctcccaaagtgttgtgattaccagtgtgagccaccacacctggccagctgctacttttatcaatattattcttattccactcaattaaaaattattattttcaaggctatgcaacagtatgtatcctacagcgtaattgtaaaaacatacacagtcgtcatccctcagtatacagaattagttccagccccccatctctgcatataccaaaatccatgcttactcacgtttcgctgtcacccctctagaatccacgtatacgaaaattccaaatgttagttgggcatagtggcaagcacctgtagtctcagccacgtgggaggttgaggtgggaggatcgcttcagcctggaaggttgaggctgcagtcagctgcgatagcactactacactccagccttggacaacagagggagaccctgtctcagaaaaaaaaacaaaataaaacaggttagaaattgtaatgaggtctgctgggcaaaattccatataagcaatgtataaattaataaagcaaatcgtgataaattagtacgattgactttctggagtttctgacaataaaagtaaggaaaatgcagaacacaaagacagagagtaaaaagagaaattaggaaagcattctacatgttgaataggaagacactggccatgttcgtgcagcggcagtatgtcgtgacatgacataccttggagagaagttaacagatgaggaagttgataaaaatcatcagagaagcaaaatactggtagcgacactcaagtaaaccatgaaatttccataacttatgtcagcaaagtgggaatattgtacagtgtgtgttgaagttcctatacaacattgtttatctgccttttgtttgtttgtaaggaatgtacatactaaaagttcttcttgctgtcaaaagaatatgcgtgaataagtcattttaacttattcttctgtttttcttttatcttcctgccatcatcccacagccttactttagaaatttcttttttagaaaattgaacaagtgctccctgtggtggcacatacctcgaggatgggaggcaggggtggaagggtcacttgaggccattagtttgacaccagcctggccaacaaagtgagaccccgtgtctacaaaacaatttaaaaattagccaagtatcgtcatgtatacctacagtcccagctatctgaacttactgagaatgttcagggcctggagagaaggctgggaggcaggagctgggtctaaagaggccattgtaacgatggagctgtgcctgtggaggctgttgtgaggcagtaggctcatctgcggaggctgccgtgacgtagggtatgggcctaaataggccattgtgagtcatgagcttggtctgtagaggctgactggagaaagttctgggcctggagaggctgccgggaggtaggagctgggccaaaagatgtaagcacatttgcatttattaggcactttatttgcattattacactgtaatatataataaaataattatagaactcaccataatgtagaatcagtgggcgtgttaagcttgttttcctgcaactggatggtcccacctgagcgtgatgggagaaagtgacagatcaataggtattagattctcataaggacagcgcaacctagatccctcacatgcacggttcacaacagggtgcgttctcctatgagaatctaacgctgctgctcatctgagaaggtggagctcaggcgggaatgtgagcaaaggggagtggctgtaaatacagacgaagcttccctcactccctcactcgacaccgctcacctcctgctgtgtggctccttgcggctccatggctcaggggttggggacccctgctcaagtgcatccaaagcgacccttcccacaccagtcttcacagtggtcaagggcagcaaccacttagctcccaaggcatgtgcctcagctggcatttcgtcacaatcaacagtaagtggtagcttgagtcactgtgaggtcacctactggaaatcaccagcatcccatttcccactggcaaagagctcagcactgcccccgggaaaccaaacctatgcccaaatcccatctgtgtgggtgtatctcctgggacccttcctaacatattagtcagagtccaatcaggaagcataaaccactcaaaagtttaaagtggtaaaatttaatacagagaattattcattataacaggtgaacagcataatgagagattggctagcacaaagtaaacagaactctagagaatataggactagcccaggccaggcatggtggctcaggcctgaaattccagcaatttgagaagctaatgcaggaggattgcttaaggccaggagctagagaccggtctggacgacacagtgagaccctgtctctatccaaaagaagaaaaaagttagctgggggtggtagtgcacacttgtagtcccagctactcggaatgcggaagtttgagcctgggaggtcaaggctgcagtgaggcatgattatgccactacagtccagcctggtgacagagcaagaccctgtctcaaagaacaaaacaacaacaaccatttacagacagaaaagaaatagagctaataagctgaggaaagatgttgaaatgtgacaagtaaagtaatatgagttcttttgtctatgtaaaataatcaaacaaaaaatgacttactaaattataataccctgtgctggcaaaggtgcagtgaaatgggcaccttcttatactatgaggggtgtttaaattgtgtataagccttcccgggtaaagcctgtcaattttttaaaataatggagacagggtctcaccatactgccatactgcctcctccaactcttggcctcaagcaatcctcctctcttagcctcccaaagtgctaagattatagctgggaggcacccaaaaccctgtcaatttacatcaagggtaaggagaatgtccattcaccatgactcacagtaatcttacttctggggagacaattcaatctaagcaaaaggtcatctgtacacacacagtaaaaatctgggagtaactgaagacagagttggtaagtgaaataagaaacagttataagaaattaaactatggtatcaataggcacctggtaaaaggtcagttgatgttagctgctacttttttgttgttttgagacagggtctcactctgtcacccaggctggagtgcagaggcctgatcatgactcactgcagtctcagcctccctgggctcaagtgatcctcccacctcagcctcccaagtagctgggactacaggaacatgccaccacactaggctaattcatgtatttttctgtagggatggtgactccccctttgtttccaaggcctatcgcaaactcttggcctcaagccatcctcctgcctcagcctcccaaagtgttgcgattaccagtgtgagccaccacacctggccagctgctacttttatcaatattattcttattccactcaattaaaaattattattttcaaggctatgcaacagtatgtatcccacagcataattgtaaaaacatatagtcgtcgtccctcagtatacagaattagttccagccccccatctctgcatataccaaaatccatgcttactcacgtttcgctgtcacccctctggaatccacgtatacgaaaattccaaatgttagttgggcatagtggcaagcacctgtagtctcagccacgtgggaggttgaggtgggaggatcgcttcagcctggaaggttgaggctgcagtcagctgcgatagcactactacactccagccttggacaacagagggagaccctgtctcagaaaaaaaaacaaaataaaacaggttagaaattgtaatgaggtctgctgggcaaaattccatataagcaaagtataaattaataaagcaaatcgtgataaattagtacgattggctttctggagtttctgacaataaaagtaaggaaaatgcagaacacaaagacagagagtaaaaagagaaattaggaaagcattctacatgttgaataggaagacactggccatgttcgtgcagcggcagtatgtcgtgacatgacataccttggagagaagttaacagatgaggaagttgataaaaatcatcagagaagcaaaatactggtagcgacactcaagtaaaccatgaaatttccataacttatgtcagcaaagtgggaatattgtacagtgtgtgttgaagttcctatacaacattgtttatctgccttttgtttgtttgtaaggaatgtacatactaaaagttcttcttgctgtcaaaagaatatgtgtgaataagtcattttaacttattcttctgtttttcttttatcttcctgccatcatcccacagccttactttagaaattttttttttagaaaattgaacaagtgctccctgtggtggcacatgcctcgaggatgggaggcaggggtggaagggtcacttgaggccattagtttgacaccagcctggccaacaaagtgagaccccgtgtctacaaaacaatttaaaaattagccaagtatcatcatgtatacctacagtcccagctacctgaacttactgagaaagttcagagcctggagagaaggctgggaggcaggagctgggtctaaagaggccattgtaacgatggagctgtgcctgtggaggctgttgtgaggcagtaggctcatctgcggaggctgccgtgacgtagggtatgggcctaaataggccattgtgagtcatgagcttggtctgtagaggctgactggagaaagttctcggcctggagaggctgccgggaggtaggagctgggccaaaagatgtaagcacatttgcatttattaggcactttatttccattattacactgtaatatataataaaataatcatagaactcaccataatgtagaatcagtgggcgtgttaagcttgttttcctgcaactggatgttcccacctgagcgtgatgggagaaagtaacagatcaataggtattagattctcataaggacagcgcaaccttgatccctcacatgcacggttcacaacagggtgcgttctcctatgagaatctaacgctgctgctcatctgagaaggtggagctcaggcgggaatgtgagcaaaggggagtggctgtaaatacagacgaagcttccctcactccctcactcgacaccgctcacctcctgctgtgtggctccttgcggctccatggctcaggggttggggacccctgctcaagtgcatccaaagcgacccttcccacaccagtcttcacagtggtcaagggcagcaaccacttagctcccaaggcatgtgcctcagctggcatttcgtcacaatcaacagtaagtggtagcttgagtcactgtgaggtcacctactggaaatcaccagcatcccatttcccactggcaaagagctcagcactgccccctgggaaaccaaacctatgcccaaatcccatctgtgtgggtctacctcctgggacccttcctaacatattagtcagagtccaatcaggaagcataaaccactcaaaagtttaaagtggtaaaatttaatacagagaattattcattataacaggtgaacagcataatgagagattggctagcacaaagtaaacagaactctagagaatatgggactagcccaggccaggcatggtggctcatgcctgaaattccagtaatttcagaagctaatgcaggaggattgcttaaggccaggagctagagaccggtctggacgacacagtgagaccctgtctctatccaaaagaagaaaaaagttagctgggggtggtggtgcacacttgtagtcccagctactcggaatgctgaagtttgagcctgggaggtcaaggctgcagtgaggcatgattatgccactacagtccagcctggtgacagagcaagatcctgtctcaaagaccaaaacagcaacaaccatttacagacagaaaagaaatagagctaataagctgaggaaagatgttgaaatgtgacaagtaaagtaatatgagttcttttgtctatgtaaaataatcaaacaaaaaatgacttactaaattataataccctgtgctggcaaaggtgcagtgaaatgggcactttcttatactatgaggggtggttaaattgtgtataagccttccagggtaaagcctgtcaattttttaaaataatggagacagggtctcaccatactgccatactgcctcctccaactcttggcctcaagcaatcctcctctcttagcctcccaaagtgctaagattatagctgggaggcacccaaaaccctgtcaatttacatcaagggtaaggagaatgtccattcaccatgactcacagtaatcttacttctggggagacaattcagtctaaacaaaaggtcatctgtacacacacagtaaaaatctgggagtaactgaagacagagttggtaagtgaaataagaaacagttataagaaattaaactatggtatcaataggcacctggtacaaaaggtcagttgatgttggctgctacttttttgttgttttgagacagggtctcactctgtcacccaggctggagtgcagaggcctgatcatgactcactgcagtctcagcctccctgggctcaagtgatcctcccacctcagcctcccaagtagctgggactacaggaacatgccaccacactaggctaattcatgtatttttctgtagggatggtgactccccctttgtttccaaggcctatcgcaaactcttggcctcgagccatcctcctgcctcagcctcccaaagtgttgtgattaccagtgtgagccaccacacctggccagctgctacttttatcaatattattcttattccactcaattaaaaattattattttcaaggctatgcaacagtatgtatcctacagcgtaattgtaaaaacatatacagtcgtcgtccctcagtatacagaattagttccagccccccatctctgcatataccaaaatccatgcttactcacgttttgctgtcacccctctggaatccacgtatacgaaaattccaaatattagttgggcatagtggcaagcacctgtagtctcagccacgtgggaggttgaggtgggaggatcgcttcagcctggaaggttgaggctgcagtcagctgcgatagcactactacactccagccttggacaacagagggagaccctgtctcagaaaaaaaaaaataaataaataaaacaggttagaaactgtgatgaggtctgctgggcaaaattccatataagcaaagtataaattaataaagcaaatcgtgataaattagtacgattggctttctggagtttctgacaataaaagtaaggaaaatgcagaacacaaagacagagagtaaaaagagaaattaggaaagcattctacatgttgaataggaagacactggccatgttcgtgcagcggcagtatgtcgtgacatgacataccttggagagaagttaacagatgaggaagttgataaaaatcatcagagaagcaaaatactggtagcgacactcaagtaaaccatgaaatttccataacttatgtcagcaaagtgggaatattgtacagtgtgtgttgaagttcctatacaacattgtttatctgccttttgtttgtttgtaaggaatgtatatactaaaagttcttcttgctgtcaaaagaatatgcgtgaataagtcattttaacttattcttctgtttttcttttatcttcctgccatcatcccacagccttactttagaaattttttttttagaaaattgaacaagtgctccttgtggtggcacatgcctcgaggatgggaggcaggggtggaagggtcacttgaggccattagtttgacaccagcctggccaacaaagtgagaccccgtgtctacaaaacaatttaaaaattagccaagtatcgtcatgtatacctacagtcccagctacctgaacttactgagaatgttcagggcctggagagaaggctgggaggcaggagctgggtctaaagaggccattgtaacgatggagctgtgcctgtggaggctgttgtgaggcagtagcctcatctgcggaggctgccgtgacgtagggtatgggcctaaataggccattgtgagtcatgagcttggtctgtagaggctgactggagaaagttctgggcctggagaggctgccgggaggtaggagctgggccaaaagatgtaagcacatttgcatttattaggcactttatttccattattacactgtgatatataataaaataattatagaactcaccataatgtagaatcagtgggcgtgttaagcttgttttcctgcaactggatgttcccacctgagcgtgatgggagaaagtgacagatcaataggtattagactctcataaggacagcgcaacctagatccctcacatgcacggttcacaacagggtgcgttctcctatgagaatctaacgctgctgctcatctgagaaggtggagctcaggtgggaatgtgagcaaaggggagtggctgtaaatacagacgaagcttccctcactccctcactcgacaccgctcacctcctgctgtgtggctccttgcggctccatggctcaggggttggggacccctgctcaagtgcatccaaaacgacccttcccacaccagtcttcacagtggtcaagggcagcaaccacttagctcccaaggcatgtgcctcagctggcatttcgtcacaatcaacagtaagtggtagcttgagtcactgtgaggtcacctactggaaatcaccagcatcccatttcccactggcaaagagctcagcactgccccctgggaaaccaaacctatgcccaaatcccatctgtgtgggtctacctcctgggacccttcctaacatataaccttcataacaaacttgagaggctgaggtgagacaatcgatttagcccaggagtttgagatcagcctggacgacgtaactaaatctcatctctacaaggaagaggtgggaggatcacttgagcccaggaatttgtggccagcctgggcaacaaaagaagaccccatctggccaacatggccaacctggccaccacggtgaaactctgactctacaaaaatgatctgggcatgggtgacatgcatgtgtagtcctagctacttgggaggttgagatgggaggattgcttgatctcagaaggccaaagctatagtgagctatgatcacatcactgcactccagcctggatggcacagggagattctgtctcaaaaaaaagaaaagaaatatatatttaatctctgtccctggttcctggcacagagcttctaaagctcttacaaagacctcagtgatagatgtgacaggagcatcttttgttttaatatttgatcttggtcccaggtttctaacacaagagcctctaagaactttgggatctccagcatggtaagaatgcatttggggatgttgttgagatgactgggtgactgcaagctcctaaatttcttcaagaggagggctgattaccatgcaaccacatggtaagaggcttggaactttcagcctcatgcactgaactccagggggaagaggggctggagactgacttaatcaccaacagccaaaggttttatcaatcatgcttgcataataaagcctccataaacaccctgaaaggggtttgcagagctttcagggttgctggacacaggagatgctgggagggtcgcatgttcaacagagggcatgggagctctgtgcccctccgaacttaacttgccctgggtatctttcttttttttgagacaggatcaggctcttttgtccaagctggagtgcagtggcacaatctcagcttactgtaacctaagcctccccagtccccagctcaaggtatcctctcatctcagcttccctagtagttggaactctaggtgcacaacaccacaccagttattattattattttttaattttttatagagacaggttttcaccatgttgcccaggctggtctcaaactcctgagtttaagcgatcctcccaccttggcctcccaaagtgctgagattacaggcatgagccactgcatccagcatgcacgtctctttcattgactgtttctgagatgtatccttcacaatgaaccagtaataggaaatgaactggccagatgtggtggctcacatctgtaatcccagcactttcagaggctgaggtgggaggatcacttgagaccaggaatttgtggccagcctggccaacacaacaagaccccatctatacaaaaaataaaagaaactagccagatgtggtggtgcaggcatgtagtctcagctactagggaggctgaggtgggagaaccactggaacccagacaatcaaggctgcaatgagctatgactgcaccattgcacaccagcctgggcaacaaaataagaccctctctctcagaaaaaaagaaaataaactgtttttctgagttccgtaaactgttctagcaaattattaaacccaagaagacagttacgggaacccccgattggtaacaggttggtcaaaagtatggtgacaacttaggacttgccattgtcatctgaagtgaggatggcctcgtgggactgagcccctaacttgtggggtctgtgctaactccaggtagtgtcagaataaagtcatgggatacccagttaatatccagagcactgaagaatctggtgtagaaactccatacatacattcagtcggaagtgtgtgagtagagacaaacatgggcttttctgtcacctacctgcttaactgcataggagaggcaatatgtggtgctcatgaacaaagcaaacattaaagtcagaccagacccaacatttgactcagtcttaatatccaggtgagcctgcgcaaatcattcattattcctaaggttttcatcactccattcataaaatggggataactgtggcacctatatgtgattctgtgagaattaacgaaatattatgcttggggttattgtgatcattatacctgttccaaactatttgacaaggacagtgatggatgaagacatcaaaaaatcagaaactgcaatgaggtctctcaggcaaaattccatacaagcaaattactgtgtctacaaagcattcctgccacacttaattcaccattccctgaacaaaatatgccatcttcgttgttcaggtctgtacagtgctggtttcccttcccgggcagtttgcgctatcccatcccggcccattccccatccctccacctcccccttccctccccactctcatacaactcttcctcatctttcaggacttggcttcaatgtcaccttaactggaagcttctctcactctccagaagagcttcccattgcacctgatgcatgggaaacataatttgatcatttttaagttacagtccaaatctttttgtacctgaataacatgttgcccagtcagtctctcttcctggattcacaagtctttcatggtagatccagctggaagtgacaaaaagacatcttttgacataaagggatgacacagacagacataagttcttaaatgtcttaaatgtcatgtgaaaattaaacagaattcaaagacttgtggggagcacttaggaagttactgggaatgtcatgaagggttaatttgtattttattttattttttgagacagtctcattctgtcacctaggctggagtgcagtggtgcaatcaggctcactgcagccttgaccacctgggctcaagtaatctcacttaatttttatttggtttaagaaagtcttggttgagggtggtggcttatgcctgtaatctcagcactttgggaggctgagagaggtatattacttgaggccaggagtttgagatcagactgggcaatatattaagaccctgcctctaccaaaaaacagagtgaatgtgtggaagacaatttttccacagactgggaatgagggaataatttcaggatgattcaagtgcattacatatattgtgcactttatttctattattactacatagtaatatataatgaaatgattctacaactcactataacgtagactcagtgggatctctgagcttgttttcctgcaactagactgtccacctggggtgatgggagacagtaacagaatatcaggcattagattctcataaggagtacacaacctagatccctcgcatgcacacttcacaacagagtttgtgctcctatgacaacctaatgctgctgctgatctgacaggacatggagctcaggtggtcgtgcaagcgatgggaggggctagaaatacagatgaagtttcccttcactcgcctgctgctcacctccagctctgtggccctgtggttggagaccgctgctcaagtgcatttgaaaggaaccatcccacgccattcttcagagtcatctttactgctgcagtggtcaacttgtagcacccccaagctcgcaggacatatgcttcaactggcatttcacaatcaacagtatgtggcagcttgagtcattgtgagctcacttcctggaaatcaccagcatcccatatcccattgcaaggagctcagcactgctccttggataaccaaacctattcccaaatcccatctgtgtgcgtctatctcctggtacccttcctagcatcaattctgtatttgtaggagtccaatcaggagacacaaaccactcaaaagtttaaactagaatgagcaagatggctcacacctgtaatcccagaactctgggaggccaaggtgggtggactgctttgagctcaggagtttgagaacagtctgggaaacatggtgaaacctcgtctctacaaaaaacacaaaaatcagctgggtgtggtggcacttacctgtaatcccagctactcgggaggctgaggcaggagaattgcttgagcctggcaggtggaggctgcagtgagcagaggttgtgccactgtactccagcctgggtgacagtgtgagacccggtatcaaaaagaaaaaacgtatatatatatatatatgtaaatttaatataaaaagtattaattttggccaggcaaaatggctcatgcctgtaatcccagcactttgggaggccaaggcagacagatcacctgaggtcaggagttcgaaaccagcctgaccagcacagagaaaccccatctctactaaaaatacaaaattagctgggcatggtggcacatgcctgtaatcccaactactcgggaggctgaggcaggagaattgcttgaacccagaaggtggaggttgcgctgagccgagatagcaccattgcactccagcctgggcaacaagagtgaaactccatctcaaaaaaaaaaaaaaaggtattaatttttacagaggatcagcacaatgagggacacactagcacaaagtaaagacaactctagagaatacggaactagcagaggccaggcattgtggctcatgcctgtaatcccagcaatttgggaagcctaggcaggaggatcgcttgaggccaggagttggagaccaatcagtgctaaatagtgagactctgtgtctaccaaaaaaaagagacattagccaggtgtggtggtggtgcacacccgtagttccagctacttgggagtctggggtgggagaaatcccttgagcctgggaagtctacactacagtgagccaagattgtgccactgcactccagcctgggcgacagagtgagaccctgtcttagaaagaaaaaagaaaagaaagtgttaatccccctatgggaatctcctcttctcctgccctctctggaacctcacttgtcagttcttcctcccactttcctgtatctttaacctatcccccacttttagctccttcccatcatcatttaaattactcaaacttcttctgttttaaaaacctctccctaaactcagggagaggtcttctgcacacacattgagccatctgctcttcctggtgccttctctacagcagcctgagccatgtctctaatctatgaatctcatcatgttactcccccatttacatcacttctccttgcctcagggattaagtccaaactccttaacagcccctgctctgccctgccttgcaaggcagcctcactgcttgcccctctccatttcatctgctatggagtccaactgagcctcatctgccccttgaacgcacactctttctcctctgggagtctctgaagtgggtaatatcctctgcttataatatgcttccccttaaacctctactctcttcctagctagctttgactcctctgtcacttgtccgctttggcatcacctcctcatagaagacttctatgactcccgagattctcaggagcatggcaggtgaagtgctcctcccatgaatggatggagattagggagtgtgtgttattcatgcttaattcaccagtgcttagctgagtacctggcataaaatagttactgtggtggccaaagtaataacccccaccgccaccaattgctcatgtcctatgttacacagcacaattacataggaagggggaattaagagtgcagataaaattaatgttgctcatcagctgaccttaaaacaagattatcctggagtatctaggagagcccatgtaattacaagcattctttaaaactggaagagggaggcagaaggttaagaaccagagacggtgggcacaatggctcatgcctgtaataccaatactttgggaggccagggtaggaaaatcccttgagtgcaggagttcaaggtcagccatggcaacatactgaggtcccatctctacaacaaaataaaaacaaaattcactgagtgtcacgatgcttacctgtagtcccagctactgggaaggctgacatggtaggattgcttgagcctgggagtttgaggctataatgagccatgataggaccactgaactccatcctgagtgacagggcaaggtcctgtttctgaagaaaaaaaggacattggaatcaggaccctctccatcctgaggtgcctacaaggcatctctctctgcaaacgagtaaacatcaccctccaactccttacagagtggagcaacaggaaaactccttcacctcatttctgtgctgcttgggaggcctggacagcccaataaccagctcctcgctgatgaagcaatcaggaaatggctcgagttgagctaaggagaatttggatccttcctttggttctcagtaggcagggtagggggccaggcatggtggctcatacctgtaatccttgcactgtggggggccaaggtgagaggattgcttgaggccaggagctcaagaccagcctggacaacatagcaagacctgggtggcatacacctgtggtccctactacttggtaggatgaggtgggaggattgatcacttgatcccaggagtttcaggctgcagtgagccatgatcacaccactgcacttcagcctgggtgacagagccagaccatgtcacaaaaagttagaaaaaaaaaagagggagagagactatacacaggcaccaccacatttggctaatttttaaatattctgtagagacaaggtcttgctaggttgcccaggctagtctaaaactcctggcatcaggctgggcatggtggctcatgcttgtaatcgcagcactttgggaagctaaggcaggcaaatcacctgaagtctggagttcgagaccagcctggccaacacggtgaaactctgactctatcaaaaatacaaaaattagctgggcagtagtggcgtgtacctgtagtctcacctactcgggaggctgaggcaggagaatcacttgaacctgggaggtggaggttgcagtggaccccatcactgcactccaccctgggtgacagagcgagactgtcaaaaacaacaacaacaataacaaaaacaaaaacaacaacaacaaaaaaaactcctggcatcaagacatcttcctgtcttagcctcccaaagccctgggattatactgtttcctataattgaagacacttgttcttatactgctttaaggtataaaggaagaaaaaaaaaacagataatggcaaatgttggtgaaggccgggcatggtggcagcctgtaattccagaacttagggaggctgaggtgggcagatcacttgaggccaggagtatgagaccagcctgggcaacatggtaaaatcccaccactacagaaaaatctaaaaattagccaggcatggtggcgtacacctgtaattttcagctacccaggaggctgagatgagagaatcacttgtgcctgggaggtcacggctgcagtgaactgtgatggcatcattgcactgcggcctgagagacagagcaagcccctatctagaaaaaaaaaatgtcagtgaagatgtggaggaattggaacccacatacattactggtgggaacataaaattgtgtaaccattttgtttgggtatttcttttcttgtcattttaattggatttttaaaaaatcaagacggggtttcactatcttgcccaggctggtcttgaattcacgggctcaagccatcctcctagctgagcctcctgagtagctgggattacaggtgtgagccattgcacccaactggtatagccacgttagaaaacagtctggcagtttctcaaaaggctaaatgtacagtcatcctataatgcaacaatttcactcctaggcatatatcccagaaaaataaaaatatatgtccacacaaaaacttgtacaacaatcttcatagcagcattattcataatgaccaatacatggaatacatggaaacaacccaaatatccaccaactgatgaacagataaacaaaatgcagtgtgtctctaccatggaatactgccatagaaggaatgaaatattgatacacactatgacataaaggaactttgaaaacactgtgctaagagggaagaaaagccacaaaagatcacatattgtacaattctatttgtccagattaggcaaatctatagtgacaaaaaaattaatcaatggttgcctaaggctgggggcaaaggtaggtggggagagtaggaggtagtggctaaggggtatggatttctctatagggtaatgaaaggttctaaaagtgactgtggtgatcgatgcacagctctgtgaatattctaaaacctactgaattgcagatttcaataaataaagtgaatggtatgtgaatattttaataaagctattatttaaaataataataatagggggctgggcacaggtggtcatgcctgcctgtaatcccagcactttgggaggctgaggcaggaggatcacttgaggtcaggagttttgagcccagtcggagcaacatggcaagatctcgtctctatgataaaaaattacctggacatggtggcacatgtctgtagtcccagctacttgggagactgaagtgagagaaccacttgagcccaggagtttgaggctacagtgaaccatgatcatgtcactgtactgtagcctaagcaacagagcaagatgccatctctgaaaaggaaagaaaacaaatgcaagtttttatcactttgtgagtgtagccaagttggaggagaaatagacaataataaaagagcactgaataatgacggtgagtggctggttaggctcagttgctagctaaatggcttctaaaaaattcaataaagttacagctctggggacagtcatgtagtcaaagaatgaaggcgaaattcattacaattgcccatggtctttatttacatgccttctagtgaaaaattcctaagtgcctaaacagcaagtctgcaatgatagcagctgtttattaaagactacaaaaaagaaatggaggccgggcgtggttgttcacatctgtactccttgaattttgggaggctgaggcaggcagattgcctgaggtcaggagctccagaggagcctggccaacatggtgaaatcccatctctactaaaaatacaaaaattagctgggtatggtggcgggcacctgtaatcccagctactcgggaggctgaggcaggagaattgcttgaacccagaaggtgaaggttgcagtgagccaaaatcgcaccattgcactccagcctgggtgacaagagaaagactcttatcttaaaaaaaaaaagaaaaaaaagaaatggcatcttcttcaagaattacatcgtgtttcatgataaagaagctctaattttgcatttgttcaagtattgatgagatttacccaatatgacacccatcttggataaaatgcaaacaacacaatttcattttctcattaacaaaaccgattaagtagtctaatataaattgcgatcttattaaaaactgatcagattaaaaaaattatggaattatggagccaataagatgttacaacctgttccaaggggaattccaaaatccacacatatctgagaccatcaagtatgatgaaatatatttgattactatattgaaaaataaactgattacatagccaacaattggacaggggtctcctcatccacagccacacaaacccgatcatgcagctatgtggttacaaggcctacatagcctagaagggactggtctgacttgagatttcatttgtatttgtattttgagacagggtcccactctgtcacccaggatggagtgcagtggtataatcatagctcactgcaaccttgaccaactgggctcaagagatgctcctgcctcagctgcccccatacctgggaatacaggcaagtaccaccatgtcaggcatttttttcatttttgtagagagagaagacttgctatgttgcccaagctggcctcaaactcctagaatcaagagatctgcccatctcagccacatgagtaactggggccataggtacataccatcatgcctggctatatttattttattttattaaatttattttttttatttttgtagagaggaggtcttgctgtgttgcccaggctgctctcaaactcatggccttaaaacatactcccatctctgcctctcaaactgttggaactataggtgtgagccactgtacctggcctgacttgggatttcttttatctagcatcctttacttggtaggattgggaaaagcagtagtgttttttaaaattacttaataattcaatcagaatcaaactcaaccttgaccactgccttctctcacagctcacatccagtctgtcaggaaatcctactgactgacttcaacatgtatccaggctctaaccatctctcaccaccaccatgaaccccgtcaggatcactatcatctcccaccgggatgttgccacagcttggctcccatgcttctacccaaatcttcccatagtctttctcaactcggcagccaggtcgtgcttttaaatcaggagacggatcatgtcgcctctctgctcagaagccctcggtggttcccattttagtcagagtaaaagccaaagccccagcaatagcgtcccagggcttacacgatctgtaccgatcccagcccagcaactccctggccacctcgctgacttcgctccctctatctctttgctccactggcctccttccagagcctcagacacaccagagagtttcctcctaatgcctttatcctgttgactcagcctacaatgctcttccctcagcaccttggccagctccatcacctgcttcaaacttttgctcaatattcacttatgaggccaaccctgaccactctacttaacactgccatctgtccccattcccaccatgctcatttctttctttctttttgaaacaaggtcttgctttattgcccaggctggagtacactggtgcaatcacagctcacagcaacttcaacctcccaggcttaaacaatcctcccgcctcagccaccctaggaactgagactacagctgcatgccacaacacatggctttttttttttttttttgagatggagtctcggtcgcccaggctgaagtgtaagggtgcgatcttggctcactgcaatgtctgccttttgggttcaagtgattctctgcctcccaagtagctgggattacaggcacccaccaccacacctggctaatgtttgtatttttagtagagatggggtttcaccatcttggctaggctggtcttgaacttctgacctcgtgatccaccctcctcggcctcccaaagtgctgggattacaggcgtgagccactgcgcctggcctttaaaaaaatttttttttagacatgaggtctcattatgttgtccaggctggtcttaagctcctgggcttaagcgatcctcccacctcagcctcctaaagttctgggattacaggcgtgagcaaccgtaacatgaggtcccagcttcatgttcattttttgttgttgctacaacaaagtaccctacatttagtggcatcaaacaccacaaatctaccatcttacagttctgggggccagaagcccaactaggtctattaaggttaaagtcaaggtgtcagagaggctgcattccttctgggggaggctctagaaagaatgtgctcctttgccttttccagcttctagaagccacccccattccttgacttacctcgtgactccatattcaaggccagaagtgcagcatcttcaaatctccctctctgacctcttcttccattaccacatcactttctctaattctgactctcctacctcattctcttataaagatccttgtgattggtgggtatgggggctcccatctgtaatcccaacattttgggaggccaaagaggaaggattgcttgaggccaagagttagagatcagcctggggaaaaaaaggaagatcctgcctttacaaaattaaaatcagctggacatggtgatgcatgcctgtagttccagctactggagaggctaaggtgggaggattgctttagcctaggaggtcaaggctgcagtgagctatgatcacatcactgcactccagcctcagtggcagagtgagactctgtctccgatataagaaaagaaatatacatttggtctctgcccctggttcctggcataaagcttccaaagctcttataaagcccttcgtgacagaggtaataggagcattttctgttttgatatttagtcttagtcccaggttcctgacacaagggcctctaaggtctttcagatctgcagcatggtaagaatgcatgtgggatgctgttgagctaacagggtggctgcaagctccgagactgcttcaggaggagggctagctgccagagaaagcaaccacattttttttttaaaacggagtttggctcttgtagcccaggctggagtgcaatggcacaatctcagctcactacaacctccacctcccgggttcaagcaattctcctgcctcggcctcccgagtagctggaattatagggatgtgccacaacgcctagctaactgttgttatttttagtagaaatggggtttcaccatgttggtcaggctggtctcaaactcttgacctcaagtggtccatgtgcctcagccttccaaactgctaggattacaggagtgagccaccgcacctggccccaaccacattttttgaggcttggaactttcagcctcacctgctgaactccaggaggcaaaaggaactggagattgacttaactaccaatggccaatgattttatcaatcatgcctccataaacacccaaacagcagggtttggagagcttctgtgttgctaaacacaaggaggtcctgggagggtagtgtgcccaacagagggcatggaagctctgtgcccctccccacttaccttgtcctgtgcatctctttcattggctgttcctgagatggagccattacattgagccagtaatagaaaataaggtggccagatgcgctggctcatgcccgtaatcccagcactttgggaggcagaggtgggcggaatcacttgagcctaggaatttgagaccaacctgggcaacataagaagaccccatctatacaaaaaataaaagaaattagccaaatgtggtggtgggaaccctgtaattccagctacttgagaggctgaagcaggagaatcacttgagctctggacgttgaggcttcaatgagctatgattgcaccactgcacaccagcttggacaacagagcgaggccctgtctcttaaaaagaaaagaaaaaaaaacttgtttttctaagttctgtgagttgttctagtaaataattaaactcaacaagagggtcatgggaaaccctgatttctaactggttggtcaaaatacaggtgacaacctaggacttgcaactggcatctgaagtgagggtggtcttgtgggactgagcccctaacctgtgggttctgtgctaactctaggtagtgtcagaatggaattgtgggatacgcggttggtatccagagagttggagaactggtgtagaaactctgcacacacatttggtcagaagtctgtgagtagagagaaacgtgttgcaggaagtcagggaccccaaacggagggactggctgaagccacagcagaagaacataaattgtgaagatttcatggacatttattagttccccaaattaatacttctataatttcttaggcctgtcattactgcaatctctgaacataaattgtgaagatttcatggacacttatcacttccccaatcaatacccttgtgattttctatgcctgtctttaatctcttaatccggtcatcttcgtaagctgaggatgaatgtccccgcaggaccctgtgataattgcgttaactgcacaagttgtttaaacaatatgaaacctgggcaccttgaaaaaagaacaggataacagcaatttcagggaacaagggagataaccttaaactctggctgccagtgggccgggttgaacagagccatatttctcttctttcaaaagcaaataggagaagtattgctgaattctttttctcagcaaagaacatccctgagaaagagaatgcatccctaaggggaggcctctgaaatggccgctttggggacggctgtcttttacagtcatagataagggatgaaataagccctgggttcgcgtggcgctcccagccttatcaggacaaggaaattcccgcctaataaatgttggtcagatgggttgtctgctctcaaaccctttctcctgataagatgttatcaatgacaatgcgcgcccgaaacttcattagcaattttaatttcgccccggtcctgtggtcctgtgatcttgccctgcctccatttgccttgtgatattttattaccttgtgaagcatgtgatctctgtgatccacaccctattcgtacactccctcaccttttgaaaatcactaataaaaacttgttggttttgcggcttggggggcatcacggaacctgccgacgtgtgatgtctcccctggacatccagctttaaaatttctctcttttgtactctttccctttatttctcagactggctgacactcagggaaaatagaaaagaacctacatgaaatatcaggggtgaatttcccccgatatcacactggctcttctctcacctgtctacctgcttaacttaataggagaggcaatgcatggtgctcatgaacaaggcaagcattaaagtcagaccagactaacatttgactcagtcctaatattcaggtgagcttgggcaaatcgctcattaaccccaagtcttcatcattttgtgcatataatggggataactgtggcacccacctgtttttgtgagaatcaatgaaatattatgcttgatgttattgtgatcatgatactatctgacaagggcagtgatgcatgataacatcaaaaaattagaaactgtaatgaggtctcttgggcaaaattccatacaagcaaattactgtctctacaaagcatttctgccacacttaattcaccattccctgaacaaaatgtgccatcttcattgttcaggtctgtatagtgctggtttccctgcctgggcagctcactccatcccatcccagcccaatccccatccctccacctcccccttccctccccactctcatacaactcttccttatcttacaggacttggcttcaatgtcaccttaactggaagcttctctccctctccagaagagcttccgattgcacttgatgcatgcactattatttgatcatttttgagttacagtccaagtctttttgtacctgaataacatgttgcccagtcagtttctcttcctggattcagaagtctttcatggtaggtccagctagaagtgacaaaaagacatttaaaaaaaaaaaaagagggatgacacagacagacatcagcacttaaaagttttaaacgatatgtgaaaaacaaaatttaagggcttctaggagaaatgtaggagggaaggtgttactgggaaatatgatagaaggttaatttttattttattttatttttagagaaagggtcttgctctatcacctaggctggactgcagtggtgcaatcacagttaactgcagcctcaacctccagggcttgagcaatattcccatctaatttttattttgtttaagaaatgcagtcttgctcttagcaaagctaaagtgcaatggtgtgatcatagcttactgcagcctcaaccttctagactcaagtgatcctccagtcttagcctccccagtagctcggactacaggtgtgcactgcaacgtgtagctcatttttttttttaatttttagtagagacaaagtgtcactatgttgaccaggttggtggtgatctcctacactcaggcagttctctcacctcagccttccaaaatgctgggattacaggtgtgagctgccacacctggctgagggggttaatttttaattatataaagagctcaaagcaaatattagaaggagcctaaatgcctccagcagttgactggtactggtaaattgtgatacatccatataataaaatattatgcaaccataaaaaggattaagatagatcaataggtattggcacaaatgtccacgaaatatgaaaatatgaagtgatgttcaatcaccatgtacgtatcttgaaggatatggcccattttctcaactgcaattatttcctgagataagattatgggtctaaagagtgaaggacatttttcacttatttaaaagtatttatcatttttataatttaataaaagattaaacagatcattgaattagtaaaagacaaagtaactctataaataaatggaaaagacacagataccccaggcatggtggctcatgcttataataccagtactttgggagggggtggtggggggattgcttgaggccaggagttccagaccagcctaagaaacaaagcaagacctcctctctagtaaaaataaaaaaataaaaataattggccaggcatagtggcatgtgcctatagtcccaactactgaggtggaaggatcacctgagcctaggaggtcaaggctgcagtgagttgagactgtgccactacactgaagcctaggagacagagcgagacttcatctcaaaaaaaaaaaaaggacaataaagaaataaagctaataagctaacataaggaaagataaaatatgtgacaaataggctgggcacatggctcacagctgtaatcaagcactttgggaggccaaggcgggtagatcacgagatcaggagttcgagaccagcctgatcaacatggtgaaaccacgtttctactaaaaatacaaaaattaaccaggcatggtggcatatgcctgtaatcccagctactcaggaggctgaggcaggagaatcgcttgaacctgggaggcacaggttgcagtgagctgagatcacaccactgcactccagcctggtcgacagagcgagactgtgtctcaaaaatgaaaaaagaatgggtgacaaagtaataataggaggtctttcatttatcacacagaaaataacttgttaaattataatacctgtgtgggcgaaggtgcagtgaaatggccattttcttgtagtattagtggtgtttaaaatgtatataagccttccagcataaagcttggaaattttttttaaatcatacagacagtgactcattatactgcctcctccaactcctggcctcaagcaatcctcccacctcagcctcccaaagtgctggaattacaggctgacagccaccatgcctgaaagctttgcaatttacatcgagggtaataagaatgctcatgccctgtgactcacagtaatctcacttctggaaatttcacctttggatataattcaacctaaacaaaaggtcatatgcacaaacacagtgaaaatctgcgagtaatttttttctctttttttaaaaaaatatggaatgcttcacaaatttgcatgtcattctttcacagaggccgtgccaatctctctattgttccaactaaagtatgtgtgctactgaggcaagcatgagtaatttaagatagagtggttaagtgacataaggaagaattatggagaatttaaaaatctatgctatttataggcacctagtaacagctcagtaaatattagctgctactattattatttttatggtaatttcactcaattaaaaactgtcattaaaaattaccattgtcatggaacataatgtctcctactgtgtaattgtagaaacagatacaatttgtcccttggtatatggggggattagttccagctctcccatttctgtgtataccaaaatccacgcatactcaagttttcgaagtcagtcctgtggaatccacatataacacaaatgggaaaattagtgaggtgtggtgacaagcacctgtagtcccagctacttgtgaggctgaggcaggaggattgcttgagcccaggaggttgaggctgcagtgagccataattgcaccactgcactccagtctgggcaacacagtgagacagaaggttgactttttaatagaatttttctgttcacttgaagatatggtcaggattgtggcatatgaaaattcttcataaaataactatctaatccaattaatgctggaattgggaacagcagaagtgtcatctcagagctactcacaatgaaaggtgatgtctggggctcaggtgtgttgaggtccccatgcctggactatgggtgctgagtgggatttacttgtccatccattttctatattccagcactgggaaactagggacagtacttgttctcaagggaatcttcagcttaggtggctctgtaaaagagaaattacatcattgaaaaatcgtcgcaggtcaggtgaggtggctcatacctataatcccagcccactgggagactaaggcaggaggattccgtgaggccaggagttcaagaccagcctgagcaacacagtgaaacctcatctctacaaaaaattagaaaatgaactgggtgcggtaaaacattcgtatagtcccagctactctggaggctgaaataggaggatcgcttgagcccaggaagtggaagctgcagtgagctctgatctcaccactgcactctagccttggtgacagagtgagaccctgtctcaagacacacacaaacacacacacacacacacacacacacacacacacacacacacccaatctcactctgtccagccttgactaatcaaaagggccttctggttacagaagaggtatgctcttttgtaggacagggagagaccagcaagcttgttcacagacttttcctcatcctctgcttagttttccaagaaccctcacagtggaaatggagtctctgggaaaatgacctaaatctttgggttaccaggggagaaatatgcctcctttgtcaattaataaatggaacatcagccttaaaatccagggagttctgctagaatgaatcactccctaagaccctgaccaatgcatggaacatgaaaaactgaagtttaactgggcgcggtggatcacgcctgtaatcccagcactttgggaggctgaggcgggcggatcacctgaggtcaaaagttctagatcagcctggccaacatggtgaaaccccgtctctactaaaaatacaaaaattagttgggcatggtggtggacacctgtaatcccagctacttgggaggctgaggcaggaaaatcgcttgaacccggaaggcggaggttgcagttacttctagaagaatttccattagccctttgaaatccttcaacattcatgaaggccaaagagttttcacctaatttaatctgatgggtatgtgaccagagtctttctagggaatagagactcccaaacagttcgactgggaagtgaggagagaatttattactcaaaaccaaagggaaatgaaaagaggccaacatagaatgtcattattctttcttggcggggaatggattccagagtcattctgtgacctttacatgacctccttattagcatctaaaagcttccagtgtaggatgcagccagctaggttctcttctaatgtaataaaatttgcttcggcaaatcttatgcagagccaactccaggctccagaaacaataggctataaattactggatctcccatttgatacaatgaagtatgagcacggtcctgaatgactcctctacatactactctgggtggcttgaagtgaatttgatacaagaactggagcgagggcaaagcagagctagatctaggattaatgtgcttgggcccagctcctcactactcacctatgagtctagttccagaacccaagtagaggatggggaaacaaggctcctgactttttttccctaatatctgcatctctttcacatttcttatctccttgcaaagaaactaaacagtctcaactgaaataactaaatgattaaaccctatacagagaatctccaaagactgacaaaatatcattcaagactgttacacagacaaccttgaggatgacttgatgtaccagtgatctacaatatttgggatcattccaaattcccatcaaggatctgcctatatcaacaaaggagccaaggaccaaccattcaaatgggccctgctgccaagcctttttttttttttttaacaatgccatctcttcatattgttccatttaacaaaactgcagcccttcatctatccttaagtcccttggccaatggtacagagccagagtatgctactccctagcaggaaatcaacaggatgacctactaaacaccattcagaagatgctaagacccatgaattgcaacaggaaagaaaagacagagaattagtcagacaggtacatgctgtgccaaaaatgcactacagcccccacccaattctgcctaatcctagctgggctgacaccaacctgatgagacaggcctataagatctcaaactaaaacagaaactcctgaactgggttcttttgagcccaggaagcagcagtaaatcattaaagaacagataagttcttaaggtgagggagagtttcagataaatggaatgctggtagaacacagggcccaaaggagcaaaagttaacctaagcccaggtagaaccttgtttactagagtattaggcatgggtttgggcaactattctaaccagagaaactggcttcagtgagggcaagttggcaatccaaggtatagcatgcatagggctggcaaaattcagggtgactgaagcaaaagcttcagaaccagaaagaccacatctgggggtagagcacaaaactctcaagagatgaatctttgtaagagtgaggcagaactatatagcagttttaggagatctgttggtgcccagcaagagctccaaacgggctatatgcagggatgcaggctgtagtctcaggagaggaggttcacaaaagtcattcagtccaagacctcaaactgtgttctctactaaaaggaatcaaggttccctagagaaacggctgactccatgtatggtgcagtatattgatcctggaacatcttttttgccagaaagcaaggaagccatcaaagtccaacaggatcacgtcaaaaagacatgaaagtcaacttgaagagataattattaacctagatgagacaatgtaagcatccaaaacaataaagactgcaatggcctgaaatacatcaaatgcaaacaataaactatgagttcataatggtattcagaaaaaaaaactactggtcattagagggaaggttactaggtcactaacttactactctgaaaagtgacttaagatgagaggtagggtggagaattagctatttattcagtctttcctgtacaaacataaatttttagggagattgaagcagatgaaacaaatctggaaaaatggaggtaactgcttaatctgcgggttgggtgcatggaggttcaacatatttcttttgtgtatatttgaaccccctacaaaaaaagcacaagacagaatgtgagccaagcagcttagggtttaggcaaggcttctgcctacaagagacaccaggatatgaggggtagttttagccctattgggctgagccaactggaggtatatagggaagtgctaaattgcagaggtatcatgttgcccagcacttgatcaaatcctagatcctaggtctgcttggtggcatgcttcctaggtagtggatctgaggctacctatagaacttcctttgcagtcatagttcactcagaaactacaaaagtgcttgctcttgaaaatggagtctttgtccatttcatgcttctataaaagaataccacagactgcataatttataaaaaggaaaaaaggaaggaaagaaaaaaggaaggaaggagggaaggagggaaaaagggaaggagggaaggaaaggaaggaagggaaagaaggaaaggaaggaagggaaagagagaaagagggaaggaggaagggagggaaggagggagggagggagagagggagggaggggaagggaagaaaagggaagagaagggaaaggaggaagaaaaggaaaggaaaggaataaattttatttcttaacagttctggatgttaggaagtccaaggttgaggggcctgcatctggtaagggtcttcttgctgcatcatcccactacagaaggcagaaggaaaagagagtgcaagaaagcaagagggcaaaaggggctgaactctgttttataataagcccactctgtgattactaatctattagcacaataacaacattaactcattcatgaaggctattttattaggccccacatcccaactgttgcattgaggattgagtttccagcacataaactttgggggacacatttaaaccatagcagagcacttaggttaattcaactaagaggagctgggaaaatcaaaggcatgagaaagacagcaaaagctagcagagagaaatgcataggttaaggaaaaaagtcacagtgaatcctgtagtgcaggctactttatcaaaagcacctaaaaaagatctcattaactcccccagctcacctccacccacatctaaagagccacacacagcaccaccaaaggcagcacaatgagaacagcattctcctcaacagacaagctgggagtatctagacacctgacctcaatagctccagaacagccctaaaacatttcctccctaaccaccactcaagtcaccagcttggaaagtattaagaaaacccaaatcctgacacaccactatgaaacaacttaaaacagcaaagaacaacccatttaaacagcaatgccagctgttggggaaaaaaggaacaatgagtagaggagaaacagaccactcggggtccaccaagacccagtctctcagcttcagcacttttaaatgcagaatccatacccctctggggcctgtggagctccacaaggcatgtcgtcctcaaagataaatgagcaggcaagctggctagaaaaccactaagggtatttattctttaaagaatctttacagggtcaaagaagaatgggtcttaactggctatgtgaactccccacagattctgaggatgatgtcagtatccctttccagatgtgtttaacactttgcagtcacttgtattcctgccactgagtgccagtgctttgctaatttgaactgattccagctcacgctgaccccagctccctggatgttaccattagccaagactgtcacccatactgtaccctttcaaagagtcctaaaaacagctcttcacctactcttccaagacaagtaaaaatgtctgccaaagaaatggggaaaaaagattcagagagtgaaaacaattaatatactaacaagagagcaaaaagcaaagggggaggagaaactaggaaaatcatatatgggctctcacctatttccaaagctgggctaatgtccttttgcttgtgtctgaataaggcaccaattttaagctgctaatgaaaaaaaaagaaaaagagaaagaagcaggcccaggctgggcgcagtggctcatgcctgtaatcccagcactttgggaggccgaggcgggtggatcacccaaggtcaggagttctagaccagcctggtcaacatggtgaaacaccatctctactaaaaatacaaaaaattagccaggcatggtggcgcatgcctgtaaatccagctactaaggaggctgaggcaggagaattgcttgaacctggaaggcagagaatgtggtgacctgagatcacgtcattgccctcaagccacggcaatgagaacaaaattcggtaaaaacaaaacaaaacaaaacaaaatcaccataaaataactcagacttaattaaatacaaccctagtggtgaatgactaaagatggattactcataacagagataacggtccaataagaatccaggaatcttaccttttaataacaaaaaaatcctttccttctaaagtaacatcctctcaaggccaggaattccattagtagaaagccttcctaaaaaacaaaattcctggccaggcatgggttcacgtctgtaatctcagcactctgggaggccgaggcgggaagatcacttgatatcaggagtcgaggcgggaagatcacttgacgtcaggagttcgagactggcccggccaacatggtgaaaccgcatctccactaaaaatacaaaaattagcctggtgtggtggtgggcacctgtaatcccagtgacttgggaggctaaggcaggagaatttcttgaacccaggaggcagaggttgcagtgaccagcaaggttgcgccattgcaccccagcctgggcgataagagtgaaaactccatctcaaaaaaaaaaaaaaaaaattcctttgggaaggccttctacataaaaatcttcaacatgagactggaaaaaagggtatgggatcatcaccggacctttggcttttacagctcgagctataagaacaaaaagaaaaagggatatcatttaaacacagtatgtagaaaagaataattattgaatctgtactggtctttaacttttacactttgatctttaattctgttattgtgattgagtccaaagaaaaacagtatgagtaaaataaaaagaacaccaaaaatgctaatattctgtttaccgaagtctgtagtgatatatcccattaaatccaagtgcagtgacacacccataatcccaagcactttgggaggctgaggcgggtgaatctcctgaagtcaggagttcaaggccagcctggccaacatggtgaaaccccaactctactacaaatacaaaaattaggcaggcgtggtggcagaggcctgtaatcccagctacttaggaggctgaggcagggagaattgcttgaacccaggaggtgagcttgccatgagctgagatcataccactgcactccagcgtgggtgacagaacaaaacttcaacctccaaaaaaaaaaaaacagctagcaggtgacatttgctatagggagactagggatatgatcttgctgcaatccttccattttagtaaatctaaacagtgtgaatccattctgtttcgtccccactccactccagagccaaaacaagaaaatcaattatatttctagttctttaaaaacatatctaactaaatcatctaattaaaagataatatgcatggttccatactctaaaagaaaacttatgtcctgcatatcatggacatttgatgaatgcttattcagttgactggtgtagacttcaataataacctgttcaatgcattatgccagatgaatcttgcatctcaaaagtagaacaaatattgttctttcagttttgtctacccataaatgcaatatttactaataaaaagaaaatgagtttattgttctagagagtatgagaattttgacaacatgaattctcctgtcctaggacataattaatacttagaggcatactatttcatgtggaagctaccattaaatcaatgttaagtgttaattacctcacataatcttctaatctgacttgactgaagacgtacctgacaaagttgatttatcaagttgtaaatcttcacctgttgaattcataagttcatgtctgaaaggtgagaataaatacttaatattcactaggcaatttcagcaaagtaatatccactagtacatatttaacatttcatcatgaactgcgggtgtgaagagaaaagacaggctgggcacagtggctcacacctgtaatcccagcagtttgggaggccgaggcaggcagatcatgaagtcaggagttcgagaccagcctggccaacatggtaaaaccccgtctgtactaaaagtacaataattagctgggcatggtggcaggcacctgtaatcccagcgactcaggaggctgaggcaggagaattgcctgaacccaggaggtggaggttgcagaaaccattatcacgccactgcattccagcctgggcaagagagcaagattctgtctccatcaatcaatcaataaaaatataaggaggaagcatttactgtgtatttatatgtctggtattatgtgaagcactttactatcttatcaaatcttcgggacaggtcttcagttctcatgaccacaaaagaggatactaaagctcagacaggagaagagacgtggccagcctgtgtccccagggcctatggtcttaccactaggttacagtgtttccagatatcacatgttgtgagatttttgctttaaaatgaaccaaaaaaaaaccaaaggtgaaaaaggcataagctattaaaaagtgggagaaacactaagagaaccttaagcatgtaactaaaaatattatggaaatgttattgaattcattagcaaatttagtgctaggttttcattgaggagtaggttatattactcatgatgaagaaaaatgttccttttaagtatattaacataaataccatcaatattgtttatcatgtttaaatgttcacttaaagcaattcagttaaaattctgcatatcatacaattttatagtttgctagtaggttacaagtaaatagtcacccaaataaaaacatcatgttttccactggttgttgctcttttttaggtgagtatttgatgtataccaacagagagaggataataacaaatcgctaatttctttcatcactatataaaggtggcttcaggatagaatagtatcagggcaatgatgaatttgaaatctaacatcaattcagtgatgcatcaagataaaagcagagacaacaggggcaccttggtgagtactgaacattttatttatttacttatttattttgagatggagttttgctctttttgcccaggctagagtgcaatggtgccaacctcgcctcactgcaacctctgcctcctgggttcaagcgattctcctgccttggcctcccgaatagctgggattacagacatgcgccaccacacccgtctaattttgtatttttagtagagacggggtttctccatgttggtcaggctggtctcgaactcccgacctagatatctgcctgccttggcctcccaaagtgctgggattacaggtgtgagccaccgcgcccagatgaattccaaatttaacaaagcagactaagagaaacaattcatttaaaaaaataatatttggccaggcatggtggctcacacctataatcccagcactttgggaggctgaggtgagtggatcaggaggtcagcagttcaagaccagcctagccaagatcatgaaaccccgtctctactaaaaatacaaaaatcagccaggcgtggtggctggtgcctgtaatcctagctgctcgggaggctgaggcagagaactgcttgaacccgggaggcggaggttgcagtgagccgagatcgtgccactgcactccagcctgggcgacagagtgaggctccgtctcaaaaaaaataaataaataattcaatgaaattcctaagatccagggctttgcaataaatatgtaaataaatttccaatctccatactgaaagtttaaaagaaatgctaactaataactaaagaaatacaacttttcctcagctttgcagcaatctagaaacaaagtgtgtagacactacaaagcaccttacaaggagaaacatgtaaggatggcatgactcgccggcagccctgggcttgtccacggtacccccatgatgaacagtaactccactgtgtaaacgcccatgaacataagattacaagacttttccagtttagacataccatattttctttcagacaattcttcagtttgtttacgtagatcagcgatacgatgattccatttctctgaaaaccaagcaaaagttgcttctcaataacacatccctatgtcagagcagcactaacgtataatgactgatgtcatatattttacattctaacagtccatatcattttactgctttcaagaaaaaatttccccttcttggtggttcttagaattggtttaatgggagactattagagaagctgaaaagcaggagggcagaaaagttcaatcaaattaaacacaataacagggaggtcacaatgaggcggtctccaggggtcttttagcaaacttcctaaaacatgtctcagctgtgtgaaaatagactttacagcagccgggtgcagtggtgcaggcctgtaatcccagcactttggcagcagaggcaggtggatcactttgagctcagggcaacatagccaaaacccccctccccagccccacccccaccccgtccctaccaaaaatacaaaacagcagggcatggtggcgggcgcctgtagtcccagctactcaggaggctgaggcaggagaatcacctgaacccaggaggcagacattgcagtgagccaagatcacaccactgccagcctggatgacagagcaagactccacctcaaaaaaaacaaaaacaaaaacacaaggttaagagggacccccgaccttacagatgcaagtttaagagggacccctaagcaaaaaatgccaaccctttttctcccaatcattgaaacaccaggagggtgtaacagttttgcagcctagctgtagcaggctgatgcccccaagatgcccatatcctaatcccgggaactggtgaacatgaccttatatggcaaaaggagctttgcagatataatgaagttaagggtctttggcttttggggttgatgtactcactcggatccttgtaagagcagagcaggtgatggagagggtgggaggtgtagtgacagaagcaggaaactccagtcattcgagacgggcagcacaggctgaggagtgcaggccacctctacggccaggaaacagattctcccgcagagcctcggaagctaccgaccctgctcccaccttgactcagtaggacttactgtagaattctggccttcagacctgtaagggaatacattttggttgttttaagtcactaagtgtgtggtaatttgttgcagcagccacaggaaactagtattgtagtgaagcctcaaaacccccctgaaggggctgggctcagtggctcatgcctgtaatcccagcactttgggaggccgagatgggtggatcacttgaggtcaggagttcgagaccagcccagccaacatggtgaaatgccatctatacaaaaaatacaaaaactagccgggcatggtggcacatgcctgtaatctcagctactcaggaggctgagacaggagaattgtttgaacccaggggggcggaggttgcagtgaactgagattccaccactgcactccagcctgggtgacagagcgacgctccacctcgaaaacaaaacaaaacaaaaaaaccccacctgaaggtttccagttctgccagcactctcccacccaacccccagaaacagacattccattgctgtgggccatggacaggcagaaggaagcacctcctcatggcagaggcctacccaggagaaacccaagggaaggcactgctgggctggcccctctctgccaaggccatattcttttttttttttttgaggccagtttcactctgtctcccagactggagtgcaggggcacagtctcggctcacttcgacctctgcctccccagttcaagtgattctcctgcctcagtctcctgagtagctgggatgacaggagtggagcatgcctagctaatctttgtatttctagtagagatgcggttttgccacgttgccagtccacctgtctcagccccgcaaagtgctggtattacaggagtgagccactgcacccagcatttgccaagacctttgatggcaggctttttccaggtgatcagtccttgtctggtctggctctgccccactctccttctcacctagttggaatccctagctacttttcagtagaggagagtgtgtaccccaatcccagcttggttcagatctgcatttaactcatggaacctggctgctccccaggtcctgaagaaaaaaacggtctctctgtgggtatgataaaggatgggcctgtccccaggaccctgtgagagggaagcccaatgtcccaccaggttggcagggctggggaagggaaagtgttatggcagccccaagaaaaaaaagaggcagcagagggagcaggacagcgctcacatggaactcatgccactgcctgaggggggggaggagtgcacgccagtgacgtcagggggcagagaggcgcagttccagggtggctttccccctcacttcctgccatgttactctgatcgcctccaggtgagcctgcccactttgtgcccaggggcctgtagaaaaccacagctccccatggttatggccccaggagtggggcagagcagggaggagtcctggacagaggagaggcaggggcaggagggagtgggcctcaaactccaggagggggcccttctcatgggtcctgctttctggcttctccttccttacccctgggctgatcacttggggaagaactgagacaaagtttctcgccctcaggcccaaagggtttaattactgggcccttagggaggtgtgagccccctgaaaggatgcaaggttttgttttgttttgttttttgagacagagtttcgctcctgtcgcccaggctggagtgcagtggcgtgatctcaccacactacaacctgcgcctcccaggttcaagtgattctcctgcctcagcctctggagtagctgggattacaggtggctgccaccacgcctggctaattttttgtatttttagtagagacagggtttcgccatgttgggcaggctggtcttgaactcctgacctcaggtgatccgactggctccgcctcccaaagttctgggatcacatgagccactgtgcttggccacgatgaaaggttttgtgtggagagcatgtacatgcctttctgggaaaacagtccacagcgcttattctcagcagacttcacggtgaaaaaaggttagaactcttgctacagagctgtggaagcagccaggtgaggggcctgccaagggcactctgggcactacctgggcactctcgagcccatcatcccctaggcaggctgcactgcttggtatttgcagagctgagggggtggggcatgtggggactgtgaaatcgccctgagatgacccacagtcctcagctgggaagtgagcgctgcatctcctgcagcgtcctccatccctagagccatggggccaggagaaccggcccttgcagcaagtgaaaagcctattattgattccctccctagccatgtagacagtgaaccaagacactcatatcaggtaaatgccttgttctctgttaccaaggtaaccagtaggcattcccagatacagcgaaggtcctcacaccaagatatgcacctggccacctgaggaaagagaaaggactatctgaggggatggggctgagctgggtgtggagtggtccttgtgggtcttggagagtgggagggggagcagcatgagccaggcctcgaggcagaaggacaaccaggagacagcctggaaaaagtgctggacccacaagggctctaggctggccagaggggaggtgggataggctgtaaagtcctgaggtctgaagattggccctggcaggaagaaaccaggtaaggtggggtgttacctacaccctcggggccagatgcaggccagagccagccaattaccaggcccttagggaggtgtgagccccttgaaacgatgcaaggttttttgtttttgttttggagacggagtttcgctcttgtcacacaggctggcacctttgcccagagcaggcaccaagacttctggctctgggtgtgacctcagtctgggtaaaagccccagcccccaccagcaccacctatcccctagactacttcaggtgctgagcccaagccaggggcaggaagctaaactgatacctagggtaatcccaacaaagtccctggttccccgcagctatggggctgacggggaattacagcccaaaccccagatgctggctctcaaactaacactgagccctcagtgcccacagggagatacaatcagcgcactttccagatggggaaatgggatcagagaagtgcaacagccttgcccaatgccccagaccagggctccaggcccagagtgttcttttgtcactgtgttcagagggcagcagctgctgtgatgtacccacctgagcctggcagctttctccaactttggaagcccaggagcatggcccctgtccacagatgcacctggcatgaggcgtgcccagagggacagaggcagatgagttgcgtctcctccactggattgtgagggcctagaaggagacaagggtctgcttgagaaggcagtgaacagcgagcagcctgaggcagtgcccctctggatggatgcgcagtgcctggatggaacctggctcagacagagctcagttctgcaggtccctgaggcatggagagttcacagctaccaagtgtaggagtctggattcaaagccaacggcgtgactccaaagtccctgccctagcccctggaccacccttgcaggcccatcagatgcccaggccagcagcacagccggccaagaccagggaaacttggggagcctcagagcacccccaggtattccaacctaaccctggtgccccgcctctcaccacccttcttcctgcttttacctcaacccctacacaaagcctgggccacttaatgtggcatcaaacagacgcctcaataaatcagtctaatctcgaaaaaaaaaaggcttaacagatatacaattgcacgttagaatgctaaagaccataaacatataacaacttaaagtacatataaattcaatatatatccaatcattgtaactatgacacagtagaatattaaaatactattttcaaaatgtatacaagcttaatgttctatgtattcaaactgtttattcaaaatacaaatcatcaacataaattgccactaatattcagtcccttcacaggacatgattcactgggagttaataaattagcagccggcaggcagtgacacaccgcaaaaatgaaaaccaagaggtgaaatagttctgaaataaaggttttaaagctaacagaaatcactgaattactaagtcattagcactaattttgagccaactaactaattaatatgagatgatacaatgtcctatactttggtaaatacagactatgtttaaacaatgtctgtaacgtgacttgtaaaatgctcctggctttacaaagatgtgattaagatgtagtaacacatgctaaaccatttccccctgcagagcatgtggtaactttcatcagtcacattgagagtccagaagataaaggaaaaggtcatggatttcgctgagaacttaccagagttgaactccctcattttccgttccccagcattggcgggttctgggactggtggctgtggtggctcgttggtctttgtctcttagaaggtggggaataatcatcatcttgaaaaagaaaaaatggtcattactgaaggaaccatcttaggttacagccacctctgggtcaattcccaacattcaaaagctgagcagggctttaaagctatcttattaataattatttctgtattgcgaacttcagcatacttttttctagttacatttgaaatgttattcttttgggatgtgctcaagtgagtactgctttttcctctgccttgcttcattactttttagtttccttcatttgaatcatcattgtaagtctccccttctcctcaaataactttcaaattgctgccaagaactatgttctatcttaaggcttttgagaaaaaactttcaatgaagatagccgcctaaagttatacaaatatagaagaaacgggataaaataaagcttagattggaaaaaatatttaagattctacaaaattcacgcgtaaacaagggaagctgagtaattgtatgttcaaatacttgcaaaacatgtaggcttaaagaaatagagctggccaggcatggtggttcacgcctataattccaacagtttgggaggccgaggcaggcagataacttgaggtcaggaattcaagaccagcctggccaacagagtgaaaccctctctctactaaaaatacaaaaattaggccaggagtgatggctcatgcctgtgatcccagcactttgagaggccgaggtgggtagatcacctgaggtcaggagtttgagaccagcctaaccaacatagggaaaccccgtctctactaaaactacaacattagccaggtgtggtggcacatgcctgtaatcccagctactcgggaggctgaggcaggagaatcccttgaacccaaaaggcaaagattgtggtgagccgagattgtgccattgcactccagcctgggcaaaaacagcgaaactccgtctcaaaaaaaaaaaaaaagaaaaaattagccaggcgtgaagttgcggtgagctgagactgcaccattgcactccagcctgggtagcagagcaagaccctgtctcaaaaaaaaaaaaaaaagagagagagagagaaagaaagaaagagggctacattatttatgaaacaggtactgttaactcagtcaccagaaagcctgtgtataaatgagcagtgagatattcaagcacagcacacacacacttctcaggacagctgtcgtgagtgttccatgctcatttccttctggatacatcagcaactcactctgctatgatcctgcaatacatctcatgttagaattagagacatctgggccaggcacagtggctgacgcctgtaatcctaacactttgggaagccgaggcaggcagatcacctaaggtcaggagttcgagaccagcctggccaacatggtgaaatgctgtctctaccaaaaatacaaaaaattagctgggcatggtggcgcgcgcctgtaatcccagctactcgggagcctgaggcaggagaatcgcttgaacccgggaggtggaggttgcagtgagccgagatcttgccactgcactccagcatgggggacggagcaaggctctgtcaaaaaaaaaaaaaaaaaaaacagaaaaagaaaaagaaaaaagaattagagacatctggatcaaatcagctgccagtctcgcaaagtgtcgggtaacatcctattaagcttgctgcttacacatcatctataaaatactgaaaatatcattttaagaaatcttttttttattttgagacagagttttgctcattgcccaggctggagtgcaatggtgcgatctcagctcactgcaatctctgccccctgggttcaagcaattctccttcctcagcctcctgagtagctgggattacaggcatgcaccaccacgcctggctaattttgtattttcagttgagacagggtttctccatattggtcaggctggtctcgaactcctgacctcaggtgatccactgaccttggcctcccaaagtgctgggattacaggtgtgagccaccatgcctagccaagaaacccttattttaaaacaagccaggcgcggtggctcatgcctataatcccagcactttgggaagccaaagcgggtggatcacttgacgtcagtagtttgagaccagcctgggcaacatgttgtaaccccatctctactaaaaatatattttaaaaattagctgggcatggtggtgggcacctgtaatcccagcttctcaggaggctgaggcaggagaaccacttgaacctgggaggtggaggttgcagtgagcggagatcacgccactgcactctagcctgggtgacaatagaaagactccatctcaaaaacaaaacaaaacaaaacaaaacaaaaaaccactaaaaaaaagactccatttcaaaaacaaaactaaaaccaaaaacacaacacaaatgtagtacacaaatgaaaataattactgtgttaaacacagtttcatagaaaataaaagaccaatcaaatacaataagctgcctttttagatgggtatgttattcttctttcacagctaaagaaacaggctcagagaatgttatttgattggaccgtgttgcatttctggacagtgcagctgagatcagactttgtgtgtaactccactagcctaccagggtgcctctcataaagctaagaaatgtaaatttggcctaatatacaaagttgccagggcagcactgggtcaattctacatacagtacttctatgttcatcaagggaaaccttaagggaaagtgaaaatgcttctagaaggcgactggacaccagcgcctttgcttgttgcctttgggctcttcttctaaggccaacagtgacctgaaattattgactggcttttcaatcaagtggacaaaatggtaccaaggtcggcaacatcagacaaatttacttgagggccttatctatgcgctttgaaagacaaaactgcttttgtaaaggacactgtatttcagaaaaacataatcatattaacaaataataacactgtaaaatgctgatgtgttgaatgctactttagaaaaacatgctcaaatctagggaaaaaatttgatacaaaactacgtatcaattatctagctagctatctatctagagacatgctttcattctattgctcaggatgggaagcagtgggattatcatagctcactgcagccttgagctcctggcctcaagtgatcctcctgcctcagtctcctaactagctagggccacaggtggacacagttatgcctgggtttttgtttgtttgttttgtagagacagggtgtcactacattgcccaggctggtgtcaaactttggagtctcgctgtgtcgcccaggctggggtgcagtggtgtgatcttggcccagtgcaacctctgcctcccgggttcaagtaattctcctttatcagcctcccaggtagctgggactacaggcatgcgccaccacggccagctaatttttgtattttttgtagagactgggtttcaccatggccaggctggtctccaactcctgacctcaggtgatccacccgcctcggcctcccaaagtgttgggattacaggtgtcagccactgagcctggcggagcactttatgttattaagtagcctaacccaggtgggtcgctgtccctcacgcctgtaatcccgacaactctgatggccaaggtgagaagattgcttcaactcaggagttcgaaactggcccgggcaacatagcgaggcaccccccgaccccatctctagaaaaaaatacaaaaattaggccaggtgtccaccgcgcccggctaatttttgtatcttttgtagagacggggtttcgtcatgttgcccaggctggtctcgaactcctgagcccaagccatccatcctcccgcctcggcctcccaaagtgctgggattacagtagggcccagccagcctcatgttttatttagcagtccctccctgttgcacacctggatagttttttaaatttttttagacagggtttacctcaatctcgcaggctggaatgctgtggtgggatcatagctcactggagccttgaacctttgggttcaagtagctggggggctgaggtaggactacagagatggggttgcgccatgttgctaggctgctcttggcctgaagggtcctcccgcctcggccgcgccagacatagttttctatttttgaccaacataaacactgtgctgggtctgaatttttcagctacccttcttcagccggcaacacacagaacctggcggggaggtcactcttaccagtccccactctgatgagaaaactgcccagctccaggcaccatggcgccccagtgatgtagccgaacacccgcgcctctaacgtcgccaacggcccacctctatggtgtcggcgaagacccgcccttgtgacgtcacggaaggcgcacccttgtgacgtcacaggggactaccactcacgcagagccaatcagaactcgcggtgggggctgctggttcttccaggagcgcgcatgagcggacgctgcctactggtggccgggcgggatgtaaccggctgctgagctggcagttctgtgtcgctaggcttctgcccggccgccgccgcacataagccacgaggaggagctttacgacttcccggtcttcggcgccgggcgcagcaagggccagactctgcgctagcaggcgctgcgcgccaaccggccggcacctgtcgcagaaggtgcaaccgatcgcactgtcgcgcagaagctcctcaatggccagcgccagctgcagccccggccgcccactcgcctcatctgagcctgggtacgtgcgctccacaacgcctcccccagccagggcccggggatccccgggagcgtccccggctacctggcgccgctcatcctgggtagggtcggccccctgaggctgcccggcatgagggagttgcacccctgagcttgacctctgacggtcctttgtaatagcattaagtctttgaaacttgtagcggggtagaaggggctaggaaatgaagaaaacatctttttaaaaatataagcagtcggctgggcgaggtggcccacacctgtaatcccagcactttgggaggtcgaggcgggtggatcacgaggacaggagttcaagaccagcctggccagcatggtttcactgaaaccccgtctctactaaaaacacaaaaattagtcgggcgtggtggcaggtgcctgtaatcccagctactcgggaggctgaggcagagaattgtttgaacccgggatgcggaggttgcagtgagcggagatcgcgccactgcactccagcctgggcaacagaccaagactccgtctaaacaaacaaatatatgtgtgtatatatatgcgatcgagcccgggaggttgagattacagtgagctgagattatataagcgatcgagcactggaggttgatgttacaatgcgctgagattgcgccattgcactccagcctgtgtaacagagggagactctgtctctaaaaaattatatgcaagtgagagcttttcttccagcactcatgctcagactgaagaaagtaattgggccaggcccggtggctcacgcctttaatcccagcattttgggaggcggaggcggaagtgggtggatcacttgagctcaggaattccagactagtttgggcaacatggtggaaccctttctctacaaaaatacaaaaaattagctggacatggtggcacgcgcttgtagtctccgcaacttgccgggcttaggcgggagaatcgctcagctgcagcctcgacctccaggggcaatccatttcagcctcccaaagtgctgagattacaggaatgagccatcgtgcctggctttacactatattttaacactttttttgaaaatggaaacttttacaggcaattcacttccttcaaactaatgataaggaagtgatgctgttctgttctgttttgttttttgtttttgtgggttttttttcttttttgagatggggtcttgcccaggttggagtgaggtggtgcaaacaaggctcactgcagccttgaccttcgggctcaaggaatccttccccgtcagcctccccggtagctaggactacaggtgcatgctaccacgcttggctaattctttttttgaaatggagtctcactctgtctcccaggctggagtgcagtggtgcaatctcggctcactgcaggctggtctcaacctctgacttcggatggtccacccacttctgcatcccaaagtgctgggattacaagtgtgacccaccgcgcctggcgattttgctcattttagatactagaactttttaatttaaaatttttttttcctgagatggagtcttactttgtctccaggctggagtgtagtcgcgtaatctcggctcactgcaacctccacctcctgagttcaagcgattctcctgcctcagcctgccagagttgctgggactacaggtgtgcaccaccacacccaggagttcaaggctgcagtgagccatgatcgtaccactgcactccagcctgggcaacacagcgagaccctgactccacaaataaataaatcaacgtcatatgatctgtaccagggtataggcaggtgctatgatccccacttttcatcctcaactctaagttgagtcatacatcaacctctagtaaaaagtggcatgctctcagtcaaaggggtaagcccaaaccacgtggagagaatcttatctcttttgagagctaatataaaaagaattcctcctaggcataaaaatattatgacaccagttacttaggctaaacatgcctattatgctaagtgagttattaacaataaatactttaactctgtgccatgttaattatcataatctgatttataatttgttttaaccttaggttatatataccttgaagccatttatattttggtatacttgtaataattactatacactggactatgtatattggactaaacacggagagtcaaaaaagagtatgtggtcagagtagaaatcatgccctagcttccttcgtgtctacctcctaccttgagtagaagtggtagaaaaagtaattacctaagattttttggattctggtttgtggagaagcacccttatatttaggctgatgggcggcaaaattagaaagtattttttgtgatttagaattttatacagagatgttcattgtgattaattattctttgtattagcagatttttgctttttatagctgcatgatttcttgtttattattcattcattattgtctattaataaagaaaaactttatttcactgaagcagtgatatataatccaacttggatttttaaataatgactgactttttttctttgggaatacattactgttaaaaatgtaattattagatacattacttttaatgaatataagtggtataattagaaggctgaaaagaatccttggaaacgtgagtttaatttgatagctaagaaactgaggacaagatacttattctttgtagcatattttctaatgtcatttcattgtctcaccaagaaatacttgcataaagcaagttcaattacagtatctgttgaatatttaaggttgagtaaagtgggtgagtttaacagatattttcccttatttcttttaggcaaatctggattgggaaagttgacattaatcaactcattattcctcacagatttgtattctccagagtatccaggtccttctcagagaattaaaaagcctgtacaggtctagatattggtatttttaattgatgataagctggaataatattaatacacacaaagcacgtgttgtaactttcattatgcttccttagaggtaagatgcaaatttgcccttagccagtgtaagatggtaaatatgacttcataaaatcaaaaaaacagaagaagtacagttaatcgaaagattatcttgactagaactttccaaatttgtcctaaggattctcctagagatgacactgtgacatagtaaccaattcccctggagttgtgctatgtagtatgatagtcatttgccacatgtttaaatcaattaaaattaattaaattaaaatgcaatttctcatttgctccagatacatttcaagtgctcaacagccacatgtggcaagtggctgccattttgtgcagcacatatatgaagattttcatcattgtagaaaattgcattggacagtgtagagaaaacatgattcatagaaaaactattgttatttaaatacagtgttctatattagtcagtgggataataccatatcatagttgaatggcaatagcaattctgtaagactcccaagctatatgtgatctaatttactgcttctcagtctttgctatgcattccaatcctgggtatcctgttaaatttatttcttctagtagttctgagatgggctgcctttctacatttctaacaagatcccaggtgatgctgatgctgctggatggtagatcacactttataaagcaaggggctagactctagatatgcactttttattaaatagtacagcagcctgtagccacatgtggctattaatctttgaaatgtgggtagtctgaattgtgatgttctgcaaacataaaatatgccacagatttctaagactgagcatggaaaagaaaatctccataattttttatattgattgtatactgcagtgataatattttggatgtatcaggttaaataaaattgactgatttcacctttttcctattttaaaagtggctactaagaaaattttaaattacttacatgaccgacatggtatttttatttggcagcgctgctctaagctgttgatgaaaaatattgttggtgagctctgcttaggtaatatataggacatgagcagagaggaggcacgtgaacagttctggcctggagtaggcttcattgaggctgtgatgcttttagctggatttgaagaagtggtagtgatcatcccagtgcacaggataggtggacagtctatgtattctgagcagtaactcatatatctcatactgcaagaccccaaaggagtaattttgtgaagtaaatatcttatttctcctttttaatgtttctattttaggaattttttttttttttagtaaccttcatagggcttgagatttaaaattacctgcaaaattctactctaaaaacttgatcctacatgcttattttgtgataaatattggaaattttaaacctaagcaagaaaatgaactttgaactttcttaatttgggtatctattatgaataccttcacttaagtatttatgaatttagatatgaaaggtaaaactaaccactatccaaattaatatacagttcatttccagaaccctagtttcttccatgtgctcacttgcattcagtattacaacccccaaagataaacaccttactgactgccttctccataaatttgcctgttcttgaatgttatatacgtatacttttttgtatctgttttctttcagtgaagattatgtctgtattatttactcatgttgggtgtagttgtttttttcatcgtcgtataatactccattgtgtgaatgtatcagtatatcctttattatttatttaaactgacttaaatgttttttgacactttggttatatttaagaagttgacttctctaatttccttgtcatgtttatttttaaatatctttctctttaaaagttgggatactataataaatattcagcaagtattttgtgtttaaatataaaatcttgttatttggattttaatactttatatatagtatttatatatataaacataaacaaaactaaagactctatgaaagaatcaaatggattttctataactgaaaatttcaatgactaaaattaagatattaccagataggtttaacagcaaattccataaagttggtaagaaaacaagaatactcaaaaaatggaaagaagtagaaaataaaaacactgagaagcatagaatgcaaatttagaaaagagcttaagagacatatcagacatggtaaaaggtttaacacacatataatcaaactttcctagctctgttcacggaaagggcctgggagctgcaacacctcaacagcaacaagcacacctgctacctagaacttggtttctaaaaaccatcctcctctaaaaggaaacagagctctttgaagaaacggtaatttcaaagctagagcacagaaagtataagatgagcccagaatatctttttgtacaagaaagtaaggcaatgctcaaagaatgatggagacatgcccaaaaaaagcagagaagccaacttgaaaagattccaacaggccaaatatggggcgatttgaacatcagaataaaatggtgacagtcacagaattataacccagtgaagaaaggaattcatgacatcatattaatataaataataattgaatattgaaattcgttaaaggaaatgagatatttatgtagtcttaaggtatcttctcacaaattatgtattacttacaaaggggaaaagtgcaccttgacgtgagaatcttggcagaactactttaatcaagaggtttagttgagcattatcagtaacagagtaaatcaaaatcataagccacttgatagatacaatgagaaaataaagcatcacttctgtgacaccctataaaaaatgaatctaataatgaggaaacatgagaaaaaaccaaactgagggatattctacaaataaattgtcctgtaatcttcaaaaatttcaaggttataaaagtcaagaaaaacagacaatcttttccaaactcaagggaactaaagaggcatgaaatctaaatgcttaattctggatttcatctttttgatataaagaacagtattgagactattgataaaatttgagtggggtctgaagattcattggtagtagtaagctcaatttaatttcctcactttgatcattgtactctggtttttagaatgttctagtcaacaggtaatatgaattaaactaatcgagggtgacagggcattatatcagccacttatcaacaaacatttcagagaaaaatagttccttgtattgttattgcaattttctttgagattgccccctccgaaacagtaagaactttcaaaaacaaacaaagatatcaagccacagattcaaagtgctataaactccacgcatgattagttctcactcataggtgggaattgaacaatgagaacacatggacacaggaaggggaacatcacacaccagggcctgttgtggggtagggggaggggggagggataacattaggagatatacctaatgttaaataacgagttaatgggtgcagcacaccaacatggcacatgtatacatatgtaactaaactgcacattgtgcacatgtaccctaaaacttaaagtataataaaaaaaaatcatacctagatatatcacaataaaacttgacctcagagtttctagctctcaagaccaattcctcccatcctgccactaacagatttctccaaacatctctgcacctcagagtgcaaatacaatcaaacatttcactccattgataggaagcatccttcactatcttctaccaagggcttcctcctttggtgcttcaaaattttttatgaaaggaacatccattttattcaaagcacctccaaacctgcaatcctaagttccaggcaactcaatcccaaaaatccactgtagatgcccaaaggctggggtgttcggtcttcaacatttttgcctttgtggctcccagtcaagatagagctgcaccaagtccaattccattcctcatcacagatgattttttctactttaagatcagaactatacaagcttcttgctttgtgtcagcatgctgttgtacccatgggcaaattcttaggtaagacaaaaacacagtcccaagggcaggtagtaattttttcagaaaaaggtaaggcaatcatttatctcagtctgcccaggacagtcccaatttacacatgtatattctcccaatctgtaggctgtcttttcattttgttgattatttcacttaattttttattatttatttattttatagagacagatctcattatgttgcccagggtgatccttgatctcctggcctcaagtgatcctccaaccttggtctcccaaagtgctgggattacagatgtgaactaccacacccagtcaacgtgcagaaggttttcagtttgatgtagtctgatgtagtctcatgtatttatccttcttgttgttgcctgagcttttggtgtgatatccaaaaatatcattgccaagatcaatatcaagaaactttccccctatgtttcttacagaaattttatggtttcagatttttcatccattttgagtatatttgtgtgtatgatgtaagataagggtccagtctccccagtgttggatatccaattttcataacaccatttattgaagagattattctttctccactgtgttttcttgatgtccttgtcaaaaattagttgacttttatatgcttgggtttatttctgggctctattctgtttcattgctttacatctctgttttcatgccagtgccacagtgttttgattactatagctttgtaatataatttgaaatcagaatgtgtaatacctataactttgttttttgctctaaagatttatttatttatttatttttgccatttcaggtcttttgtggtttcatatgaatttcagaattgtttttcctatttctgtgaaaaatgccattgacattttgatagggattgtgttgaatctatatattgctttggatagtatggatgttttaacactattaattgtcccaatccatgaacatgaaatatctttccattcacttgtgtcttcttcaatttctttcatcaatgttttatagttttcattgtgcagatctttcacttacctggttaaatttattcctacaatttcattctttttgatactagggtaaattgaattattttcttgatttctataaattatttcttataatactcatacttgtcaggcctctgggcccaagcctgcatgtatacatccagatggcctgaaataactgaagaatcacaaaagaagtgaaaatggccagttcctgccttaactggtgacattaccttgtgaaattccttctcctggctcagaagctcccccgctgagcaccttgtgacccccgtccctgcccaccagagaacaaccccctttgactgtaattgtccactacccacccaaatcctataaaacagccccacccgtctcccttcactgactcctttttcagactcagcctgcctgcacccaggtgaaataaacagccttgttgctcacacaaagcctgttggtggactctcttcacacagatgcgcgagacaatactaacactaatattattttgattcgtcagatggaaaagtaaggcttgaagaggttagaaataacttttccaaggtcacagagctaattgccacaactataactcagctctagtatgtgaacaaagatttttttataccaaaccaaaattatttatttctactccactattctatcatggtgcattttaggtgctaatgggaaaatctgctctatgatggtgtccaatagacaattaaaattcaaatctggaaatgagatctggactgaagatttttttaaaaattagccctcatcacatgtagtcagctgtagaaatccttagcatggctgaaatttttcatattaagacaagactagaacttggccaggtgtggtggctcacacctgtaatcccagcactttgggaggctgaggtgggtgaatcacctgaggtctggagtttgagaccagctgaccaacatggtgaaacaccatctctactaaaaatacaaaaaattagccaggcgtggttgcacatgcctgtaatcctagctacttgggaagctgaggtaggagaattgcttgaacccaggaggtggaggttgcagcaagctgagatcgtgccattgcactgcagtctgggcaaaaaaagcaaaactctgaagaaagagagagagagggagagagggagagagaaaggaagagacgatgagagacagagagaaggagagagaaagtacaaaagaacgaatgaacgaacaaactagaaatcgagcaggaaccttggaggacctattgcttaaggtgtgggccaaagaaagtaagttagggcaagagactaaggtatgccagagacccaggacaaaacacagtgcagagtgatgtcacagagccaaatgggagtgcaagctatggcaagccctcccaagtatgtgtgggttaaatgtaattaaattcaaaatctctcaacccaaaaattttctccacaaaggaagtagagaaacaaaacagttcattattgaataagcattaaaccagaatgtgatgtgtgaatataatggaatggaatggaatggaatggaatggaatggaatggaatggaatggagtggagtggaatggacccgaatggaatggaacggaacggaatggaatggaacgcactcgaatggaatggaacggacatgaatggaatggaatggaacggacacgaatggaacggaacggaacggaatggacttgagtgggatggaatggaattgaatggactctaatggaatggacatgaatggaatggaatggactcaattggaatgcagttgaattgaaaggatccaaaaggaatgcaatggaatgcattggaatggaatgcaatggacttgaatgggatggaatggaatggaatggactctaatggaacggaatggaatggaaccgaatggaatggaatggacttgaatggaatagaatggaatggaatggactcgaaagaaatgaaatggaatggattcaaatggaatggaatggacacaaatggaaccaaatggaatggaatggactcgaatggaatacaatggaatttaatggaatggactctaatggaatggaatggactagaatggaatagaacggaataggctcgaatggtatggaatgcaatggaatggactcgaatggaatagaacagaatagactagaatggtatggaatgcaatgtaatggactcgaatggaacggaatggaatggacaagaattgaattgaatggactggaatggaatggaatggactccaatggaatgtggtgggatggattcaaatggaatggaatggaattgagtggatttgaattgaatggaatggaatggtatggaatggaatggaatggaatgaaatggactagaatggaatggaatggactcgaatggaatggaatggaatgtacttgaattgtatggaacggaattgaatggactcgaaaggaatggaatggaatggaatggaatggaatggaatggaatggactcgaatggaatggaatggaatgaactccaatggaatggaatggactcgaatagaatggaatggaatggaaaggactcgagtgggatggaatggagtggaatggactcgaatgggatggaatggaatggaatggactcgaatggaatggaaccgaaaggaatggaacggaacggaacggaacgcaatggaatcgacccgaatggaatggaatggaatggaatggaatggaatgcaatggaatcgaatgggatggaatgtattggaatggactcgaatggcatggacaggagtggacccgaatgaaatggaatggaatggaatggtctcgagtggaatgggatgggatgggatgggatgcgatgggatgggatgggatgggatgggatgggatgggatggatttgaatggaatagaatggaatggaatggaatggaatggaatggaatggaatagactcgaaaggattggaatggaatggactcgaatggaatggaatggacatgaatggaacggaatggaatggaatgaactcgaatggaatacaatggaatttaatggaatggactctaatggaatggacttgaatggaatagaatggaagagactcgaatggaatggaatacaatggaatttaatggaatggactctaatggaatggacttgaatggaatagaatggaagagactcgaatggaatggaatgcaatggaatggactcgaatggaatggaatggaattgactcagatggaatggaatggaatggactcgaaaggattggaatggaatacaatggaatggtctcgaatggaatggaatggaatggactcgaatggaatggactgcaatggaatggactcaaatggaatggaatggaactgactcgaatggaattgaatggaatggacccgaatggaatggaatggactgggctcaaatggaatggaatggaaaagaatggaatggaatagaatggactggaatgtaatgagtttggaatggacttgaatgcaatggaatggaatggaatggaatggaatggactcaaatggaatagcatggaatggaatggactcaaatgcattggaatggaatggactcgaatggaatggaatggactcgaatggaatggagttgaatggactcatatggaatggaatggcattgaatggactcgaatggaatagaattataacagaatggaatgaacccgaatggaatggaatggaatggaatggaatggaatggaatggaatggaatggaatgaaaggtgctcgaatagaatggaatggaatggaatagaatggactcaaatggaatggaatataatggaatgggaatgggaatgggaatggaagggatgggatgggatgggatgtaatggaatggaatgcaatggaatggacacctatggaatgcagttgaattgaatggacccgaaagcaatggaatggaatgcaatgtactcgaatggaatggactcgaatggaatggaatgaactcgaatggaatggaatggaatggactcgaatggaatggaatggaatgcacccaaatggaattaaatgtaatggaatggacttgaatgaaatggcaagaatggactcgaatggaatggaatggaatggaatcgaatggaatcgaatggaatgacatggaatggattcgaatggaaagacatggaatggactcgattggaatgggttgggatggaatgatctagaatgtaatggaatggaatggactcaaatggaatagaatggaatagaatggactcgaatataatggaatgaaattggctcgaatggaatggaatggacttgaatggaatggaatggaatcgaatggaatggaatggaatggaatggaatggaatggaatggaatggaatggaatggactcgaatggaatggaaaggaatggactcaaatggaatagaatttaatggaattacaaaccacagtgatataacacacatgcatgaagatttctaacatgccatcctaaattaagtcactgtatcagtcagagtccaagtataggaaacagtcactacccatgcaaacctgaagagaccttcatacaagggagctgaggcagccgcagcctgcagctctgtcttctagtcttgcaggcattcatttagttagtggaagcatatctcctcccagagcccaggctgcaagagtctgaaatggagcttttagctttccagcctctgtatcaaaagggcacaccagaaagaggctagaatgaatggttgggcactaacaaatattttcacaacctaagcccatactcgcagttgtttgctgaacagacaatcaataaatcaaacagcccttccatgtagaaattaagaaggaaacacaacaccaaaactcattattaaatagcattttgtatttgaaaactcattattaaatagcaaataaattgcactaaaatacaaaattgtagaatttgtattctgggaagccacagtaacaaatccctgtgacagaacccacgaagtagaggtctcctgtgggaatgatgaccgaggccctcgccgctgctccacctgcccctccagggatgccctgcttttccagttgcccctactctgatgtgcatcatggcaggaaaaagtgggctgctgctttcctttaatgctttttgtcccactttattttttacttttgcctagtatatcttttcattcttttattttcaacttttgtaaatctctgttttaggtgggcttcttacgtacaacttggagttgggtttcactttttgattcaatctgaaatcttttacttttaccaaccttcaggttatgtgtataaagttatgtgtttacatgtatagatacaatgtttggtcttacttttatgacatgtttttgtagctttttgaaaaagtttgtgttctctctgtagttcttctgaaatttagaaatgtttgcactattttgtactaggggttacttttggaattttaactctatgtaattccctctccttcggaatcctcatacaacacatcttagcctgttagtttcctgttccacactgtgataaaactgtcattcatcttgctccttcttccttccatccctctcctctacaacttgattttagtgaataacatcttactgcctccctgtgattataggtgagacagtcaacaaacctctaaccaccgaccttttctcctctgccctccactcacactctgctccatcaccctcagccacacagctgacgctgtagagattcactgacatccagtctgatggacactgtttctccagccgaaactgctcatgagaacagtgtgtattccctgagttctcacatgatcaatagtgtttgtttgcagactggatacaaaagatggtttgactggacataaaattcatgggccatcctttcttcctggaggatcccataagtaaggattactccactatctgaagaatttggagaaatttgaagccaccctgatcttttccctccgtaagagatgacatgtttgtttacccattgggaggttcttgcttcatcttcagagtttaataattcctgtaggatatggcacactcataacctgttctcagtcaaccttccccagcataaaatttgccctctcacaatgtacacttccatctatttttacctgagcagaattttcctgaacattatctttaaatatttgttctgtccttttgttttgttttcctgtttgaagattccaatgataaatatgctggaacccctctccctgttctcttcagctgtaattttctttctagttccttttaaactcatgattacggtttcattcttattaattctctcattcgtatttttccatcaccttttttgtgtttcccaaaacatctgtcttctcctgggcccttccaatcgcaccttcacctctgtggtggttctcctggctgctgccatcctttcttctgccaacttgactttgtctcctgctgtctcacttggttgtacaggttgagcatccctaattccaaaatccagaatcctccaaactccggaactttttgagcatggacatgatgccacaagtggaaaattccatacttgacctcatgtgatgggttgaacaaaattattaaaaatactgtataaaattaccttcaggttatatgtataaggtgtatgtgaaacatacatgaatttcgtgtttaagcttgtatcccaagttatctcattatgtatacgtaaatattccaaaatctgaaaaaatccaaaatctaaaacacttccagttctaagcatttgggataagggatactcaacctcattaaaatctcttttctgttttgtggcattcctgcactgggatcttctgccacagaactgcttcatgagtttcctgtttttttcatttatgatgaactgtctggtcatgattccatcctgcttcacagacacatttcccacaatttccttagagaatatccatgcagtgatggtcaccttctctaacaggcatttcagagtgaggtgggacgttctagggcacctgttttgcagatgccctcagggtgggggaagggcagcttccagccttcccagttccagcactctctcccccagccgctacctgcatgtgaatccctgggagaccccacagcccatgtctctgagtaaaactggatccaggaagccctttgctttcagtggtcctccctggaacttctgcactctgcaagctggagttgaacatctgcgactcagcctctcagtgcacagggtatgtggggctcgacttctagacctggccctgacgagtgcttttgttagcctgagcccttctgctcagttccgcctatactatcgctgcccaggcttagctgcttttggtaagcctcatgcacattttagagtctgtgaattgcatctgcctcttatttctctgaaaatggagtttttcatcccttccttccaattctccttccagcctttcttgatttccagaatgagaaatcattaagtcatatactgagccacaaataacattataaatgtgacaattacatgataatctttggggggaaaacattctgtgatttctaacatatttacataaaaatatcttacactaaaacacaccagttgagggcactggccagagataagattaggttaaggccaagcaaagctgagaagaccattgttaaaatttcaatcctgttcctttatcttttcaaattaactgaatattgttattaaatttcttgttttagtgtcgaatagcaccttttccctgcctcactttagaatcaatttagagacaaaggattcaggccaactgaggtcatcagcattatcgctaataatagctggactggcggatgcgattcagattcacacaacaatggatttcctaatctgaatcctagactgagatgaagccagccagccgtaagcattgcttaataaccaaagcctccccagataggcttcttgccctacagcactgaagacatgaaagaaacagaccaaaatgtacaaatatcttttattcctcaaaggaaaaagaagagttacacatgcctgtttctcaccaataagaggggtcagggcagagtgagtctgggagagagagttctaccaccacggttcccaaagcatcgtctaggggcctgttaggggagcccgaggtctaaactatttccacagtttcactaagataagattttccttttccatcctcacattcgttagtgtgcagtgaagtgctccagaggccccagcatgctacattacagaagactgaactcaggagagatgaggaataatcccctccatcacaccagacaccaggagggtgtgccaaggtgtgagacatacagtccttactctttttttgttttgttttgttttgtgagacggagtttcacttttgtcccccaggctggagtgcaatggcccgatctcggctcactgcaacctctgcttcctgggttcaagcgattctccagcctcagcttcccgagcagctggcattacaggtgcatgccaccatgcccggctaattttctgtatgcctggctaagttctgtatttttagtagagacaggtttcaccatgttggccgggctggtctcaaactcctgatctcaggtgatccacccacctcggcctcccaaagtgctgggattataggcgtgagccactgcacccagcccagtccttacttttaaataaatggagaaatattttaaaaattgttttaatttctaatgtggcaaacattaatagatataactcacatgaccaaaatctctttggggtcctcagtaattttaaaaagtgaaaaggacccctgagacaacatttgggtttggaactgctgctccactaggggaagagataccagaacagagaatatgtgttccctgggagataaggccttcccgactacctcccctcctatcatcgaaataagttttctacatttctttaatatcatgttttaaaattccttttaaaagactgaaatcatcagcagaaggcacgggattagcttagcacagtcagtttagactagttacccacaggggactacagaatggacatcacgaggcatacataagcatagaggtgagaagggccgtgttcacagttgacaagattacatttcaggttaaactggtaactaagataacagggaaaaagacaattaacaaagaaactgtaatcgtccataagcctaattagccataaagcaaagtctgttgggaatttaatgaacatttgttaaaaacacaaatattataggaagttttttatacagtcatgggtcgcttaacaagggggatacaatctgatccgagaaatgcattgctaggtaatttcctcattgtgtgaacatcacagagtgtattacacaacacctacacagctaggctacagacctatacaacatattaatgcactgaacagcaactgtaacataatggcaactatctgtgtatctaaatatatctaaacataggaaacgtacagtaaaaaaaggaaacaatcttatgtggccactacactacacgcggtcggtcattgaccaaaacatcgttatgtagtgcatgactgcatatctcctcaaatctgacaattctaaacaagtaaagatgtggaagaattagataaacagaaagaaagtacatccttcaaatagagaatctgtatttttttcacacatcaatagaatatttacaaaaatcaattataaagaaggccacaaaggaaaacttaatcatttcaaagaattagagatcttaaaggccaaactctctggtggtaatataataaaactagaattcaataaagttaaataaaatcacagctatttgaaattcgaagtccacttctgaacacccttggatctgggagcaaattggcactgcatgtgtgcctgggctcctgaagggcctcacatacatggggaagggcagagaaagagaaacaacaacatccactacctctatttttaaagtcagccttactacaaaatacagaaagtattcttcactgggcagaccaaatcaactttgctcaatcttcgcctttgggttcctttaggtttataatgaactgtaagcatttactgagtgattattataaaggcaccatttgaagtacctgatgcccttttaatgctgtaatgcccctgtgaagtaggtcttactattatccctgctctagagatgagaaaactgaggcagggagagatgaagaagctggccccaaggccacaccactgaggagggaggggccagacctggagagcagggggatcccacaatctgtgcttgtgccttcctgctctgctgcttcccagctagcgtgtgtgctggacacagccctcagtgatctcaactttgattatctaattttaaaaagacttctcaagtttattgtcttttacaaaaaagggatgtaatctagcaagccaaagcagaaccaagcagactttgtagttttcatcaattttctggacgctccagccactttcctcaggtcctttagcaatgtgtggactgcccgcccaccgctgccccgaggtagggaagcaccacactacaacctcatgcaggctggattaaaacatgccctccacttcaggcttaggaaccagcgcccctcctacagctcacaagttgctcaagcagtggtctgtgagaagtgattctatttttggggttgtcccttttctctgcttttcttgggaaccattttgactctgtcaaatgttcactgacttctagcactggcagaaagaacgtctgcttttttatctgaaactgaactgttacacaacttataattttattttggtaaaagcattcttagttgctgtgtttagtcatactctacaaattatcttgttggtaggataaatatggtgagaattaaagaaaaatgaagatggtagtggacatttgcagactattatcaataccggcatttcaaacttccaatataattcggatacttgcctggaggacaaactttttttggcatgccgtataatgaggagccttatattcccagtgtgctcaaactgccctgacaccacctatccaccgtcgtcagcaatctatgttcaatgtttcttaaaaacatcagttacaaggtcaaatttaattcaactgaggtcagactctcaggggagctgaggagcacttccttcaatggaaatggccatttctgagtggtgacaacactgtcatttcttggaccttctttaacaaatctgttctcaggagcattaacatactttgctaatacattttaatctggcatttttatgggggtaattataggaaatgcctggaattaaatagcctacaaccaattcttggatcaacaactaggaaaactgaaaaatatatatgtaaatatatctttttctgtgtaagaaaagtcctgctaacttaggaaattagaggatatctttgtgtagaatctttttataaagtggaaataggccaggcatggtggctaacgcctgcaatcccagcactttgggaggccgaggcagccagatcacctgaggtcaggagttcaagaccagcctgacccatatggcaaaaccccctctctactaaaaatacaaaaattagccaggtgtggtggcaggtgcctgaaatcccagctactcgggaagctgaggcaggagaatcacttgaacccggggggcggagattgcagtgggccaagattacaccactgcactccagcctgggcgacaaagcgactctgtctcagaaaaatacaaaataaaaaaataaagtggaaataacttcctctgcttctaactatgcagtttgcttggaaaaaaaaaaaaaagtaacctgtaggtgtagtacaactatcagcacaaatgtaattatcttagagtatcttaatagttcctacttcaagtagaacttatgaaggagtttaactgtggtaaaaaaaaaaataattggagtaacttagaaaacatttatatatacaatagttggtttgtatgctcagtcactcattcattttaggaataacaagtgcctactacttgccaggtgcttgggatatagcagggcctactgaataaattattatacaacagtaaattagcattggattgtgttgcttaaaacaacactcaccagagcaaacaaaagcctgattagcaatatgatctgaaattttaaaaacagcccttttcaacagttccatctaatttgccaggtcattattttataatgtcatatgggattgctgggtcaaatagtatttctggttctagatccttgaggaatcaccacactgtcttccacaatggttgaacttatactcccaccaacagtgtaaaagcattcctatttctccatgtcctctccagcatctgttgtttcctgactttttaatgatagccattctaactggtgtgagatgatatctcattgtggtttttatttgcatttctctaatgaccagagatgagctttttttcatgtttgttggctgcataaatttcttcttttgagaagtgtctgttcatatcctttacccactttttgatggggttgtttttttcttgtaaatttgtttaagttctttgtagattctggatgttagccctttgtcagatggatagattgcaaaaattttctcccattctgtaggttgcctcttcgctctgatgatagtttcttttgctatgcagaagctctttagtttaattagatcccatttgtcaattttggcttttgttgccattgctttcggtgttttagacatcaagtctttgcccgtgcctatgtcctgaatggtattgcctagcttttcttgtagggtttttatggttttaggtcttatgtttaagtctttaatccatcttgagttaatttttgtataaaggtgtaaggaagtggtccagtttcagttttttgcatatggctagccagttttcccaacaccatttattaaatagggaaccctttccccattgcttgtttttctcaggtttgtgaaagatcagatggttgtagatgtgtggcgttatttctgaggcctctgttctgttccattggtctatatatctgttttggtgccagtatcatgctgttttggttactgtagccttgtaatatagtctgaagtcaggtagtatgatgaaaagattataaatcattctactataaagacacacgcacacgtatgtttattgcagcactgttcacaatagcaaagacttggaaccaacccaaatgcccatcagtgatagactggataaagaaaatgtggcacatatacaccatggaatactatgcagtcataaaaaaggatgagttcatgtcctttgcaaggacgtggatgaagctggaaaccattattctcagcaaactaacacgagaacagaaaaccaaacaccacatgttcttattcataagtgggagccgaacaatgagaacacatgggcacagggaggggaacatcacacaccagggcctgtcggggggtggggggctaggggacggatagcattaggagaaatacctaatgtagatgacgggttgatgggtgcagcaaaccaccatggcatgtgtatacctatgtaacaaacctgcacattgagcatatgtataccagaacttaaaagtataatttaaaaaattttttaaaaagtcatatgatgcatttaagaaagtcacttaatttacatcagaggaaaatcaaagtttatagacttaggaaataaagtcgtaatgaagaagctcttcacggctgtcaggacagctacgtttttggtctctgtccttgattccattgtgaccttcagcccatctctctgggccccattttcttgtctttacctcttgggtcataaatggatctccatgcagctgatatccctctgcctaaatcctcctcaaaagaaaatcaaaatagtggctaacacagagtacagactgttccaagagcttcctatgatggaactaatctaatctttataacagtgctctgaggtagatgctaaaatctaccagatactatggatgagatgatgaagtcatatgcttgagatccctgagtaaataaataagaaagagacagaattccaacagcggccgtgtggctgcagagcctctctccctccctgcctcaccctcgagtccccgcctgggagggctcagggtcactcactaagcatctttcccatgcgctgctgtgaggctgctgctattaacttgctactatggagtagtcattagtagaaattatgaaaaaatttgaaaaaaaatcttcatatagccagagattctagcctgagatgtctttccttatttgcttattattatttgtaaaaacagggtctccctatgttgcccaggctggcctcaaactcctgggctcaagttatcctcctgcctcggcctcccaaaatgctgggattgcaggcatgagtgaccgcacctggccacctttccacatttaagagatccctgggatactgcgaagcaggagtccatctccagacatgaggagcaggtgggctaaaggaaacaggactggggagtcttggaggggcagagcaatgcccagggacacagaaacttttgaataaagacaagagagaccgactcttcgcctacatctaaagcaaatgaaaacataaaaataaatgatggcaagaaactaaactaaaaatacactacccctgaaagtatgtgacactggatgtactatctaattggtctgccacaggtagagaatgaagtacttcagataagttaatttatcaaataactaaaattagatatataaactttacgattctgaaaacttttttcctacagatgtgtgtactttaggaaacacagcatatttaacatttttataaatttcagttgcacaccgtgcagctttcaggaagctttcacaccgtgcactgccctgcatgcacctcccaagcctcgggctgttcatgcctggctgtcagaagtcacctcctggctgccagaggggcgagggggcaggctgttcttctcagtgctataagcaagcccaggactccaagggaatgataacaaatgtgtaaaaaccacagtcacattaacctataggctcaggacccagttctacttcctccagacagcttttgggtactggtctccctctctgtgtttacagccgtcctgggtttgctgggcacctccgagttcatggaagtgcagctcctcactgcagttgggacacactccactttgacaaagggggtgttattttcagcagtgggtgaacagcagtgaacaaaccaagcccctgctcctggggctcaactgggatggggacgcagacaacttaaacacgtgaccactggcgtacctaagggccagggaatgctgctgacatgatgggggtggcgaggccaaggtcccagccaggtaggcttgagttggtattgctacaaccttgtgatcactggcaaacaagatttcatggtgggagtgtgactagaactggatttcaaagtttcttgaaagcactagttagaaaagacaaggtacattgatctgcacacaggaggtgctcagcgacgccagcactgatgggctcctcctgccttgagtgaagagcatctgcccctggacagtgaacaaaaggtggggccattttatgcctccaacaagacatctggctcaaactcaacttcaaagattagagtaaaaacgaaacttccattccaaactacttatctttattttggcaactggaacaatctgtaattgaacactaaattctattactaacttttatcctaagactgtgtagtaattattgattagtctccgtttaaagttgctgtttagatggaaaaaatgattttacataaaacattagttgaaagatacaggctgggcatggtggctcacacctgtaatcccaacactttgggaggccgaggcaggtggatcacttgaggtcaggagttcaagaccagcctggccaaaatggcgaaaccccatctctactaaaaatacaaaaaagaattagccaggcatcgtggtgcatgcctgcaatcccagctactcaggaggctgaggtaggagaatcactggaacccaggaagcagagggtgcagtgagcagagatcgtgccactgcactccaccctgggcaacagagtgagactccatctaaaaaaaaaaaagatacacattaagtttttcacacaaattcttaagggcagatattactaaatgccattagaaaaaaaggaaaccttttatcaagcattttttaaaaatgcttctacatttcttatttataggtattctaataatactgcgtgacattacggacaacttagcctaaattatggaaaatcaaattatttagtagaactgcaagacaatcctctcagttgttgtagtaagtgttgctataaacatttaaaacagcaaaaaaataccaaatacctgcacagtatgtatgataaatgcatatgataaagtaaaaaaaaaaatagcacacactgaaagaaagccaacagaagagggcactgggcatgggccagggagggcaagaattgggatggggacatggaggagcccaatccaaggcaagacacaggttcaggctttaccacagtcacaaaggctgcttcttgtttttgtttttagcagaaggtaagcatgagcaaattactttttagaggtaactttgctgaacttgtgaagaatggtgtgcaaggtccagagcgactgcaggagagggaaggtgggattcccacagagcaggagcacagataagccaagcaaggccctgcttggaaggcagcaatcaacagagatgcacagacctgtgagggtgccgggacagccatgcaacaatgcagcccttttgcttcctgagctcaccagttccctcgctccacctctgagaggtggtttggagaaacacagcccttctcaagagggctgcaaggtaagtttagttggtacatgagtgcacagcacattttaatttttatagttatgcatttattttatatgtactagacaaacgaccgacagaaaatttaccatttcacaggtattagtgtttaggatgaggctaaagtaggtatttctgtttaaaaaagtaaatttgaagaaaagctacccagcaaattatagtagtatgtggtacacagacaaaaaaaaaattatgcagtcgtccaaatgactgaaactgataaaatgctggtcctggtctatggattccccctctgacaaagcacagaatactcgcaccttctccagagtcagtgaccaaagatgagagagcagggcacccagcacagaaaccaccaggagccaatgacttcctcctgtgctccatcctactctctcactcacaccaggaattaaatccttttatgtagacagatggtcaagaattgctactataaagcaactcagtatggtctgaactatcagagagctacatggagaaatagctactgctaaacagacctctctgctgatgtttttcccagctacttaagtcctgaaaatttccacaaggctgagtcaaatctgcgtttcatcatctataagaaaggtacctatcgagaacaccctgctggccagtgtgtaaatatctaaaggaggactcagaaaacaccggggaagtccagcctgcacgtggtggctgggcttcagtgaagcatgcagcacaacaggagttgtaagtagtagttacatcagcagccctggaaattctgctcagaaccaaactgaacaaataacattatctaaggcttacaattatttaactccctaaattttctgtcctcccagtagcactttcaaatgcctaaaagcaattaaaagaaacatttttccaatgtctcacagaaccattagaaacacaaaattaatagcttcataaactatagcttctattttatccataatagaatgaaggtgcataaaccacatagtaattaatctttggacaaaagcaaacaataaatggaatatatggctaagatcctttctttttgagtgtggcccaagataaaaatttcttccaaaagggtaacattaatgcaataaggcttttgtggaattctattttgtacgaaattcctgttttctattagctacttcttcctctgtgacacaagcctcattccttgtgaaaaacacgaagcagaaaacattcgtgaaatcatcaggtaaagatcccatgaccgttctatcactgacacagtatgtaggtacatggtacaacccccaagggaccaccttgtggcatcctcagcaaccacagagccacagggcagatgagtgtttgctcccactgaggctctgcaacctctgccaccaatactggagaaatcctccaacctcactgttttctcctgaacttgttcccttctgtttttcgattaatacacagcaaacaggcacaccttcaagctgccaaaagcatcttaaacgttgtacacttacaatcttcaaaatatagttgttcaaaagagtcatcaaagtagtttttgaaatagaacacttactttgaccacataattgaaccttcggatatcttgaattgcacttgagaagtctaaccgattaaaggcttctcccaaggtgcaatagccatgcctctggaagagcaacacagaatttaaaattagtcaattagccaaaaagaattggcagttaatgtcaattaattgtgcgattaaaaaaatttttggcaaaggacaatttgtttttattttgaagactgattttagatttagatgagagtatagtaaaattgtagcaatgctaataatttaagctgtttatgtatacctgagacaccattaactgacattttttacaacctgctgaagtaatgacaaagacaaatatttattaaatatcttgctggtttgttttgttggggacaaactggggtgtggacgatgttaaagctaagatcataaaaaaactggattcattctaggctacgcaactaaaaatacataaatcatctgattaactgcattgtaaggatgtaggtgttacaaatatctagttgaaacacaggatttctctgcaggggaggcatgcactgcccgagtttgaagtgtaacatgggatttctctccagagcagccatgcactgcccaggctggaagtatgctcaaccacaagggtcagggctgggagaggcgcttcggtagcaagaaggtgcctctgaaaaccagcattgggatggagagggctgaaggcaagtgctggatgtgaccacgggcagctttcaggctgggagcacggatgccaagaacccaaaacaccaaaaaaactggtgcttagacccacaggtccaagaaccgaaggaagaaaatgaaacaatttattttcagtactgtaaacactgctgctattctcttagatgtttttcttccatgatatacccttatcctgtattggtttgtatagattagcacattaggtttcagaagtcattttaaactccatcttcatcctccatatttgaaatatttaaaatctacagattttcaggtcaaagttgtagagataagtaagctagaaaacaataatagaaaacatgagacgattggtctcaaattccaaacaggtgacttgagatgtcctagagaaagcagctggagccatagcacctttgtctctaacagccgatacactcagaggctcatgtgcttctgtgcgccaaccccaatcgccctgacgggtgcacaactcaactaaatatactcatttaaaacatccaaatatgttgactgagtgcctgctatgtggaaaacattttcctgggaactctggggaaaggaaacactcattttgatatagattataatctgaaatccatcacagctgatattccacacgatggtgtagcagacactttccaaggtcaccacccatctcacaaaaggaaattaaatctgattcacagagcagaccacaaagagcatgtctggacctagaaccacagcatgtaacctcggaagcagtgagacaccagccagcatggacaagcagcaggcacttgctctataccaggtgagggtgtggagacatgacgtggtgcagggacaccagcacccagtcctagttctggtccctctcagccttgttaggtcctggttcctaagattccagggaacatccccacagcctcacaataagatcctcctttcctgcatatgctagcttggatgggatcctctgttctgtaatcagtatggcaacagagcagatgaaatatttaatggtctttcatgagcactaaattttgttttttacaaactaggttagattctgtcaaataatcgtctaatggtgtattcgagtgtatattaaggatctgattcattctatacccactaaccataaccaaacagattaagttttctttctcagaatctaatccttcagtttcttggaagctggactagtttcagagcatctacaaacatttctggaatatttaacttaccctgaaataacagacgatagacagtaattccctaaattattttccccagttgttgcaaaataaagcaaatgcagagtttctaggactataaaaggaactcaacttcccggatcctagtaaagaaacaggaaacagcttgaagctctctggtttgttttatggctcatgaaaaagctttagcccaacttggcaaaagaaaggcagggaaagagttcatatggctctgcacaaacccaacccaattactaatttcatgttagccactctttatgtggaatgagagggctcacagatgccctgccctccaaaacacgccacagggaggacacattcccatcagcatcaggggttcatgctaacacagagaaaatgcgtatgactgcaggagtccatgcttggtttaaatagccctgctgttgactcagatatgtacaggtaggcaggaaccacacactgtacacatataccacatgccaccacacaccatacatcccacagaccaatgtgtgcataaatacatgcacaaccatacatacacaccatacatacaacacacatacaccatacacacaacacacaccaatgtgtgcacaaatacacagccacataccacatgcacatgcaagcacacacaatggagaatcactgcctcaaaagctcctcatatgctattatctgtcagaatgtgaaccatagatctgatattgcaaaagaaatgtgttttatgcaactttattaatacatttatttaatgtgactccatattcaacagaaacaatccaagatactctcttatttataatagaatacttacttcttttgtgctttctttatggacatagatccatttttcatgataaaaacctagaataaaaattacctttgtttttaaaatctggcaaatcatttcaaaatgaagattttaaaggaatttaaataattggacatattaacaaaattatctgacttactatattgacaagaaatgcttttacttggttgaatgcaaacagaattgctttgtttcttaaatcagtttaagatatgaacaatgatttcagacagtaccaagtcctagtaacttagaagaaaattagtattattaatgactgaagccatatgaagacataaatgattataaaatgcaattacattactacattcctatgtaccctaataaaaagttctattcttctgttgctgtgtatagtactccatagaaacaaatttttcagataaatcttaaaagtttcaagaatcacactaactgtattctccatgtgaccctatcttcttcataaagtagtccccccgtattcacagtttcatcttctacagtttcaattacccacagtcagctttggtttgaaaacattaagtggaaaattccagaaataaaccattcataagttttaaattgtgtgccattctgggtggtgtcatgaaatctcacaccgtcctgctctgtcctgcctgggatgcaaatcctccctttgtcaagcgagtcctacactacccgccccttggtcactcagtagccgtcttggttatcggatcacctgttgagatatcacagtgcttgtgtttaaagaacccttattgcacttcataatagccccaaagtgcaagagcagtgatggtggccatcttgctataactgtttcattttattattattctcgttaatctcttactgcacctaatttataaattaaactttattataagtgtgtatatacagaaaaaaaaacatagtatccataaggtttggtagtatccacagtttcaggcatccactggaggtctatcccctgaggtaaggaagcctactatacattaacatgtgtcttggtaactcacagatatgctgcatgatagaacgctatgccctctcacagataggtcccacctccagccttcccctgctgccatctaacatcctaaactccagctctgaatgtctgtctcctgctctgaatcttcagtgacttcgaaactcaagtcaggacacctctcagtttggcctcactgctcaagattgagctgaattcatgaccataattcaagcattcagattcatgggctgttttgtgggttttgctatctcttattttgtttttgcacatcttacccactgaaacgttgggctgcaaaaagtttgatcactaaatatgtaggcaatgctggatactgggctgttatttacatatttgtatcaccttttatttcataagatagcattgtcagagtaatttagtatttcaacataatcaacaagtaaaataaaattaatgagaatgatcttactttgagtatttgtgtcatttctaaaatggtcctttttcctttttttggatgcatattcatgctcttcattattgactatttctccatcttcactatttaagatactgaaataaagacatattctattaaaatattttttcagggagatcttcatttggcttttcttttgtaaaaggatacaaatacttcaaagtgacagactgtgggcttgaaatcacaggggtaatgtctaatacatttttgtttcattttgagaaataagatgtatcctggttctttgagaatattgtaccagaaagtgctgaacatgttttagaatctctgaagggtcttgatatgcttatccaaggtagtttcaaacatcaaaatggcttattaaaacagagatttttttaaaaaacaactattaaaactccagaaaaaagatggtaagaacatgatgatacccaatactgaccaatgacttgatgtgtcccttaccccatgctgagtaaccactcaacatttctgtttactccctatatgtttaagggtttaactgaagttaattattactgcactgaacatgtttttattaagcaccaaccacatacactgttaacacatttaactggaaccaggtgaagtgacatgtatatttttactatttaaatacgtttaattaaaagctgttctttgtgaaacaagaaaatcaaatcataaggcaataactaaacaatgggaacaccttttactttttaaaaaaatgtcttccttacagaaaaaaaaaacctgtaaatagtaatccacatcctcaaaactaaagatgtgtaaaatttttattttccacacactgataacagattttcagtgtaaagtgaggaaggaagctctgtggagacaagctggttggtggaggcatgcaagagtggtgctcaaatccaaggaactaaaattgcttatttgccggtcatcgttctttgacaagaaaattgtatacaagcccctttccactcaccactattcacttttagtaaaaaacagctgactttgccaaatgagtcactttctcactgtcagaacagacttaaacagcagtgccaacagttgtaaatcatcaagacaagcaaagcacatttgaaaaacatacaaacaactgaactttttgtggcagacattataacagcaatttatggaaatgtgttgatttatggaaatgtgtttgtattttatatttagtcttacaccagtttgttatcattgattgaaatactgaatgtagaagctttagaatctaaaagggttttctaacgaaaattacaaacatatcaaaggaaaagcacaaatacaatgttctccagaaatagtgtcgcagaaataaagacagaatatggaaggagacaggattgctgactaatctcatatgtacagggagaacgacactccatgcagcttagctccaacatgtgagcgtgggacagaaaagcaaggtgaacctaaagacatcccatggacacactgagctggaaccaactctgcccataggtggtggggccaggttcagatgcttgcagtaaccgcatcctcctgtgaatctgggtctacatggctgtggctccctgggggctacccacactgtggattccacaggtggaggtgaccttcttgggcactgctgggacacttcctgggcctgcctgggcagtggtagggctcagagaacttcagcgttagggccttggggagtctatgtcagacttgaggaccaagcctgggctcacaaatgacaactaggctactatttttacaaagtattttaaatggggaaaaagccattattttttggttgtgggttttacactgtcaggtaaacaaaaatgtacaagtagagaagaaagatgaatgcttctgaaatttaaatttgacacattaaaatgttaataaaggagtatttaatttataaatctttctattctgcatgtgtcaactacatttcatagcaatcaactacatgtcatagcaaacatgttctctttttataaccttcaagacaaacatcacctactctgacttaaaaacaagggaacctgtccaacaacttgattaaaaaatgtcaaacaacttcaacagacacttctccaaagaagagacacagcagccaacaagcccatgaaaagatgctccacatcacgaattgttaggtaaatgcaaattaacactacaatgagatactacctcacgctcattatgaggctactggcaaattaaaaaaaaaaaaagaaagtttaacaagtattgacatggatgtggggaaactggatccttcgtgcaatgttggtggaaatggaggatggtatagctactataggaaacagtatggaggttcttcaaaaaattaaacacagaattaccatatgatccagcaattccacttctgggtatatattcaaaagaactgaaagcagagaatgaaagatacttgtatacccacattcatagcagtattacttgcaacagataaacatggaagcaacccacatgtccatcagtggatgaatagataagcaaaatgtggtgtacactatacacaatatggaatattattcagtctgaaaaaggaaatgctgacacatgctacaatagggctgaaacttgaggacgttacgctgagataagacagtcacaaaaggacacatactgtctgatttgacttatgtgaggtactcagaaaagtcaaatcatacagacagaaaacagaaagccagttaccaggtctgggggtgctggagaatgaaaagttagcgtttaatggggacagagtttcagtgtgggaagatgtaaaagttctagagaaggatggtggtaatggttgcacaataatgtgaatgtacttaacaccactgaactgtacatttaaaaatggttaggaaggcaattttatgttatgtgtattttgctgcaattaaagataaacagtgtgcaagagaggagaggaagtagcagcttgtcttgttcatgctgtctgaggtgcatgtcggagggatggggtgggggcgggaagtgttaaaaacaaagaatagaacgttatacaacacaagcggaaaacacagggcacaaacgcacttgtataaaacacagagtttccataaacttaaaacatgtctgaatgatggagctaacagcccttaactccccacacccaggctgcaccacagcatatgtcacccccttgcttgcaaatgtgcccaaaaggcaatgacattccaagtttcctctgacaagcccaaggacagggcatgagttttccaagttcctttccattcaagaaaaggaagagaagagaatagagaagaatcaacaaaacaactccaaatagaagtaaacgagagccaagaacggaactatttctcataattaaaccccaatttctataaattacaatcctcattctagtgatgacctataataagatttgcattttcctctgatggtatttcccttaagagatggataacaaggtcttaatcttcatctcccagaccactctagggttctaagcacaggctttacagaaatgtgctgttatgggccatcatcttcaaatcatttccacacaagtctaggaaaataagacaggctaggataagcctccagtttttaaaattgctaatcaagggcatcagttcttaactatattgctgtaagatatgtcacaaaacttttgttaccagtaagaaaaatgaccaacatttgtgaatgatttaatttttaataattattaaagtactacactacacataataaaaaataatacatactcataaactcaacttccctgagttgccagtaggaagcaaccctgccgagcccttgattttggatttctggcctccagaattgtgaggacatacatttctgtggttttaagccaccgagtttgtggttatggaatcccagaaaatgaataaaattatctatcttttcaagctacttcagtttgatattgattatgaaaggtacatatatgctatcaaacagaagagactttagggagaaaaaatctcgcataaatgcaacaagttgccatgactctaagtgccaaggtcatataacatgcagactgtgataatttcaccaaaaccaaaacaaagtggaacaaatcctcagacacagttgctgataattcccaccctggcctcctctgacatttcctttcgatcaatttggctgcacctcttctgtcaagcaggagctggacgacattttggtcagctcctccccagaagggagctacaatctctgctctaacaatccccagttgttgtcttaagtcacactgtgttcatcaatggctacctactaaacttagctttttatctgtacattttccaatcaggtcgtattattttctcctggtaggcaaatgtttacgtttatccattttcctgatataaagctacttcgtatcagtgtgttattagtctctaattataagaagataatccagaagagaaagtccagtcaattttatataagttaaaaaaaagatgtgaaacctattttcagaattaacatttccttcctaaacatctaacacgacacacttacggactcttaacacacccttattacatgaaggagcagcagagcagagggcggcaagagcaccaaggccaggtggagccacagccaatgtgggcccatctcactccgcagggagaagcaactgcactgtgcacagagtgcaatctggcagaagggaaacgccgtcttaaagagcttcagatgcagcaaccttgaggaagggctgtgccagaaagtccaccagatgaggccgcaaacctatcaaagggcatcagacactctgtgcacagggtacacaaaacaatgcctcccacattctgtgacttcctgcgcgtgccacttggaccaccacactccctacctgcaccatcttacctggacagactaaatctcagccacctcatgactaggatattaacatggcttccagttctataaattcctcccccttaagaatgcatgtctgtaaaatcagaaatgatgaaaactggactcgtgagtggctttgtagtagggattacaggtccagaatagaataggttcagtaacatatttaagatatttaagggaaaaaatataagccaaagatttaacatctaaatagtgactatcaagggtaaaagtcacacatattttttatgagtacacacaaacacaggaagtacggtgaccaggagctgagggatgacccactaaagaataagctccggaaaccaaaatgactagaggcagatgcaaaggtgagctgcaggtggtctgtatttatctgtggagctgctggcacatgacggtgataaaagtgcagcatgccatggttaccagcttggacaatgcagacaaagaacaaccaccagagaagtggtaggggcgggcagaagatgtgcaggggccaactgggactggggtgtccatcagctaactgcagtatcaggtactatggggagccaaccaaagaaactaagtgtttgctataaaggcattaggataaaagtggaaaaaaaagaggaagaaagccctcttaaataccaaaagggtaaaagcaaataaaatagaacaaggtggttccctgttatctgtgatgtaaaaaatggacttggctcacctattaaatggaaaacagtcttggattggctcacaaagcaaaatcaaacaccatactgcatataagatatacagctataaaaggctgggaaaatatatagagaatttataggactcagaaaaaaagtaactgtcacaggaaactttatagcattaaatacctatatcaatacaaatttaaataataaaaataaattatttaaacatataactgaaaaagccagaaaaagaataagtgaaccaaaagaaaggggtgaattattacaaataaaagcagatattattaagtagaaaaagaatagaactaagaagtaaatccaaaagctggctctcaagagaaaataatcaaccaaaacaaaccactaggtatctgattagaaaaaaaaaaaaataagaaagttacaagtgctaacagaagaaaatttaaacattgtaaaagataaggaaaagaaagagatagagagaaaaacgtgtagattaaaagagactttaaaaacatatcaaattttaagaataaaacaacactaaactatagtgtctagggatatacacttggtgataaaactataaagattagggaaatgattaccataagagtttgggaagtggttatttttggggagaggaagtaggttataatagaaatgggacatgtggtgggcgcttctgggatgattgataaagttctattccttgacctgggtgtggttacaaggatgtttcctttataaaaatgaagaaaaacattaaaaaatcattacaggcaactttataaaactctttgcagtaagttagaagtagatgaaacattttttaaaaatattaaatttaatgctattccaatacaaaatcaagtttttttcttagagctaaacaagttaattataaaatgcatttaagaacaagaagaaactatcctaaaattcatatggaatgaaaagagagcccaaatagccaaagcaatcctaagcaaaaagaacaaagccagaggcatcacactactcaacttcaaactatactatacagccccagtaaccaaaacagcttctgtactggtacaaaaacagactcatagaccaatgaacagaacagaaaactcagaaataaagccacacacctacaaccatccaatctttgacaaggccagcaaaagcagcagtggaaaaagaccatactattcaatatatggtgttggaataactggctagccacatacagaagactgaagccagacccctacctttcaccatatacaaaaattaactcaaaatatattaaagatttcaatgtaagacctcaaactgtaagatcctggaagataacctaggaaatactcttcttgacgttggccttggcaaagaatttttggctaagttcccaaaaacgattgcaacaaaacaaaattggcaagtagaatttaactaaatgaaagagcttctgcacagcaagagaaacgtttgacagagaatacagacaacctactgaatgagagaaactatttgcaaactatgcatctgacaaaggcctaatatccagaatctacagggaacttatgcaaaaaacgttcactttctgtctgtgttcacgtcaccaagagaatagaaaggaaaagggaagaatgcaaaagtcaaagacacgtcaccctccttgagacagccctccagtccaggccaaatctcagcctgcccttggtccgctgtggttgggcctgcacccaagccatgagcacacgcagcaattgtggcagcagaagcttcctctgggctcagactcaggctgatgctgcgtcaggacctgccgcggtctcggctgggcttcctgggactcggtggttgtgggctgattgtaaagcacggaatgactcttagaaactgggcgtcattctttgtggttttccaagcttggtctctgatgatactccaggtcttaggagacatgctgaatatttattatgcttacattcaagcaacattaacccttaaggttgatgtagctccccgtctttttttcccagaaggaggagcactgaaggaacacttttccagtatggattctttccagctccgagaagctggaggcacacggatccctcggccagctctcatctatggacgtgctgtagtcacaaggactgtgactaaggctcagtccctgaggactgccttggcatgggctgctttaggctgtaaacacccagttttatccactttatgtgaagaaagccaacaaggggcatggagtgagttccgcaggttttagcggctgcggcggctggtgctcagtggggatgatggcgggaaggcgcctccctctgtgggccccgaggtctgtgcgggaatcagctctgcagctgtgtccaggggcagccgtagaccacacacggcaggctcacagctctgttccatgagaactttatacacaaaagcagacgggctgggcttggcctctggatcataatctgctgacccctgggtaagaaattttaaatatttacttatttctgttcaacagaaggggtgatatactgaggagtgaataatgggaaagatctgattcggctgtatcaggaaggactggtgtaaattcaacttattaactgaattcacagtattcgtgttttatgcctttaggggttaaaaatgggtcacacacgagcagcatgcacttcactggcgtggcagggcacctcagtgtttacatgtgtggttcccatgcttaccagggctggaggcccctgtgagtagtgaagtgcatgtggagttctggatacttttcctggctttctctatttgtgtgagcttgtgcagttagaggtttgggctgaatttgggtagaaatgggtggctcacaggctgcaaaagttctgtggacactttttcccccagctgattaatgttgtaaatattagaatattgttacataaaagtctggatttttagtttctttcacattggaatagctgccaacattgggcctgcattcatctctctagggcaacgtcggctgcagctgagatggctgctccccggtggggtgtgtgctcggcctgcagtccccgccctccggactccattcgcctccactctcaggtttgcacctcgtcattgtcttctaattttgcatccctggactgcgtgacctacaaggctctcagcacaacaagactctatgattctgtctattggaacaaaaagccagtgaggcaagtgtatcatcctgttgatgaattcacagcattaactctgggagttggggacagtgtgtattcttcctccagacactctctgtttctcctggatggaaaggttctgctacttgtcccgtggtcaggcccagccaatggaacggaatggaagtgactctgccccttattggcagaaactttaaaagccgcacaacgttcctgcaccctcccctctgccatgagcctggcagtgctcaggatgggaaaattatctcacctgggcctgaggatacaggagctacccccagcctgcagtggaagagaagcatggacaagtgattaaactttgtgttttcaagccacagaggttttttgaagttgtttgctaccatgctttgtccctacaaacacagtcatggagaaggccagtggcagagcctgagccgttcgcgcatctgttcaccagtatccagaataacaatagatttttgaaacattcctgagaaaattctgggagttgcataccggccagtcttattctctaaagttgttccttctaaagggtgtgatgaccgaaaatttcagaaaagcaaaccaccgctgaaaggcaacgttatttctgttggcagaaggcggcctgagcaatctagattttccacggttcaccaactagtttttaaggaaatatggctgtgagaggaataaaacatgattcctacctttaaggaactcagagaagtgaattaaaggaagtcacagatcagacaaccaaccacacaaagtttctaagagcaaactgttcaggtcggcaagtcactcttatccactgttttgccttctaaggtttcagttactctcagtcagtcatggtccaaaaacattaaatgaaaaattccagaaataaacaatacacacgtgttaaatcatgtttcattctgagtagcttgatgaagtctcatgccgtcccactcagccccacctggggtgtgacacctccctctgtcgagcagatccaccctgtctatactacctgcttttccaggagatccaccctgtctagactacctgcgtggccagcagatccaccctatctacactacctgcttttccagcagatccaccctgtctacactacctgcctgtccagcagatcaacactgtctacactacctgcttttccagcagatccacactgtctacactacctgcttttccagcagatccaccccgtctacactacctgcctggccagcatatccaccctgtctacactacctgcttttccagtagatctgccctatctacaatacctgcttgtccagcagaaccaccctgtctatactacctgcctgtccagcagaaccaccctgtctatactacctgcctgtccagcagatccaccctgtctacactacctgcctggccagcagatccgccctgtctatactacctgccgctccagcagatccaccctgtctacactacctgcctgtccagcagacccgccctgtctacactacctgcctggtcagtatatccaccctatctacactacctgcctggccagcatatccgccctgtctacactacctcccagcccagcagatccgccctgtctacactacctgcctggccagtagatccacgctatctacactacctgcctggccagcagatccaccctgtcaacactacctgcttgtccagcaggtccacactgtctacactacctgcctgtccagcaggtgcaccctatctacactacctgactgtccagcagatccaccctgtctacactacctgcctgtccaaaagatccaccctgtctatattacctgcctatacagcagaactaccctgtctacactaccagcctccccagcagatccaccctgtctatactacctgcctggccagtagatgcatcctgtcttcactacctgcttgtccagcaggtccaccatgtctacactgcctgcctggccagcagatccaccctgtctacactacctgcttgtccagcaggtccaccctgtctacactacctgcctgcaaagcagatccaccctgtctacactacctggctggccagtagatccacgctatctacactaccttcctgtccagcagatccaacctgtctatactacctgcctgtcgagcagatccaccctgtctatactacctgcctgtccagcaggtccaccctgtctacactacctgcgtgcccagctgatccgccctgtctacactacctgcttgtcgagcagatctgccctgtctacactacctgcctgtccagcagatccaccctgtctatactccgtacctggccagcagatccacgctatctacactacctgcctgtccagcagatccacactgtctacactacttgcctgtccagcagatccactctgtctacactaactgcctgcccagcagatccaccctgtctatactacttgcctggccagtagatccacgctatctacattcccttcctgtccagcagagccaccctgtctatactacctgcctttcgagccaatccaccctgtctatactacctgcctatccagcaggtccacgctgtctacactacctgcttgcccagaagatccacactgtctacactacctgcctggccagtagatccacggtatctacactacctccctggccagcagattcacccagtctacactaactgcttgtccagcaggtccaccctgtctacactacgtgcctgccagcagatccaagctgtctacactacctgcctggccagtagatccatgctatctccactacctgcctatccaactgatccaccctctctttactaccttcctgtccggcagattgaccctctctactctacctgcctggccagcagatccacgctatctacactacctgacttaccagatccaccctgtctacactacatgcttgtccagcaggtccaccctgtctacactacctgcctctccagaagatccaccctgtctatactacctgcctatccagcatatctaccctgtctacactacctacctgcccagcagatccaccctgtcttcactacctacctagcgagcagatccaccctgtctactctacctgcttgtccagcaggtccaccctgtctacactacctgcctgtccagcaaatccactctgtctacactacctggctgtccagcagatccaccctgtctacactacctgcctatccagcagatccaccctgtctatactacctgcctgtctagcagatccaccctgtctatactacctgcccatccagcaggtccaccctgtctacactacctccctgccgagtagatccaccctgtctacactacctgcctggccagaagatccaccctgtctacactaccttccttgccagtaatgcacgctatctacactacctgcctggctagcagatccacgctgtctatactacctccctgtccagtagacccaccctgtctatactacctccctggccagcagatccaccctgtctatactacctgcctggccagcagatccaccctgtctatactacctgactggccagcagatccaccctgtctacactacctgcctgcccagaagatgcgccatgtctacactacctgcttgtccagcagatccaccctgtctacactagctgcctgtccagcatgtccaccctatctacactacctgcctgtccagcagatccaccctgtctatactacctgcctatccagcagatctaccctgtctacactacctgcctgctcagcagatccaccctgtctatactaactgcctggccagcagatccacgctatctacactacctgcctggcgagcagatccaccctgtctacactacctgcttgcccagcaggtccaccctatctacactacctgcctgcccagcagatccgccctgtctgtactacctgcctggccagcagatccaccctgtctacactacctgcctgcccagcagatccaccctgtccatactacctgcctggccagtagattcacgctatctactctacctgtatggccagcagatccactctgtctatactacctgcctgtcaagcaggtccaccctgtctacactacctacctggccagtagatccacactatctacactacctgcctgtccagcagatccaccctgtctatactacctaactgtcgagcagatgcaccctgtctatactacctgcctatcctgcaggtccaccttgtctacactacctgcctgcccagcagatccaccctgtctacactacctgcctgtccagcagacccgccctttctatactacctgcctggccagcacatccgccctgtctatactaccggcctgtccagcagatccactctgtctatactacctgcctgtccagcagatccatcctgtctacactacctgcctacccaacagatccaccctgtctacactacctgcctggccagtagatccatgctatctacactacctgcctggccggcagatccactctgtctacactgcctgcttgtccagcaggtccaccctgtctacactacctgcctgcccagcagatccaccctgtctacactacctgcctggccagtagatccacgctatctatactacctggctggccagcagatccaccctgtctatactacctgcctgtccagcagatccaccctgtctctaatacctgcctgtccagcaacattagtccttaaaaaaagcaaacacacaaaatcagtgtctatttacaacagccaaatattatgactacgatttgaaataaatttgtagacccatgtaaataaattttaaaactcaatgaggatataaaaatgacatgaataaagcctgaaaatcatattattagaatggaggacatagtgacataaaacctcagtgactgtagactcagggcaacctagacttaaaagtcccatgtggtcttttacatgtaaaaaatgagaattagtctaaaagtcaattttgtctaaattttgatttttggtgagtatacagtcaaaatagttgtgaaaagaaaaaaataaagttgtcaaatttcatgtaacctatgttatttggaaatttaaaataagttatataaatatttataacaatgttaaacaatttcataagtggactgaataaaacataatattttatcatatacaatagctcctgccttcctgaggaaaacataaaatcaaagggcgtgaaggaaggattttggtttcactgcagaaacataataagacaccgaagtgtgtgtttgtgtgtgcgtacatatatttaaactacagaatataaaatagcatctaatatacatcaaaaatgagtttcatagaaaaattcattttacatatatgtctataaaataataaaatttattcagcctcacaattactttgtgaactggaaataacaatgagttgtcattttatccaaatctaaaaaaaaacatacatacagtatcaagttctggttaaagtagtagatgtactttacgtggtacataagagtatctatacagtttgtgggctgcatcttgctagaatatattacattataaaatgcaccatttatttactctgcgatcaaacccccaacttgccccaagtggaggaaccctcagacatttgcagaggagtcagtgtgctagtaagcagcattctttacaaatctatgaacatcaaggtctccttggaacagatgctctgtgaacaatttataaaactccctcctgttagacacttaggttgattccatttttaaatcaattactgaataaaacacactccatcgtgtggatgaaatgctaccttaatttgtcaaagctatcattttctaaacttttctttttaattcaaatcattaataatttgtgaccagatcaatactgattcattgttttaagcttcaaatgcattatacagttgggcagaacacatttcctctcatcaatcttcttttccaggatttgtcaggtattcctgacattaattcactactaatatgcacagtttctctaatcatggtcaacaaagatctgacagtgcattgtccctaaacgatccatacttgcctcactgacaccatgtggcccacttcccatctataatctatgtctgggtgtgaagcccttcccatatgatcccccgaatggaacttcacaagttcgaattcactgggtcacagtgtgatagtgtgaagatgggaggacgttaagggaaggctatgggtgagttgggaaatgtgttaggcagggtcagagattaccacatcctaaaaacaacacttaaggagggagatgacaaaacaatcaatgaataacatgactttttccagtgaaagtgccatatctaatccttttccatttttgttctctgagcttctttcttagggaagatccttcttgagaagcccctgctgagtattaggaaaatgcatttcaggacctctcatcaacacatcctctttctttaccacaaccacatatatgggggcataactcaacatgtgtaaaagacaatcttctgcttttcactgaacctccaggaattcaggacaataaacgtctacatggagaccaacaggtgagtttttctgccccttctttcataacaccgttcttccctagtgaagtccacacacatccttacatggcagctgtgggtatatcaactggtctgaccccttttagtcacagagcctgaagtctctgctagtacctgctgagcacagggtcatgggtgagaatgggcaagtctttttctttctctggttcctgaacttcccaggctctctcacttctggatcctgaatacccaaaaaccaagcttccttcccagaaccaacacctcctcctcattagaaagatacctttgttctgtgcttactttataaagtcttgctctttccctatccactgccttgtgtcagtatgtgtgtgtcttggggccggtggaaaggtgaacagaagccagtagagagtaaccagcaccagcttcacaggaatggcatgaccttgatacgatagcggcagttttcccttaacatccctgccccctaaagacttcagatcatatgtcacactcttaagtaacagcgatttgtctttcacggttttaatcatattgattaaaagcatttgtcttctccagaacatcacattaagtcatcaaaaaatataaaccttaaaaagatgtaattattggaactgaaaaacataaaaggtgagctttggaaatatctttgagcaatttattcgttatgaacacatgtaatctgttggaacaaagttctaggacaatccaggtcatccttcaatatttgcagaaaacatcacaaagaaaacttgatacttatacttagttggaaactttatgccacagccattaaatacagagatcatacaaaggaatagaggaagctgttgaatactaaactaactcaaatcatcaatatccttacggagtgcacactgaattaatgtaaaaagcatttagtaaacaaaaagtattttcaatatacaattaagactgaaaagtattgaggcctcataagctgaacctgacacaataaatttaaaagggaaactaatttggaaatcagaaaaccactaaggaatttgggaattaggcttctgctgccctctctgctactgacggtcaaggcctcctcattgtattctgtcctccatatctctgctgattcccattttgtctatttccatttaccccactactgcttgctcaggtcactctccttcactgtcggtgtttgttcaaattcctcagacccatccacttcccatctaaacttccctccccttttctcgctcgttggctctacctccctcctctctgttttctcctcactctcctgccccacctcgacatccacagcgaggcaatgaagaagcccctgccaaggaggagcccgcttctcagtgggacaccgggaaggtagacacccaacagtcaccgctagtgggaggcgattgtgcagaagcacgagggttgttacaggatcgggcaggtcccctaccccagtctcggactcagggtcctgtctgaggcggccaccccgaagcgtggggtttgcggagacgtagggcctggcggagggaaggacggggaagcatctcagggaggactggcgtctgccgaatcccagggctgccctgaggggccaagaggggcgagggtggggacgatggaagacaagccacatgccgaatggggacctgaggccgcgcgcgataggatgggcggacggtgaagagaactagggtggaagggccggacaggggcgacctcagtgacggaaccggacacagacgcagatctggcagctgagcgacaggcttcggagcatttccgggcgtcgcgggactccccgccgacaggagggcggttgccgagcctgtgacatccgcggagaccagcagaccccgggtgtggaggacgccgcagggaggggactgcgtggctgggtttggccacaaaaagcggagggcactcacccgagcggaccttggctccggataatccgtttccgggtcaacaaaaaacgtcgcgcgaggggcggggcgcgtacgtgcagggaggggaggcagagaaaaaggcggggccgggccgggccggggcggggtctcgggcaggggcggggagcttaccgacctcccgcccccgctgcgcgcgtttctggccctgccagtgtctccgccggttgaaagcgcgtgtctgcgtcgggttctgttggagtgcgttcggtgcgccgtgggtccgcgctgcttccacccaacttcctgttaggtaagaggcgcgtgaggctcctgtgccgggggcggtgctgctcccgagtcggcgcgcggcggggacgcgagtccgtaggtgctggcgggagcgagagtcgggtggggaccctcgcgagcccgcactccgcctctgggtagcagcctcttcggccccacacggcgtgacgcgcgctcgggctccgcgttcgcgtcgaggcagaggcgtagtaggggtcgggcccagggctggaggggccgggaccgggcggggtgccgccctggacaccgcgccggcagctgttccgcgcgggttcatgtcattcctattttcaacctgtcctgctccgcacctgagatgatttataaattcggtacctttgggacaggcgtggatgacatcccataatttacttcgttattaatttctaaatgtaatacataccactctctaaaagtattttttaatttgaaatatatttgtatatatgtacatatatatttatttatttctgaattttgtctccagtacatataatgaggcttgtaaagtggatagtgttcaggacataggtggattttgcttttaagtagtaaagacttaattggtgacttactggggctatttgataaggatttttttttttaaatgaacattaaaaacagtgaaattgtatttccggatttcattagcttcatttatatcttaattggtgaaaactgtaagttaataactcatttttatttcctttggagattcttaagtttgtgctaccaatgattatttccaaaaaaaggcacacttctggttttcccagaactaatgctagcttctcaatcttttgagtttacttgatattaatgtttgacctcaaatcatgtcacatttttgaagaaaactttctcttagccagtggaacataaaccaccctggagttcatatagaggaggggttcaaatgcctctgatagtgtcgtgttaaaactcatggccaaacccaaggtcacatagctttctttccatgttttcctctagaatttgtatagttttgtcattataaaatgggtcttgtcctagaccccaagaacaggtttttggatttcacatgggaaagaccttttggcaagtcacagagtatagtgaagttaagatagtttattagcaactactcagctacatagcagggcgtcctcagaaagcaagaggaggaatgcacctgttgtaaacatataatttttttttgaaacagtttctctcctgtcacaatggcatgatctcggctcactgcgacctctgcttcctgggttcaaggattctcctgcctcagcctcccaagtagctgggattacaggtgcgtgccaatatacccggctaattttttgtatttttggtagagactgggcttcaccatgttggtcaggctggtctggaactcctggcctcaagtgatctgcctgcctcggcttcccaaagtgctgggataacaggcatgagccacccggcgcccgggcttaatgtttgtttatataggttattaagaatcagtttgtgacaggctattagtattgttacttctctttgttactgtcgattttaacatcaatttatgtgtgtactattacctttaaagtaaaacttatttttaaactaagaatgctgagtggtgtgctgtgtgggtgtactgtgctggtgttctatgcaggtgtattatgcatgtgtgctgtgaaagtgtattgtgggggtatattatgtaggtgtgccatgcaggtgtattgtacaggtgtgctgtataggggtggtatgcaggtatattgtgcaggtgtgctgtgtaggtgtattatatgggcatgcagtacaggtgtgcagcatctgagctccgtcttcaccttaatcccgaacactcttttcacctctcacctgcactgcagtgctgtttcctggatcacacttttttgtttgtttgtttaattcctccaggagaatgagtgtataggaaataaggatttctcttcacattttacttgactaacagtttctctggttatagaatatattttggatttaaagctctctctgaattttgaaaacactgtttcattttccgcttgcctcctatgttgttctagagaagctcaatcgcaatctcgtcccccatcctcaagcgatacacttcttttttctttattatcttgaagcattcagggtcttttcttcatttttggctttctgaaattgcaggacaatatgatgtaggttcgtttttatctctgtgctagctcttttcatttggaaacctgtgttgcgttctgaatgctgtggtctgaaagtgtaccttcaaattcatatgttcacacttaatggccaaggtgatagtattgagaggtggggcctgaaggacgtggctaagtcacaagggcagagccttcacagtgggatcagtgcccttaaggaagggctgagggcctgggtttgcctttttaccttttcacctcctgccgcgtgagggcccagccacaaggtaccatctgggaagcagagtcccaacccttgccagacactgagcccactggtgctttatcttggactcccagcctccagaactgtgagagataaatttctgttttttataaagtactcagtctcctgtattttgttggagcagtacaaatggagtaaaacactaagacattttctggaattctttgattgataattttttcttctcagtcttttatcttgtctcttccttgaacacattatttctggtgttgaacattccagaccacttctccaattttcttatacttttttctcctatttttcaccttttagatctctttttgttgttgatttactttctgtgaggtttaccaactttatctagtacaagttttatggaatttaaaaattgtttcagagtttaagttcccagatcctctttttttaactgttcatttttcatgacttccagttctttagtggtgacgtatcttttctctctgaagacagtatttacagttactggaattccttcctgctctccacctgtctttggtctgttttccttttcccgttttgatctctgtccttcatggtgcatcctcctgttgactcctgaccatctgttcacatggggctgctgtggggtgaccgggccacgcagtctcccttggcagctctcagctgtctgtatccgtcagcattttctcttggtctggtcaggttttcccagaggggacagtccgttctccagcctgggacagaggtcagggacacatgtgctccctccctgggttggctctttatatggtgagtggcaactggttttggacctctctcttgcaggctgggtctgtgggatgtaattagaaagcaactttatttctattcacttacatttattcattggaggaggagtttctctttcctagggtacacgtggacatgcctatgacttttctgctttgtcttatgtttaaaaatgtccttcagtcattgcaggtcacaagcaggctatcagctcagtaattaaaataattcggttcttcatagtgaatgtaattctaaattagattttaagttgtaactccctgcttcagcaatggtgatggggcctagaaaccagagcacctgagctccatcctacagggggccataccgggatctttccattttcagaggcttctctctgacagtgaagtgtgatgacagacttgggggcagggcaatggctagcttctgaaagccgctggcactttagtgataaatttaaattaagtgacgggtagtgaggtgtttgtcaaggaaagtgccgtccaaatgctaaatactgattatttctgcagcagtgactgcaatacctcactcaatctctgtctttcttgaagaagtcataaataaacacgatgaatctatgtagaagcggtaagtcagaaaaatctgtgtgtttcattacataaacaacggtttatcattaattgacaggcttggattgggagttgttaatgaaactgatgagatgttggacagatgagctccctcttatttcgaagagcttatctagggctgagtcatgggacctgatagcgtcttgtggtgctgtcttcttgtagatatatccgtgttttagaggatttagttttttaaaatttctcttagaatgtgaattttacaaaaaagcacttcccaaatggatgattatttgaaaaatgaattgtcagacaaaactgacacatcagttatggagaaaacccttcaagaactggctttaaatgtgttttagtgggagccacagtgtggagagaaacagaagagggaggagagggcgccccttgtttcttctctccacagccaggccttcgccacctttctcagtgtcttcaagaataaaatgcctccgttgttggttttagctgcttttctccctcggggtaggtaaagtggttccaaaacgacaagcatcctgtaaagtcggaagagctgtgtcaacattaagctgcgtgactttggctatgagggaaaaaaggctggtgagtgcagagaagacagagctgtggcagggctcctcccgccaagtcgccatggagaggggctgtgaggtgtccttaaacggcctggtctccagggtgactcaggaagggctgagagtggtcagctccctcacctgctaaacccgcagcgccccgctcagcacacaccctccactctccaaccttgcccaagtgctggtccgtcacggcaccaggacagggcatggagacttgggctgattcttttctctcccttcctccctcttttttttcttctctcactcctccttttcctttcctgctgtttcctgctctcctgtttctgtcctgcagtgtctggagctccagagaggctggccctggggtggggtccacatggacatgggcgtaagcaggtttgatggtcatgggcataggcaggttcgatggccagagttctttcagctcacagtaagttttgttttgttttgttttgttttgttttgttttgttttgttttagatggagtcttgctttgtcgcccaggctgtagtgcagtggcgtgatcttggctcactgcagcctccaccttagagcaatcctcttgcctcatcctcccgggtagttgggactacatgtgcatgccacatgcctggctaatttttgtatttttagtagagacacggtttcaccatgttggccaggctggtgtccaactcctgacctcaggtgatccatccgcctcagcctcccaaagtgccgggattacaggtatgagccactgcacctggcctcagctgacagtaggttttagagccagatatttacacactaacttgccagaaacatatatgactttattattctaattgattttaagagatattatgaactcaaatccaaagttacgtcccacctatcatgacaatttcattaaggaaaaagtcaaaccattttggaaatgatttaagtgagcaacttggaaaaattttctacattcctaacttactttccaggggatcgttcctgacttaacatctatcaggtgtcttagcttagctctctttttacttcaggtttttcttgcctcctcagtgtgctgggagtcccactccactcaaatgccctcaggtctaataattaacttcattgcaggctcctggcaggcctgggtgggcggcagctgcattgtgctcctgaagaagatttaagttgggtttggtgaactggtagaatttgcattttgctgtttctttccctctcccagaatttgtacctttaaataggttttttagtgtcattaagtatatcaaaaggaaacccagtggggcaaattggccgggctccatagaggtggccttgtctaagcctttcatcttatcgataaggaaagacaggaccagagaagtcgccgactgtccctggtcccactgcttggtttggggcaatttcctgaaaataatatccaagatgcaaagcatatggctctggtgagacatgtgtgaggagctgagaatgagacggctgagtgtcgggggcagatcacgaagggctgcgctcaccatcaggaggtctggacttcgctgtgaaagacacaggccctcatgtacgtccaggatgcggtgacagcgaggcttgcaggagacaggtccctgctgtgtgggggtgaagctggaggcaagatgatgcctggagctaagagatggtcacaggaaatccggcaagaattaacgaggactggacagtgacaggcaggccaaagagtgagaggaacttcactggcaagagccaacagggcttgttgatttaggagaggagacaaaggactgaggggtttgggggctggggcctgggagggtggagaagccactgtctgcattatgggatgcaggaggagaagcattcagttctccacacaatgagttccctgagaggtgtctcagtgggatcgtggtgcagttggaaatgttcatgagaaagatgagaagcggcaccagcagcaaacatccaggaacccagaaaccatcagcacaggtgcctgctgagtcccatagacccactaatggcccaccaggaccaaccaggaagcaagtgtggagctgggagtgagggagctgggtgtggagatcagggggaagactgtcatctaaagggcgagagtgggaaggatggagtcatctgtagctacagggaaccaccattagtcagtccttgtgatgaaggtgcaagatgttcctgcttccgcgcacgtcgctcctgggctgtgggcaagtttggaactgctgttgttccccagcatagtctcaagcgagtggaatgacggtttcctatagaagcacagttcctacaggaaagaaggcgtggttaagagcatgagggccaaggaaaaggaggggattagagatagccagcagtgagggagacggttccagacacgagccgagtgggcaaagcagggaattcaagagagagaggagcatatattacgcaaattttaaattttttggtagcaagcaacctagcaaaactagctgaatccaaaggggatttattggctcacatcataaaaatctagtgaaagattctagctgaagtcataactagatatacgagtttaaataattttgtcagaaactgtttctttgctgctcatccacctatccatccacccatctatccaaccctccctccctccatccacccatccacccacctacccactcacccgtgtctttatccattgatccacgtgcacatccatcctttcatctctactttcctccatccctctcccttgcctccctccccatccatctgcccatccctccatccacctcttcatctctcctttcctccctcccccatccctccaccccctgttcacccacccattcatccatccctgcatctttccgtccacttctctatcttcttgtctctgcttctctttgtattttgttctcactattctctatttcataaggcttcctgaaagcggcatccatttattccttgtagcaagatccctagagaaagactcataatttatctctcagtgttcataaactctcagggcaagttttatttggcctgacttggatcacctgccaatatctgaacggattgcacacccaggtaatggagtattttaatcactgcagaccccccaccctcacctgaccagtgccccacagcaggaccacgagcagggccaaggtgtctccaaggtgctgaggagctgagcgctcagccagcccacggccacgatggtgtgcctccgaagccacgcggcttacttcacagccaggatccgggatcaggctatgtcccatgcagcctgatgaagggtaaaaaagagcccaatgcagagtgctggggaagcatagagagagccggggcacctgacccagcctgggacggtcaagggtgactgccgtgcaggagttggcatctgagctgttccttaattagaaagcctggcacagaatgaagaatgcattcctcaaactgagtcagggtgcagggatccacatgaccgtgctcctcttatccttaggaagggacaagagacttctatcctttggcctgcagctgctgaaatgacccttgcaagtactgaatcatctttaatgaaaaaatacactaatatgctgcaaatttggagcttatcctttcagtccaatccatggggaaggtgtgaattaaagaccctgtgcgtgtgctggaggcatcgtggacttttgttcacgatttcctttccttttgatgcttcagttatggtggttgcagctctataagctgtgtgatatgggcaattcctctcaccttttgaccactatttttcttactaatgaaatgaatacatacaagaatacttgaagtttaaataatgaaacatctgatactcacaggcactacagtattggctgaattcttaagtgactataggacacctttaagcatgttctagggcaggataaccaaggacaccatctcacgtgccaggaaatgaggggcctgtgtccaataagtccctggctccatgtggctctgctgttgcccacttctcttggaccctggttgtggtcttcccttgccacggggcctttgctggtgatactccctctgcctggagtacctccataatgtccactgctggggccttgcccatattctctacatgtggcactgcagtgcccccccagccagctcccaggggccagtgcccccagttccttgtccaaggtctttgtcccgcagctaaaacccaatctgctgccaccggctccatccacaggcaaaagttcccgggaataaatgcgtcagggcacagccctcaggagaccttggttacggacatctatccatctcctcgccctctggggtgaatacatctcaggtgcactcttttgggtgtttctttttgcttttgttgtttgcattggctcccagagtctgacagtggcagaaggctccagctgcccacagtggtgactggttttaagcgtaccctttgttggccatcttcctctctcttggaaataaacagcctgcactccaatccttgtcacagggtcagctcctgagggatcttcttggccttgctaatgctggcttatccttcagaatttagcttccattttcacttcttcatgggagtcttcttgagtatagtctcctcgtcatgtctgccgcttcttcctgagtcagggaatatctcttaggccatatctattatagtcgtggtctgacttatatttgtggtcaatttttttttcttaatttttcgtagagacggggtctcactatgttgcccaggctggtctcaaactctaagtgatcctcctgcctcagcctcccaaactgctgggattacaggcttgagccaccaagcctggcctatgtttgtggtctctttgactaaaaatgatcttttcttctaacctgaaatctcctgagggatggaactttgtgtctctttggtttatcccagcatataaatagttacgcatttttgaattaacaaatgagcacaaatttgtatcaaattattatctaggacaagcagtggaaaaaaattctgtaaagggccgggtaactgttttaagctttaagggccatgcagtttctgttgcagttaccaactctgctgttgaagggtgaagacgtgggtaggtaatatataaaggaatgagcatgtctggatgttccaataaaattttattttcaaaaataagcagcagaggagagcttctggaatggtggtgtgaggagcttggcaggccctctatccagggaaataaccatttaacctccgaacattcatttttttaaaactagaaattatcctaaaggcatacagcaggtggataaatatttactcaaataaataatcaaatctcagtaagaacggtaaggatcagtggtatcagagccacaatccaccgctccccaccctcaaagcgcattgtgatgaaagctctgctccaggaaggtccagctaacaagatgctgtggtctgtcttcccggctcctggtctagggctgtggtttcaccccaggaaggcaggccaccagcatctctcatccctctcagtttgcactgcagaagcaccgttccaggaagttgcaactgagaggactagggctcccctgcttcagcctgtgcttgtcctcagagggtgggagccccatcccaggtgtggcagactgagcacatctgcctggattgccccacaccaagtcactcacagtgtggaggttccatgtctggaggggcaagctaggaagacaagaggctaccatgcccacccagctactggctcatgcagcaagggtgtcgctctggtggaactggatcacggtccccaggagcagaggagacctaagagcagagcatgtccctgaggtgacagactttacttggagaacagcatgcggaagttcaagcccaaggaagttggcaaaaatagtggagattttgttgatgaacaattaagagtgggtgaaatggtagactagatagaacttaaacagagggaacaaggaagagagattgttgagaagagctccggggtctgagcagacttgaaaagctggcaacactctgcccctgcaaaagagcctgatgttcactggatgagtctatggagcaatttgtgccccaggcatcataaaaaatgatagagcacttgcatttagtggatgttaacagctgtgtgtgacaccaaagagagacagaccagcagaagcttaacagagagcccagagaaaaccacagataccacaggtggtcggagagactgtgtgctagtccaaggctgtgccctctgaggagcaatatcagagctacgtccctaatcaaataaacaagcaatcaaacagaaatagcagcccctgcgggtcggggtcagaatccagatttgctatgatatattacctaaaatgccagtttccacaaaaatgcaagaaaacaggaaagtgagacccatgctcaggaaaacagaaggcaacagaaactatgacaaattccagacatcggattaacagacaaagacagccagtgtcaaaacagccacagaaacatattcaagttactaaaggagaccatgttaaaagaattaaaagaaattatgatgacagtgtcccatctaataaggaatatcaataaagaaataaaaattattttaaaaaacaaaaaattgtggagttgaaaagaacaataactgaaatgaaaagttcactcaggggcccagcagtaaattggaacagtcagaagaaagaaccagcagacttgaagttatgtcaatagagattatacaacctgaaaaacagagagggaaaaataattaagaaaaatgaatagaagcttgggacatccttaatgagagtaccagaggagatgtgagagagaaagaagcagaaaaaaagttccaagcagaaaaaatgtccaagaaataatagctgaaaagctcccaaatttgctgaaaaatgttaacctacacattcaagaagcccaaaaagctctacacaaagagacacacctagacacacacacctggacacacacacctggacacaaacacctagacacaaacacctggacacacacacctagacgcacacacctggacgcacacacctggacaaacacacctggacacacacacctagacacacacacctagacacacactcctggacacacacacctagacacacacacctggacaaacacacctggacacacacacctagacacacacacctggacacacacacgtagacacacacacctagagacacacacctggacacacacacctagacacacacacctggacacacacacctggacgcacacacctggacacacatacctagacacaccagaatcaaaatgttcaagacaaagacaaggagaaaccttgaaaggaacagaataaaatggctcaccacaaagaagggaacccagtaggattaacacttgatctgtctgtaaaaggatggaggccagaaggcagtgggataacatattcaaagtgctcagaggaagaaactattaatccacaatcctatatccagcaaggccatctgtcagacatgaaggtgaaataaatttcaagataagcaaaaacggagagaatttcttgctagctgaactgctttatgagatattaaaggaattcttcaggctgaaaacaagtgaactcatacgattttcaaatccacacaaaaaagcaaagggcagtagtaaaggtaattatgtactttttaaaaaaggtgtaaatgcatatattttctcctgttttcaaaagcaactgcataggacaataagtatggaattgtattattggacgcataacatacagaaatgtaatatacttgacaataacagtacaaaggaggcaaatgggaaaaactgcactggagtaaggaaatggccacatattgtataatcccatttatatgaaatgtccagaataggcaaatccacagaagtagaaagtagattcatagttgcctgggcttgcgatgtgggtgcaagaaagaaggaaatgagtactaatgagcatgtttcccttagggaatgacaaaaatgtgatgatttcacagctctatgaacgtactaaaaaccattgtagtattaaaaaaaaaaaaaaagaacaaaagaaaagaagagtagaattttgggtacataattgtaaaatcaatctttagtggaaagctctgttatccagaaactcaaaattagctacataacttccccagaaatattcatccgcagcaaatattcatcagagacagaatccaaacccaggtctgtgtgaatctaaagtttattttcctccacctgccttaacaacaaattattgaataactcaaggacacaatacctcgaaagagtctgaaacatttctgtgatgaatttacttatgaatcccaatactcttgattctagatgatgtgttttgttcagcatctgtttcagtcatatcaagtaaaaccacttcccccaggtaatatagttttcctttttactttttcccttggcctcagcatttacagccccgtgcagactgttttaacaaacgcgttggtgaggtgtggtagaatcacaggcaaaggcgtgctttgctgtgctgtgtaggtacatatcaaacgctcaccaagaaattataaaatattattcatagcagtttttttcttcagtattttatgggctaagtgcaatctggcttttgataacaacggctgaataatatttgagtttgccagctgaaatgtcctaaatatcttattgattcatttattgcctcttcaaataacaaggcaacaagacagtgtcagaatgctcagtgtttttacttttttgtctatcatgggatggtgtcagtttcagtaaaaacgatgtctcttattttggtccacattgtaggaatctcaccagtgacacgcgtttgtgaaaagctgtgaatattcagtgccacagggttaaacctcggtacagaagcgagaccctgctgggcagagaaagggtgacctggaaggtgtgtgagggccccgcccatgggcccctgtgatggtcatggcctcaagaatcacagtccaggtgaggccctgaatatccacagccaggaccagttccctctgctcttgggtgccaaggccaccgtcagccaggagaggcctgcagaatcagcctgtgcacctctctgacgataagcagagatgctggtttagagacttgctactcacggggaagtccttgggcctcctgtactcacattacctggaacttcttggaaattcagaatctcaggccccaacccagacggactgaatcaaaatcttcattgtggtaagaccctcggtgacacacaggcctgggaagcacaggttagcgtgtcaccttgggcaaagctctcagcattgtgagcctctgttttctactctgtaaaggaggcatgaatatctacaacatcagtttgccatgagtattgaaaaataatgtcttagaagcacagggcagagcctggcatgtagtttgtgctcagtgcacagcagacaagaaaccacatgcaccagacctgggcggccgtcggcagcccaccctgagcaaccatgggtggccctcttgtctctcgggacaagaaatgcttctttagaaatgcttctttcctttctaaaatgaaagttttggacagtatttcctttcatttaaaaatttcatctgtgtatttgatggcctctgttgtttctttcctgaaactcctgctaacatactgggagctgaagaagggctccgtgaaggcgagtaggggtgcctgtccctcccagggaggagcttccctcctctcacctgctgcacgagccctagtgcttcaccaactccagcctcagtgccctgacactgggggagggaaaggaagcgcacgcaccagccgttccacccaccgaagttgtttggtcccaatctgcaaaatcagttaaacgtcttcctgcctggcagcagatcaaagggtgaggggtctgggacagacagagacggctagagaatggatggtgaagtgctcagaggccctgtgggctatcccacactcggcggaagacagcaacaccatcaaatctccaccctttgttatccatgacttaaagaaaagtgaacagggaggtggacaactgtgcaaagactggctggagtcaaatcctgggcataggtgaagcatcgagaatgcttgtcacacgtttgaatgtgcagggggactctgactggaagctcctagcagaggctgaagacactggttaggtcctggtgcgtgccttgggatgcatcccaggcaacgggcccaggagcttgaggtcatgtccacctggctcaccagggagtcctgcaccattcttcaaacctaactggaagagacactgatccttcctcccacctaagggctcccagagccacaggtctccgactctcctgcaacacctcctgctgcctgttcccaccgcccatgattcactcagtcaccatcctcagcagcacccgacagcctctgtgtgtctgtgtcactcaccattaccagccccctgggtgcccaatgcatgtatgttagacagaacaaatgcacggcggccttcagcagcaccgaccgcgtcaacccctctgtgctcacaccaggagtgatcagcgcacacgccctcccacaggatgggagaaggtgataacagctgagctgggtgtccagaagccagccccaccccacagccactactgagaggttatgagatcatggccttatcccgagtaatgctgctgcagtgaactgggacttttttcctctgaattcaaaggtggggcagtctaggcacctggatgcaccatctgctctgtcccggcctggtggctgctcactgtgggatgctgtgcaattagacagttactatctttccctggttgacggattagagtttcccttttctgagcatcttgttttgaagtgatccgaagtgtttagggttaaagagcgtgattttcccaaactgtccaaagaaatagaagcaggtctgcaagaggggggtgcccagagccttgagatggaagcgagatggggtgagacctggggagctctccaggccgccgggaagctgcacgtcatcctctggacctctttgctgactgtgtgctgtcaccacagcagccgccttctctcatctgtaaacaggattttacgtaaatttccatacacttggttgttgacaattaagtagattgtttttaaagatacttgaaatgatatcagaatttcctaaatatatcattaaaacaggaaacttagttacctactcactcgaatcactagagaataccaaataggaataggaagataacacactggtaagaaaaatgtccaaggccaatcacaggagtcaaagctcgtgatcaaatcagctctgcctggggaggccgtgctcatggcaccatttagtgacaagtgggtgactctggggcaagttccaggggtgtcacccccaaggcagcagctcaggtgcagccaccatggaggcagtttcactgaggggccctctgaggcccctactctgagattctaagacagggtttgaagaatgttccagcatttgaacacatgaaccctatgatgtcctgctgtgagagagaacaatgtcccaattttgcccaggtgatttgaacatctcggtatggatctgttatgggttgaattttctcctgcccaaattcttatgttgaagtccttacccctgatgggactagatttgtagacagggcctttaaggaggtgattagcgtagtgaggtcaccaggtgggccctgatgcaatctggcatcctcctaagaggacatgaggacacagacacatacagagggacgatcgtgtgaggacacagaggatggcatctgcacgccaaggagagaggcctcaggaggaaccagccctgcccacaccttgatctgggacttccagcctccagggttgtgagagagaaatgtctgttgtttaagccatgcagtctatggtgctttgttatggcagctccagcaagctaacctgggatctaaaatgatacttaaactggttcagtctgattcttaaactggttcagtggagctaggccaggctccctctgagcagatgttggtccctttgcaggcctgctgtgtgtgatgattgctaaccaggttatgacagtgatctttaagtaagtgggaatcttgtgagttttgaggttttgtttttttttttaatgaaatctacatgggatgtttcaaaaatagcagcctctgtatacatttgtcaagcaggaagctgggtctgcggggagtagggtggggctggttctcccacacgcttgccactttcaggcccttgccttgcatgggctgcggtggttctgccagtgtggattcgaaccgataggtttcgctgtaccttgatcagcatcctgctgccgagaaagccaaaaagggctggagcaaccctcccgtgtgccatgtgagcctgtttcctttctacagtcaccagttcacgcagcaagtgtcagagcattcctgtaaggcccggctctccacaggggccaggggagctttctctggcagggtcttcttcactgtgtgtaggatacggcagcctttgaggctggggaaccgaagttttccttttattctattttaattaatttaaattacaataagtattatcactaagtttatgcaaacacgtgagggaatgctgatttagagctggtggcgtaaggtcacagagctcccacgaatctcacatggaagccttgtttctccaggttttttgtagtttgtactgaatcacacaccatgctgcttccatgttttttcagggatttccaacacagattttcctgagtaccctggattaatctccttttggataggtccatgggggccctgctgctttttccccttagccctgggcgaggtcatcatagagggggagtggcaatggctcacaaggtactagtggaaccccagtaagttatctcagagcccgcttagaacacaagtgctacgtcccccaaaagctttgcaatgagtatctgatgggaacaaactcagtcaaggacaggcccaggttggggcttgcaggctgcagattcagaattgtttatgagatgggagccatactttctaacaacaagacctgaatttctcaatttaatccaagtcgtgacttaagttagcgcccttccgttcctctattacatttctgttcggcatggatcaaattgcctacaaggtggaacagatttcaactgcaatctctgaaccagaaaattcacttattctcatgaaagtttgtaatctttggagagttgcttaaacacttaaaaccatctttcctctttctatactccaaacttacctgctgcaatttcttgctaagaagcaaagtgctatttgcctattcctatctctctttaccatcagacactccttaagttaagagctagataattcgctcagcctcaggccaggccgagcctcactctagaagtcacattcctgaggtgtagggggtcaaaatgcctctcattgttcagaagcaggtgaggggccagccagggcacatcctgctctccaggcttggttcagataactgtcagcccagttttcaagagcacacaccaaaaatgcaccaaagcttacatccatacaaacacccgcacatggatgtttatggaagcttatttgtttttattcataatcacccaaactcagaatcaaccaagatgtccttcagtagatgaatggataaactgtggtgtgtccaggcagtggaatattattcaacgcaaaaagaaatgagctatcaaggcatgaaaaaatatgggggaactttaaatgcataaatgagtgaaagaagccagtctgaaaaggctacaccccgtgtgcttccaactacaggacatcctggaaaaagcagaattaccaacacagtgaaagataaggcctggtggtgtggggaaggatgaacaggtggagcacagggatctttaaggcagacaatctactctgtgtgatactgcaatgatgagttcatgccactatatattttcccaaacctatagaatgtacagcaccagtggtgagccctgatgtgagctgtggactctgggtgacaatagtgtgtcaatggaggttcatggactgtaacaaatgcatcactctggtgggggatgttgataatgggggaggctatgcatgtggggaggtgggtacatgggaaatctctgtactttctgctcagctttgctctgaatctaaaactgctctaaaaatcgtttatttaaaaatacaccaaagcaatgaggccgggcatgcatacagccaaagccaaatgatatttgtgtgagtcaggtaaatttgagatctgaaaaatgatcactccagggaggctgagctgtcatggggcacttattgagaacctactttatgcccatctggtgcttagaattacgaattagctattattattactaaacaattcaaaacaaagtcacttatctcagggcgctttcaatcttgttgccatcgaagctaacaaaagtggaaacagaacaaagctacatacggcacatttcccagaacatgccaggtggagcctggccctgttgattgtgtgtggctgtcacttgcaggagggttccatggacaagtgagtttgggaaatgctgggttgggcaaatatcaacaggcttccttactgcaagatttctcatagtcaaaacatactttaaatctccaagaggatgatacagagagccatgtttcccataattagttggccccagaaacagtttcttctgggaacattttgtaagattagtgctccttgaaacacactgagggagaggctaaactgagtggtagagattcatagactatttggattctggccccagagtataaaaggccagggggaaaggactgtgttcctgagatggtgaggtggagaaggggacgtgtttctccaccacccacagagagggctgagaagccctggcacacgggctgaatctgggaggtcagaaggtgaggtgagaggacaggaagacagcccacgagacttccaaaggaaatggtgagtcttaccatggctctctgggctgatggcagggcccggcacaaggtaggaactgagtgtgagtgcgggatgcacccaggtctgaaatgctcaggaaggaccctaggacatgagcaacctgggctggtcactcatggaacctgaatggctggaaagaaggaagggtgatcctgctaagacagggcgttgtgaagatttcctttccctccgaactaacatctcactcacttctctcagtttccatcattatcttctatggagttcttcattcccacatctgtggaccttaaaatcctaccgttgagtgcctgccttggatcagcagtcagttcgttaccttggttctcagacgatgcttgcaacaacgccatgcgattcgcccactcttgggtaggtggagacattggggctcaggtgtgggtaagtgattgtgtgactccttgttaagcggcagaaccgggactcaaattcacacagatctgattccaaaccctgtggccctaagcatagtgttattagacaataagccctctgcagggagatttccagtgctgatggcagggtctgtcatgaaggaggactctgctgaatttttctttgaaccccaggaagtgcctggcacagttctctgaagaaattagaatgcagccagtggttactaaagaaatgaataagtcaagtaaatggacagagctgtgtgctaagagttcttttgggacacagaaatgggtcagaattggaaatgtccagaaaatactcttggataattatgaaagctacatataggagctcaggtttaactccatatgaaatgaagagtcacaaaagaaaaggaggaggagcgtgttcaggcggaacctcaagcttgagagtgctatgaaatatgtttgagactcagaaaacagttcctgaaagaaatgacacattaatgaatgaaggtatagttatttggagaaaatgaacctagatataagagtaaccatatcaaaatgtgtttctttaactgcggtcttcagaacctatgaggttcattggtatattcttgggaactatgtgtgtttgagaaacatatttctggcgccaaactgacagtcacctcaaatccatcacagcacttatgatgaattcttttcaagttaaatgctgtaaagaaaatacttctcttttttactgttaattcacaatttaaaagtgttttcttactgaactacatgttggtccctcagataaggatttctcgagtctcaggtctttggggtctttgaggagtgtgacttctcaaattggatgacactgatctaactggctgtagtatccattcaagcatgagggaggtcagagcctgggaaagctcaggtccaaacagctcttgaaagaggacgttgcagggcaggctgctttgcacaaagggacctgtagacactgagaacatcagtataccaggaaccagcccaccctttcactctgccagacatgaggctgtgggttacccatctttccctgtctcctgaactcatagcaaaaacaaaaaacttcacttgtttgttaacacatatagttcaagacggaagggcctacactgaagcagaaaggattgaggtttatcagcatcttcgctttgaggcctcataatgtacttcccatggactaaagttgttcactttctttagaggatattagctaaagatgtggtaaaaccacatttttgcagaaaagtgaatattcaaaaacaaatgtatatggtgattatttaatagttttcactccacttcgcaactcaacttttggttgatgcaagagggatgcgaagggagaattgtgcttctaattccagcattgtggtggaataaaagagcacagcattgcagctgttgaatataggcagttttttctttttataggcagttttaagaagaatgcattgattctacaacgtgctattgtgaagccatccgggactgttcactcactcatttaagaaaggtgtattttccacttgaggtgtgagagaaagtgtggtgttcactcattgctcttccttctggcttttatttttctcacttttagagaaaataagagaagtatccctgaaggatgaaatatcctcgaatatgaaaaggtctgctctctgaagaccaactgtctcagtctgctttttgctgctgtaacagaataccacagacttggtaatttataaacagtagaagtccatgtggcttatgcttctggaggctgggaagtcccaggttaaggggctgcatccggcaagggcttctcgctgccttatcacatggcagaaggcaccttgtggtgagacagtgaggaagggctgatttcactctcacaacaaacccactcccatgataatggcattaatccattcagcagggcagagccttcgtgaccccatcacctcttaaggctcccgctcagcatggttgcactggggttaaatttctaacacctgaactttggggacatgttcaaaccatagccagggccctgagaaacccatttccactgacttcaaaatagttcatgaaaatggagtgctgagagagcagcagggcattcacaagaatggttttgagaggcctcactgtgccaggcatggccctcagggcaggcagctctgcacagccccccatggcagcagctggtcaggctgcccaaactcaccactttggaatcacttcagcaccacctgtcttcacttgaaatcaattgtctgcagattttaaactcgtttctatgtgcccagtaggcagagaagccttcagagaaggatcctgactcggtggtttgtgcagtgacatttggcagtgttttctcggcaagcgagtctttgaggctgccctcatgctgctcagtgggcacaccaagaacaagagctggccagggatgacggacgcatctaggccttctcggcctaagggcaagtcccattcttccttgataggtctttagatgtaccagtcagcaaatgtcatccccctctgcattcacgtcaagctgtgcagggaatgctaaacagaggcagatctaaacttaggagttaggcttcttctccatggagatgtggatctgcacagacaaagtgtccaagtgggattttcctgctatttcaaggactgctgctgcaccctgctggctcttcctgcactccctgcctccaggaatgactgtgtctctttgagttagtgaagtcatcaacttttttttttaaatctcttattattattattatactttaagttttagggtacatgtgcacattgtgcaggttagttacatatgtatacatgtgccatgctggtgcgctgcacccactaactcgtcatgtagcattaggtatatctcccagtgctatccctcccccctccccccaccccacaacagtccccagagtgtgatgttccccttcctgtgtccatgtgttctcattgttcagttcccacctatgagtgagaacatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcgttgttggacattcgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctcatcaacctttttaaaaagcatttaggagctgctggttgtaaatgatcactgagaaatagtatttccctcacttgtagccatctgcttctctttttggttctggaacattctagaaccttggaaggtggctggggctgagtctcagccagcagggttgcccagtgccccttgtcaccccccgagcaacacaagccaggctgcggttactctgggtctgtgcgtctgggatcatagtttttaaatctgccccagggtcctccagtcccagctgtggaaagtcaccctcagagggtgaggcgggcggcgcgcctctgtgtgagtggccccatccttcacagcgagtttgtgtctactgaatcgcagactctgggaggctgaagggttacaggaggtcgtgtgtctcacgtcgccacttcacggttgaggaccccgtgacccgctttgctcagtggctgcgcaagatgagtaatgacctgaaacagggaaaatgtcttggatacatcttgcgtaatgaggagaaaaatgcagccatgttgcagcctgataaaatactctgccagtgtcctgccataaaatgacaggcgaattttcagtagcagattctctaatagttctgtggtcttctaggtgctaaactgtttaagtatctacattttctaagcccgcctaatgcaaatattctcaaaaaacataaacccttcattctttctcaaataggttacattagttatacactctggaggtgacttgacctgtcattgtgaacaattattgctcttggacgacccaggacataggccagccagtacgtaccccagtgtgttggagaatcgcgctcggcttcttcctctgtgctgagtcatgaaagttgccggagcaggtgcagttacacaacctccaggtaacatcacatgatcgttcaaaaaataatcatccaagtccaggatgcagcatctgtctcagtttttggcataggatgacagtctgaaatacacttactgaatttgaataagaacgggctcaggtcagtgattatcgctagtgccttatcaacgccctgtggcttttcagcattagtccccatatcctcgtccggtgtggcactgagagcagctaactgttgccctcgttggttcccagttggcttccgtgactggtcagggtcaggtccactgccaacaggctggtgttgaatcccttggagaaacacagacattctgaccctaaattatgctttcaatgccatgtgttttcctatcacaaaaatcctcgttctcaagtttcttctttctttatttttatttcatttcattttttagcattcctccacaattcattgcccaaatctactttttactcaatttacttgctttggtcatttttcaatatagcactttaatttcttagacaaatattttcaacattctcctgttttctcaaggatgtctgttttctccccaggtatgatcctgtttaaggactggatttaggataactacttagaggttaaaagtcacaagggtgtatggatgaggctggagtgatctgggaccaaaggtatgggtgataaagcagagtatctaagcagctcctgggattggtgtctttaaaaaagtaataatgcatttgcttattttagagacagggtctcactatgttgcccaggctagacttgaactcctgggctcaagggatcctcccacctcagcctcctaagtagctgaaactgcaggcatgagccaccacactcaactcactatctttttttttggagacggagtctcgctttgtcccccaggctggagtgcagtgctgtgatctcagctcactgcaatctccacctcccgggttctagctattctcctgcctcagccacctgagtaggtgggattacaggcgtgcgccaccatgcccgtctaatttttgtattttcagtagagacgcggtttcgccatcttggccaggctggtcttggaactcctgacctcaagtgatctgcccgcctcggcctcccaaagtgctgggattacaggcatgagccactgtgccctgcctagctcactatctttcaatcagtagagattctttagttattttttaactccatggatcccaagctttgatttttgttttccaaacaaattgcatttataaataataatttttatttataatcaacagacatctaggcttgctgtcaaggcttctgatcaacatgagatgaccgccgtgtggtaaactgatgaaccctgaccctgatcaacatgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatcaacgtgagatgaccgccgtgtggtaaactgatgaaccccgaccctgatgaacatgagatgaccgccgtgtggtaaactgatgaaccccgaccctgatcaacatgagatgaccgccgtgtggtaaactgatgaaccccgaccctgatcaacatgagatgactgccgtgtggtaaactgatgaaccctgacccattaggctttggctacagaatgtggaaataagttgtgttactacatgtgtgtaatcctagggtgcaggacaccggccgggaggttccatagagtgatgggttctgcaggtaactcatcctctagtcctctgtaagctcctagaaggaagaaattatgtcctttagactaataaaattcctccaaaccaaatacagcacctactgtgaagacacaaagatacttttagaatagtaaaaactttatccattgagaaattccttaatgaaacagtatccaagaagtcatttgccagcagatttcttagaggtgcgataaagaagaggacattgccagtcgtcacagcagctgcaatagctcctctctattgttaaacagtgggatatcttgtgcaggttttcagttgacaatcaattttaaagattagtttcggtccccatcaatcaattatttattaacccatcaataaaaatttaaatgctctgtgaggtacaatagctattaaaagagacagaggcactttctgtgtccagaggggcttttagtctgctctggaaagcaagatgcgtgcagatgagtgacgcagtgcatcgtgtggatgcaaagggagggactcacatgggaaccagaggagctacgaagggaggcagtggggactggtgggtcgagacctggaaataacacatgaataggcaacaaaggtttcctttcctcttccatgcacttcagtccttgaaaaacgtcttaccacggaattccacagcgtaccaagcgattccacagcttgatggcacactctcctttctcagcattcttgaaaatggcgtgtgagccaagccatcttactgagaaattaccttaaaccatttgatgaaccaaaaatattttgtaatacccatctccgacattaggtaggcaaatcacacagaaacaccgaggtcttctgagtcatatttatctgaaaaatcacagcttgggtgcatgtgaagccagaggagcactcctggggcctgcggtgccatcactcagctcccctgggcttcacatggccatggagcacccagcaagtgtaggctctgagccttcagggaggggcggcatcagccagcaccatcgtctcctgggtcttgtgcctcttccttggttgcggtgttgtcagggccagaattgggcaattccgggtgacatccaggtgtggctgctgacacggagcacaggtgaggttcactgaggtaagtgggccatggccttgggcttctagttcagagcacaccatccactcagcatgtgaacccagctccaaagcgtatgtgtgcatgtgtgtacctgtgcacattgcgcatgtctctgtgtatgcatgtgctttgatgcatgttgatgtacgggtgtatctgtgtattgtgtatgcacacacgagcatatgtgtacatgaatttgtattgcacatgtgtttaatgcgaacacgtgtcatgtgtatgtgttcacatgcatgtgtgtctgtgtactgtgtgcaacagtgtgtgcaagtgtgtatatgtgggtttatgtttgtacagtgtgtgtagtgtgtgtacacatatacacctgtgtgcatgtgtacatggtatttaagcatgtttgcacgtgtgtttgtgcttgcatgtgctgcgtgtttgtgttggtgggatgtggggaggctgctgtggagacaaaagctggagagaacttggtagagtaacccaggtcaggaaatggcacctgcaaaggaaggctggagtgcctgggattcacgttgaaatggccaatccgtcagctgggctggacacagccatcacgctgggcagctgtgaggttaaaacagaaagtctgggctgtggggaggctgagaattgagatgcatgtatgagatgagtcacgagggccaagtggtgtgtgtgagaaagcaggcacagcaccactaaacactaaggagatttcaggggagttacgggtggagggaggacatcagatctaccctggaagttaaacgtgtttcgagtgcattaaatactatgggccacagacgccttgtctccatatctactcttttataaatgaagtaaagttcttgggaaatacttttctcactctaaagctcacaatctatcttgcaaaaaatattttaaattccatctcaaataagccagggtgaaaagggagcctgtgcaccagacactgccagccttgcctggctctcgccttcttgctcttccttccccacctgctggggattttcttaacgatggagatgggtttgggtttgtcctgctgtgctctgctccccattcccggatccaaggtcctgcctctgtcctgtcccctgagccacctcagggatgcagggtcccccacctggtcaagtgcccagtgctgtgttgtcatttgcaagttcttcctgtgactgaactccaaatggcactgggactgctgactccacccactggacaacccgtgttcttgcttttggggtttctgaaacagccccaagactctgggcatcttgattttgctcccattgcttctcaggacaccctgctcctgtggtttgcagccccggccttctcttcgaggacgcctctgctcttctgcctcacactcggattggaccttcttcagcacagccagtggccgaggcttcctccctggggctcagtggagcaggacagatgctgcatccaaactcttccattgggttccagtctgttccagtcatgcccttgagcctctaaagctcctaggtgagagacgtagcagctgacagcacttcccacttgatttgggtggactccagcctccccagcaacaataagagatcaaaagcatcgttgaggaagcagcttgctgaaacgctgagtgcccgccactctcaggtcaggtgggaccggcaggccagcatgagttcctgaacacttggttctcaatactggccacagccacactgtaaggggaaacaagagggcactgtatgcaaacatctcttgaactctggagtctgctcaccttcctgcctcaagcccctctcccacgtggtccagtcaccattctccacagagactaccctaaaacccagcgactctcgtgtgcctgcagaatggcacagcccgttctcatagcagcactcctgtttaatcagagggatgttaacgaccaagtcatatttgctcgatttgtgttcaacatatttcatttgtaccgataaaacttaaaaatatccccacacatgcattgcctattaaagagtatcttccaggtacacctcccttacacatcagttaacttgataatttcttcccattcttgtgcaataaatttccttcctgatcagctctgtccagcagcaacaataatccacgtagagacatgcaaactaaaagtccgttagtggaggcacgaagctgatgaggcttggaaaaaaatgaccgatttgattaaaattaggacccatgggagtggagctctgcctattttagaggcaaagtaaatgcctgggagtccaatcaccgacattctgtttgaggtttctaatcacaaggaagatggagaaaatgcagaacaagtggtcaagaacagggagataataaatagaatatttatgggctgaggaaaacaattaccaggggaaagcccaagaagcaaagatgaacagagaacgtgctgactgcgctcgtttggaaaggcctcatggccaaaggaggagaggcattatgaggagcagtgaccgagtgggcaggacccccggggatcaggaaaggtgcacggggggaaatgagaggcctgagcggcttcccagcgaaggtttttgaagcacggtttgattttctctctccccctcaccatccccaaattttagttgtgactatctccaggtacatggcttgcgacaggcggtgtataaaaactaatgtcagtttaattttaaaaccttagccattttctggaacttaaatatcaaagagaaaatgtccacatatgatgttaattgaggtttgtctcactggtgatttgtgctgattcaattcctgtttctttttttttttcttaaggggtcagttttagaattgggagataggtgtataacatatgactatacagcgcaggttggttttttaacatagaaatatctgcctttaaatgagaactgaaaacggagcttcttggaggccacctgctggtggcagtgatctgaccgctgtttaagctttctttgaactcctttttttaaaacagcctccataatcaatggtgtacgatctactctcgtggtaaaacttactcagtgaagagtgtgttttattttctgaggagctgaactgttccaacctgagtattctgaataaggacagtggtcgagcatgagtgatgccatctgggcttagaaataagtgggcctaaaatctgattgttttcatacattgttcagatattgacgcaaatagcaatttattttgtaaaaaatgattggtatccggaacttgcaacagctgtgtgtggcttgaagggagatgaagtggtgaaggcctggtttccaccgaagctctcacagcccagcctttcactgtgtggccgggggaagggtgctccgggtgggggacgggaatggtgggactggggatgccacgggacaaggctgctggcctggaaggtagtcacgtggagaaccgcaggagatgagattggaaagtagtaataagccatgtggataagaacagaggagcgggttttaagggggacgtcctgaaatgctgctcatgtcgtttcagttccatagaccacaggaaatgcaggtgagagggcagcccggtgggaaggaaggaagagggtggtggtgagccaggtgagtgtggagccgcccagggcaccgtgctgtgcgatagctcaggcatcgggtgcttctgccaaacccttcagcagctggtttggggccaaacgtccttcctgtgtgagagaaggcagagcctaggcagcattccaaaccccatccagatgggaggctgagtgcagagcaaacggagcccagcactccagagccgtgtcccttcactgccatgatcacatcacaaacagcgaggcttggagaggacttaagagctccttcaatgccatcttccatccactgcgtgagccagaatagaaaaaaaggaataagaagaggtcggttaagctctctattaagttgagaaaatgggaacttcaggtgatcatgtgagatattcaagttaaaaaaattatttaaaaagcacattcttattattaaaattttagaaagtacagagaaggaaattttaataacctacacctagaacactaagatactggtaacgtagaaaaatgtgtagttaatgccttgatggattcttttctatttttttctctagcaatatttatgtctatccacagaaagcgtacactcatgtatttgcatggctaatatattttatgtaaagttctatatatttctcaacatttcacttaatatttctttataaacatttttccagtgaataaaaatttttccaaacagtaattttaatgactatataacatttcattgcatttatatatcatttgttatttaactacttcatcattttggattcacatattttcaataatttccattataataataatgtcatgaatacctttgtacaagaatatttatatttctaattatttccttagtctagtatcctaaaaactaaaattcctacatcgaaaggtcaatgtgtatcacggctcttgattgacatattgatttccatgaagctttcatcaattaacccatgaacagtgtctgcaagtgctccttgccccataccttccacaatgtggactcttattggaagtatctaaatttcacttcagaattgcagccctgagttattaaacacacctctactacacctatgaaattgtctacaaattgtcttagtttcttttcagctttgatttctagaattgcatgacattgaagacaaatgatataatacccataaagaaggttttatgacctctttcattatctccaacaatcagaaaggcaaattcacagtagagggctgagaaatcttatctgaaaattaactaaaatgctgcttttgtcaacagaattacttgggcttcatttcattccacaatttcctgtgtactgtttattacaagaagaaaaaatttcctgccatacaaaatgctccatgcaggtagaaccaggaatctaaagaaacctgaggaaggtgctagaatcatcactaccatctttttttttttttttttttttttttttttttttatggagacagggtcttgctcttcacccaggctgcagtgcagtggtacaatcttggctcactacaacctccacctccaggggctcaagcgatcctcccacctcagcttcctgagtagctgggaccacaggcaaacgccactgtgcccagctaatttttaaacctttttgtagcaacaaggtctcactatgttgcccaggctggtcttggactcctgggctcaaacaatcgtcccgccttggcctcccaaaatgctggcattccaggcaggagccactgtacctggccccaccttctttttgctgtaggctgagcacaggagaagttgaatttatcagggaacctaaagacatgcccttctttgaaggcagaagtcctgtccacgtcaaatgccctccctccatccctcccagctccctagtcatccttcctattctaggctccaggagcgagacctcctccatgtgcctgctaacgtcagtgccacgggccctctttggttctcctgcccaccttctctgactctgcccaacacccacgggccagaggcccttttccttcttggcacttctcggtgttgtagcaggatgagccacggacaaaacccctcagacgccgggttaaggaatgatttggttttattcggccaggagcttcagcggactcaagtctcaagaaccgaactctctgaagacagagttcctggcccttttaagggtttacaacctttaggttccacgtgaaagggtcgtgatagattgagagcacatgcgtttagagtggggtgggggggttaatcttttaacctcaggcctgatcatcaggggcaccagctggtcttgccactgacttcattcctgttgtttttcaacttttacttcctcctcctcttcagacaggagacagtaagagaaatggcctctctcctcagcggcacaatggactttagacatcgcgcctgttttgtactctccaagccggacttctctactcgctggcctggcgctgatgcccagaggccccctgtgcttgtggtcgtggccttagacagttccctgccctttgtaagtactaacttaactcttgaatgtggacgttttaagctgacttttcttctcagccctctgtaagagtttcgaatctccccatagcaatcaatgtaattgttttcacccagggtgttggtcctggctgcttcgattttaaagtaatctctcattttgctgaggagaatttattagagtaaatgactgttttcacctgtcatgtcacattaaaatgtggagagaactggttgtaggggcagtcaaactggctgtgagacccttcgagcagccatgcatctcctggacagctcgaacactgatcagggaggagatactgaaaataagaaataagaattgcctttatatgtgtgtatgagtatagacacatacatcatgtacatgtatgtgtgtatgtgcatatgtgtgcatgtgaagatggatagatgatagatacataggtgatttatgtataggtagatgacagatattggtaattaattgatagtagataggttgatagtatataggtgattgatagatggatgatagatcattgatagatgataggtagatagtagatagattataggtagataaatagatggatgatggatggatgatagatacttgattgatagatgataggtagatagtagatagatgatagataatgatagatgatagctagatagtagatagatgtgataggtagatggtagatagagatgatgatagatggatgatagatggatggatggatgataggtgattgatagatggtagataggtggatggtagagatggtagataaatagatggatgatggatggatgatagagagctgatagtagataaggtagatagtagatagatgatagatggatggatgatagatgattgatagagagatagagagagaaggatgatagactgagcatcataacttcactgaatgctaccagttggattcaaaagtcagcaaactgaaacgtcgaatttcagccagctatcagaaatattgtaatctgacaacaaaagataaacaagggaacatggaagtggcagctattccagaagctgcacctctcagcatgggcacagaaccacagaagtggagccagagtcctctccacatctcctctgggtcggcgttatcattgtcacaatgggtggaggctggaccttgtgaaggcaaaggcatacggtgctttcttgcttctgctgtttggtgactcccttactcattccctctgcggtggctgaggggctgatgatcagttcctctgcccagaatgccctgaccatgctgggtgtctgtcctccctagacctgggtctgcaggatgacaaggaccctgcagcagaaactcctctgtctcttccctgagcaccgtcttccatgctgcctgactatggtgctggttcccctctgatatggagattggtggagaatgaccaggatattttatgtggcaatgggggttgaagcccacttcaaaatggcttaggataagtgaccaaaagtcccagtgtgagcatcaggcatggctggatccaggtgctcagcaccatctggaaatttgtctccatctttgactctgctgtctctgtgtgggcttcatttctaagatggttttctctgcacagctgtaacaaagctcagggcttgcatgatgctttgcagccagtacatcagagaggactttccctcaagacttctggcaaaatttggggtaacatgctgttcttgctggggtcaggagccatcttgcaccaatctcagaggccaggggatggagaactctcctagggtagtcccaggttctgtgcctccccggaaaacacaaggtcggagcctccccatccaaattaatgctcagactgtcagggaggaatgacttccaaagaaaaaccaagggcccttatgaagaaaaggaaggggtgcacctacagttgccagttctgtttggaagtgagggaggggagggcagattcccttggcttgttccctaggacagctgtacttaggttttactacacagtccactgaaaatgcttctctcattagtgttgtgcctctctcatgcctctttccttggataaagagcaagcacattacgagccacacttggtgctggtgctgtggcatgcaacactacctaatgcgagagaaagatgtgagcaaatatccggaatatacaaatataatacaaaaatacaaatataatcagttatacagcaaacagctgtgggaacagcagctctgcttgcagggttgggtagtggaaggtttcagagttgatagcatttggattgggctttaaggtatgactaggagcttaccagatagagaagtggtgtttggacgttgtatgagaaggaaacacaatctgagaaggtgtaccatcctaagtgaatctgtcacagaagcgagaagatgctgtgtaaaccggaataatgcttgtgtgcatggatcttgatcccttcgtgagcaataaatgattttgtgaataaattgaagaatgctgaattagatcatagggtgtgtttgccggggtggggagagaggagagcgtcgaaactggggaagtggggaaccagagatggcaaagcctgggacttccagcttcacccacaggacgcgaggagcctcatcagtatcacccgcacaagcaagctcccatgaaggcagcggtgtccaggctctgtcgcgtcctttctttgcagcctgggccttggtttcttgcaggtgctgtgcccaaaggttagattgacagatgtggccgtgtctatcagggaacatggactgaggccagtgctttcaaccatactcacttttcactgtgttcagagggggtgggaaatctcccctaaggaggagatacgacgtgtgcagattgagagctgggaccacacggattcctccaggggcaagggctggtgaccttgcagtaacttccagaggcctcagcaccctcctctgcacaatggtggtgggctagccagggcaccacagaaagggccagcaaggcacaccctcgtctattgcccaggcacacatgggcatccatgacagccatgcatgtgttagagcccgaccagagctgcagcctcctttggctgaggttggaaaagcggagatgtgttcacagttggagaattggtatgccttacccaagtgacatccctgtccttggaaacttattctggggtcacagaattaattccccaggattgggtgtcacgaggaggtggttcctgtggctgaaaaccaccaacacctcctttcctggaacatttccctcctggcatagggcagttctcatgccagaacatcttgggccacaaagaacctttaggactgagcatgtctttctgtttgctttaagcttttaagaaaaagaatatgcaaaggctgattgaggcaaaaataacaggctatttctgacgttcattcagaatgccacctaactaggccagtttttggactgtatgccagcctctttctgcgggatgtaatctcaatgtctttaagttcagtcagtcctataaattgctatccctattcatgcagtgtgttttcccctgtgtgaggcatttgtgagttccattagcactgataggacttttaaatgcagaagcagcagtgaagggaatggcatttcccagctgtagggcacgggccttctttgagataaaaacccaccctggcatcgatgacatgggaactattctgtgtcttttcacccgagagctcttcaatcaactgatgatcgcacctgcataactgctaccagacctgctaagggggagcctggcccagccatctcttctttgtggtcacaagcatgaacggccctgggacatcctctttcctcactgtcccctcacagcatttcctgaccactgtggccttggtcccaccacccacctgtgcagctcatctggccatgaacctctccagctcacaactctgttttctccctgttgtttctatgaaaccaggttccagccccgccacacagtctgcacggcctccaccgcagctctggtgagcctcttggccagctcctggtgacagcgtgcacctccctgctctgagaaggtctccctctcctctctgcccaccctgtacagagacatctttcaagcccatcccagaggagagtggcctctctcctcaaccccaagaggacggcctctcatgtggctgtcacccatctgacccctatcacagacctgagggtaagtggtgctcacgggcccacatctgtcagcctgcgcctggttggagacgcctccctctcatttgtccttgcttgctgcgtgactttggcaagtgcttgcctctttgagaccctcagttttcacacctgagaaatagaaaggtggtgcctgccccagctgccacgcagaagagtttaggtggcatgtgagaaaatgccttatgaactacgatgtgagcaactgcagcatgctgtgaacaccgctttcatgagctcctcaggggcagggtaacacccaagcattcttacacctcccaccgggcttgtcacgaccgtatgcaaatgaaggccatcaagcgtgtttgatcagtgatgtatttctttatttttagttgtagaatatgacaactctatttttagcagctatagcggccaaaactttgttaccactcagcagttgtgtgttcttcaagagtaggttttgtgctttcaaaatatctgaatcctctaccatttacaggtgttctgtgcatacttggtgtatgagttcctcaggaaggaagaaaaatgtgccctttttatcttttaaaaagatggcttggcttggtactcctttgcctgcattccttctctgtatttagaaacgaacctacacaagtgaaggcaaaggaagcctcttgaaagataaggcaggaaaaatgaggatagaaaacaaaacccttctagagagtttacgtggaggctaccacgggcatcgctgctctgcagtctgtcaaccagaggcccctggtgctgcagcacggccttggcagcttcaccaacaggaatgtgttctcctagggtactggagggtggcagtcccagagcaaggtgtggcagggctgctcctcctgaggcctctccctggcttgcagacgacatcttctcccatgttctcatgtgggcctccctctgcacacgtatatctgacatcctcccatgtcctcacacgttcctccctttgcactcgaatcccggacatcctcctatgtctcacgtggtcctctctctgcactcgaatcccagacatcctcctatgtcctcacatggtcctccccctgcactcacatccctgacgtcctcccgtgccctcacgtggtcctccctctgcactcacatccctgacgtcctcccgtgccctcacgtggtcctccccctgcactcacatccctgacgtcctcccgagccctcacgtggtcctccctctgcactcacatccctgacgtcctcccgtgccctcacgtggtcctccccctgcactcacatccctgacgtcctcccgagccctcacgtggtcctccccctgcactcacatccctgacgtcctcccgagccctcacgtggtcctccccctgcactcacatccctgacgtcctcccgagccctcacgtggtcctccctctgcactcacatccctgacgtcctcccgagccctcacgtggtcctccccctgcactcacatccctgacatcctcccgtgctctcacgtggtcctccccctgcactcacatccctgacgtcctcccgtgccctcacatggtcctccccctgcacttgcatccatgacgtcctcccatgccctcacgtggtcctccccctgcactcacatccctgacgtcctcccgtgctctcacgtggtcttccccctgcacctgcatccatgacgtcctcccaacagtgagcacgatatgttattggggtgggtgtgggataaataaggtataccaggtgagaataataagaaactcaactttaaaagacggtgctgatttggactgtggagagattcaactgccctgcttagcatttgagattgtgatggatgaactaattaagagcccaaaatgaaagcttgggataaatatctgagggtgtctaatatcccaatttttcatcctagagtgggcagagtccttgaccgcattctagggagacttccaaaagaaaaaagacctgcatttcttcaacaacccacactgagagactttcctgcacttctgacctgtggctaacactcctcaccgttcattctgtcatcagtgttttggggaagcacctttaactctctgtgatttacaggttattaagtggcccttacaattccctccagagatggaaaagacatgatgatggtgtctgagctcacagcagcaagcaggcgtgtgtgctcagcagccacgtggctcatctgctgggagcttgctaaatacgatgttctacaacattgcctaacacaaggggagacgctcctgactcagagtgtttaattgctcacctacttctttttctgccctcttgggcttctgaaatgaaaagaaccctggggtgatacagtgagtcaaaggggtgccagctgcatcacagcaaaatagattcctaaaaaatccctggcctaagatgatacccttggctggataagtttgaatgtgctcatagtggacatggtagaatgaaggtggttgaaatgttcacattaaagaacttccacccagattgcaagaaaagagagaagaatggagacggcagcacgagtccctacaataaaagcagatgttttgagatcagttatatttcttctgacaaaaattaaagacagaaaccaaagtttagcctgaggctacaattaattgggcaataagccagaggcacatatggcatagacagatttaaacatttctccctgatattaatacaaatactaaaattacaaatactttgattccaaataaaacaaatatttaaaaaatttaatgaataaacactggggtctacagtagtatttgaaggacagctcacaaacaggtttggtttttgaaggttagaactggtggtctagagaattcatttcattccagagagagaaagagaggaatttcttgggttccttcaggaatgcgtctagctttgcctcatctttgtttgaactatggatacggcagaagaaaacatgaggatttcacagatttaaggtgcaaaaagtcactgggttctctaagaagtctgggattcttctgctggaaaaataagtttgttgagaaaaaatgagttggaggaggctgttattgaagtgaagcagaattgtttttactaatctgcttattacccactctgtagtatggaaacaaattattcatgcacaaggtcctcttgctgttcctagaatgcagtggaaagagaacagattagttttcctccctcagaacacaatccctagagacaacctacctcagatgagatattgcctaattattttcaaaagacagtgaaacatcatggatgtaaatgtttgctgcaaaataaatacatgctagaaacagaagcatctgggtcacagctatattagagctgcctgtgttcccctgtcactgagattaaaacaaaaatgtccaatacaatcattcacagcatgggagaggggaagatgaaggatggaaaggccaggcataaaaggatttcagaatttcggtccataaggaagtggctttgtgcattgtctgttactatgtgcaaggtgaagtttgaagaatgaaaacgtgcagtaacaaaggctgctttgtccatctcacctccccagataccaagtttcagacatgttgcattttaattgaaaggttgatataattttttaaaagaacacttgtggtgtttgaagtgacaaaggctgctgtgacaaaaaagcagggaaagggaatttaaaaaaaaaaaagcaaacaacaacaacaaaaaccccacagaaaagcaaacaacaaacaaacaaaaaacagaggaagaagtcaaacaccctgggctgtggctacttccaggaaggggctacaagaggcagttggaaattctatttgttttgcaactgtgggttttccggcctgcttcctttctaaagtatattactctgcttttggttcatgaagttatccatttctgttttctggaacagctatgtatttatctatcatctatctatctacctgcctatcatctatctatctatttactatctatcttttctacctttcgccatcaagagcttcaacacctggacacattccgcaaagtttcctaagaaagcaagaaaaataattaaaaaaaaaaatccggagtccggggggctaatggggctttactgggactctctggcttaatcctccaaacaaccctgccatagcagcccatcagtcctctgagacaggtgaggaaactgaggtcgcaggagggcacccagaaggtccaggcagagcccccaggcccccacacctccccccgtggcagctccaaccccagctttttcactagtaaggcactcgcgctgctgggccacgcccactcccccacgcggggaaggagcttcgcgctgccgcctggctggggactgggcacgccctcccgcggctccggagccggctgccaccagggggcgcgcccgcggtgtccgggagcctggcggcgcctgtgcagcggccagtgcacctgctcctgccctcgcctcggtctctgccaggaccccgacgcccagccggaccctgccctccagcggggccgcggctccacggcccgcaacagcagccccacccggcattcggcgcgctccgcggggcagaggtcgcggtgtcctcaggctgtggcgccggcctacaacccccacgccgggcccgggccccgtgattatatttgggccccgtgtgattatatttgacaggtcttagttgacgcgctgttcagcgctttgagttcggctgagttttgggttggagaattttcttccacaggggattgtcttggatttttctatttctccctcagtatccacctggaaaacatttcaattaatttatattcacttaaacatttccgtgcaaaaactgtgtacaaaagccccaaagtataatttgcgcagttgagcacatgttctgttgtccagcatttatggtggtttgtagtggaaaagatttttagaatatgtggatttttgggatattcccagaagcccagatggccacactttaactttggaggaattaattctcagaatattgcacacaatcaatcgcctttggaaggagcatatattcccagcaaaagctctggttttttgaagtctgtgttgtgtgttatttccaggagaatatgcaatgatgacaatgttattaactgattcgaatatgaaatgctgttatgccaaacaatgaatctttgtgttacacattatgcctaactataaatcttcgtgttatacattttaatgtcattggagagtactcctgtcttcttggcattattgataattcgattctaattgctaataagtcagaaaaattaggaacaccaaatttcagtcgtctcaaaagcactcctcttattaaatttggatttttacctttatcacatcaaaagaaatattgttagaaaggtgtttaatgttttccagatggttagattactgttattagttctgatttcattgttaatttttaaaaccatagagttggaagtatcaatatgcctttcaatataccttagtggaatttattaaattttcatggatgtcctttaggaggttcaggaagttatttctattgctagatttctggaagatttatcaggaatgagtgtcagacattgtcagacgtccattgaaatcatcatggtcttttcctttattctattaatatggtgtattacactgatttttagatttgtattggtaggataattccacttggttatattgtctaacttttttctaattttctttaatttttattagagatgaggcctcactctgtcacccaggttggggtggagtggcacagtcacagctcactataacctcaaactcctgggctcaagtgatcctgccacctcagcctcctaagtagctggcactacaggtgtgcaccaccatgccaggcttatctaacatttttatgtgttgcttcttccagtttactagagtttttggagatttctgtcttcattcatgagggataatagtctgcacatttattttcttgtgatgcttttgtctgatttgttatctgggtaatactggcctcaaaaatgaattgaggttttcctgcttctctgctttgcaagtgtttgtgaaggattggttattcattaagtgtttaatagaattcactagtgaagctttgtgagcctgggctagactgatgaagagttttcattagtctaatctgtttacttgctgtatgagtatgcatatattctctttcttcttggtttacttttacaatttctgtatagcagggaatttgtttctaatttgtagtatttcatgcttctaggttttcatggcagttgagatgtaagaataaaaataatgttgggagaaagaagttgtggacaatctgtgaatatcccaacatctgttgtaggaaggttaagattttttttttttttttgctgtacttaactgaatactcatatttatagtgtgagacaaatgtaatgttgtgtataaatagaactaggaaaatgtcttagtatttaatcgagatggaagtctgggcctacctcctctcttttattaatatgtagacaggacaccaacacaaatttgaatgaggacaaataaaatgttagcaaatgaagaatagtatgaattggttaaaatgtgatgaaatagagtggtgaatatttacatagaatccatgatgtgttaggtgctatttcaagctatttgcacatatagttttaataccagtgacattaagatgtataacacaaagattcatataaataaaaattacaacattgaaaataatattagatgacactaaaactatcgtagaaatacacatttatataaaacaaagtaacatcaagtattaaataaattttagacactttgattactaatcagatgaataagtgattagccttttaatccagtaaacaaggcatacatattattttcaaattccagagacaaatattttaaatattgaagtctaagacctaaaaatgtgtcctgtaactctgggggagggggtttcatttgttccacctgcagtgaggtctgttagcccgtctcaggtttgactcctgacttaattcctaacaggggaagctgctgtcctgtaactctgggggagggggtttcatttgctccacctgcagcgaggttagcccgtctcaggtttgactcctgacttaattcctaacaggggaagctgctgtcctgtgactctggagaagggggtttcatttgctccacctgcagtgaggtctgttagcccatctcaggtttgactcctgacttaattcctaacaggggaagctgctgtcctgtaactctgggggagggggtttcatttgctccacctgcagcgaggttagcccatctcaggtttgactcctgacttaattcctaacaggggaagctgctgtcctgtgactctggagaagggggtttcatttgctccacctgcagcgaggtctgttagcccatctcaggtttgactcctgacttaattcctaacaggggaagctgctgtcctgtaactctgggggagggggtttcatttgctccacctgcagcgaggttagcccgtctcaggtttgactcctgacttaatttctaacaggggaagctgctgtcctgtaactccgggggagggggtttcatttgctccacctgcagggcgaatggtgctctcacctcacacgtgacacttggtcctttttgcattatggtggtgaccactgatgaccgtatacctggccgtggagtgactggctgtactgtcttacaggtcagtgtggggccagaaaaaactgggccaagggacactacacagaaggcaccgagctgatggagtcagtgatgtacgttgtcagaaaggaggctgagagctgtaactgcctgcagggtttccagctgacccactccctgggttgggggactgggtctgggatgggtacccttctcattagtaagatccgggaggagtacccagacaggatcataaacacattcagcgtcctgccctcgcccaaggtgtcggacaccgtggtggagccctacaacgccaccctctcagtccaccagctcatagaaaatgtggatgagaccttctgcatagataacgaagcgctatatgacatatgttccaggaccctaaaactgcccacacccacctatggtgacctgaaccacctggtgtctgctaccatgagtggggtcaccacgtgcctgcgcttcccgggccagctgaacgctgacctgcggaagctggccgtgaacatggtcccgtttccccggctgcatttcttcatgcccggctttgccccactgaccagccagggcagccagcagtaccgggccttgactgtggctgagctcacccagcagatgtttgatgctaagaacatgatggctgcccgtgacccccgtcacggccgctacctaacggcggctgccattttccagggtcgcatgcccatgagggaggtggatgaacaaatgttcaacattcaaaataagaacagcagctactttgctgactggctccccaacaacttaaaaactgccgtctgtgacatcccaccccgggagctaaaaatgtcagtcaccttcattgggaataatacggccatccaggaactcttcaagcgtgtctcagagcagtttacagcaatgttcaggcgcaaggccttcctccattggtacacgggcgagggcatggaagagatggaattcaccgaggccgagagcaacatgaacgacctggtgtctgaatatcagcaatatcaggatgccacggctgaggaggaggagtttgaggagtatgctgaggaggaggtggcctagaattttccttttctaggtaaaggggggaagcagcgtggattcttaactgttctgacagccatgtgtctctaagcacttattcatttgtgtcttcacctctcctcctgctgcattttaaagcacttttatagtatgcagttttgcctaatattttcacagcatctggtttcacctccaacttctttccatgggccctccggctactgctgccagatgtgcatagttgtcctgcaaggctgaagctgtctgggtttatcacatgcccaggaacaagcattccagtggctctaggaggggtcggcatgggttgtggacatggcaggcaggtgccacatgaacttggggatgccctgggccttgggcagcgacgtggtggaaaacctgttcctgaaggcaagccttggcttatcccatgtgccaaacttctaggggaccagctggccctctgtttctggaattttaaaaggggtcagtgaccctggtggacaatgtccccaaagtctcatctcagggtaggaatgtggtcagacagctggctctgaaccagcaaggaagggtgggcaagtaggaccccaggcactccatcaccacgatggcctgggtgtgtttgtgtggcctcattctcttcaccaggtgggcatggggtatctggcagggactaggcaggaatcaagcccggtgtatactcacatgcactgaaccctatgtagaagggattaggtcctgggggccatagatggcggttgctgggcctgtgtgctcggggcagtctctccaaaggcacagatggggtttctgaacaggacctggggagacaggcaggtgctcacaagtgctgcttcccccaactggcaaccagtgaggaaaaacgcccgagtggaggtctgacctgccccactctggagggctgatgctctctggaaaggtgggtgatgtgcagtgtctgctgtctccctgtcccccactccaaaacttcagggaaaaaataatccaagattgtcaggatgagcctggtgagggtggcacctttggggataggcccttcagcctggcagagtctcctccccaggcttcttggggagcctggactgcaaagcctgctttggggaagctgtcaaatgagagctgtgtgtgtgagctgggtgctgggcaacacgcacggacagtgttcttctccctggctcttgtagaacttgtccatggcctgtgtgttggtctcttggtaattcccaccctacccccatcacacagataagatgaagccagcatagcccaggggtggggagatgaacaggcgctaccccaggtcccctaggcatgcccatctgcctctgacatgtccgggaaagcaggtgaggccccttcttgttctctgaatgttgtcaatggtctattgcagccaaatggggacaggcaggcaggagagtgtctcatctcgaaagaagtggttcctggaagcagctgggaggtgggagaggttccccaaactcccccatactcccccatactcccccacattccctcacactcccccacgctcccccacgctcgcccacgctcgcccacgctcctcccccacactctcccacactcccccacactcccccacactcccccacgctcctcccccacactctcccacactcccccacactcccccacactcccccatactcccccatactcccccatactcccccacactcccccacactcccccacactcccccatactcgcccacactcccccacaccccacactcgcccacactcgcccacactcccccacactcgcccatactcgcccacactcccccacaccccacactcgcccacactcgcccacactcgcccacactcgcccacactcccccacactcgcccacactcccccacactcgcccacactcgcccacactcccccacactccctcacagtcgcccacactcccccacactcccccacactcccccacactcgcccacactcccccacgctcccccatactcgcccacgctcccccatactcgcccacgctcccccacgctcccccatactcccccacactcccccatactcccccaaactgttctcaggttaggaaaaggggcctctgtgacagccccactcagtggctctcactgtctgaggggtgtccttgcccaacccaggtgcgcacccatctgagatggccttgcatggacctggttgggaaggttcagctacagcaaccactggaacctgcccacacctagtgtctccactcacacgtggggctagatgttcctccctcccgtagtggcacagccagtggcagagggggcaagtcaccgctgcagttcccacttgagtctgaggggggatcaggcttagtgcccatgtatttcccaattacctggttccatctgggggcttcatggacaggagtggtgcttttccaggcctcttttccatatgccagctacaggcccaggtttccaagtttctggagcccctcttccagcctggcaagcatggcgtgttgtaggggaaggacatgaagcctacaggcagcagaacctgtctgggtatgttctctacccctggaggcccctggttgtttacctcttgggtgagagtcggcttaggatctcaacattcttgtaggacttcagaactgtgccgacaggggcccaggaaggagcagaggctggggctggcagctaaccagtgtagtgggagttgtagggctcagtttggtcttgcagggaattcagggaggcttggatttgctgaagctctagatgagcttgggcttggatatggaaacggcatggagccagggcccttctgcacactggggtctgagtagttgcactctggtgcatccataggtgttccccacctggagcacagctgtggatagaagccgggagagctgtggagggaagaggaggaggagggagtctcggggcagccccagctgccaggcagggcctctgcaagtgagatgcagatccagcctgttggccacttagcacttgcttggccgcctgcagatcacctgacctctgctcacctgtaaatgggggttgcagcagcacttaccttctgggactcctgcagcttgaaggggcagcacacaccacatgctgagaaggcgcctaactcaggcaagcttctccaacagcaccacatcagattaacatccaacctgtacaggacatcaaatctccccatccctcattccaatggaagaaaagggagtctctgtcctaggggagcaagcacaggcctatctatgcagttggcagttggcacttgacccaggttggggaaaggcccttggatacatgctggtttcaccaaccatctgtgggttgggtttggcctggacccatgtaccccaggaggccagcagccccctgcatgggacaggactgggaggtgtgtgggagggctgagctttgagggaagccattatttggcctcatgggaagtggtgcaggtggttgttggtggctcagttttgcagggcctgggtgatcacccaaggagtgaaaattgcctttttatgagaaattgccaaaactgatgcaagctcatccgttgaaaaggtgagtaatgctggcagttggcttcacctgccccttccccacaagtaactggtgttcagaggtggatttggttccttcccagcctttcccgtttgcatgtagctgtgtgcatgtacttttgtgtgtacacacacattccctggaggggttacttttatttttttatttggggggataactagtgaggcagcctgacactttcttatcttgtcttttaagtgtggagtcctctatggagtgggcatcaggtacttcctagctggcctctgccagctgtttggctgccccagtttctgcccttcacagacatgccagccacctgctgtgacattcagtggccttgtttgcagctagtgtgatgagacaagtggatcaggtacattataaactgaaaaagcacacgacatgcagagggaaagggtaaatgaccatgtgtgtcctgctcggctgaagtccacatcacatgactgagatgacattttttcacctaacatttgggccctgagaaacggcatctatgttttactttttatttatgacagagttagaagaaatactaccaggctttcttttccattttccccaactccctctttaccccctcaagtttacctacctcagagagaaagcggagctcgcctggttaatgacagcctgaaattatttgagtcaggtcactgtgtaaaggtcatactgcttctgtctccttgtgcatcacctgcgcagctcagatatttcatggctccctgtatacaggtagctgtgttaccctcctagccgctttcttggtttgatacatgcctgggagcatgtgggagcagttaaggtctaggctcatgggaggacagttctgcccaccccagctcatctctccagctcagcctgcatacctgccttcctccatctgattccagagtaggggatgggaggtctcacactgacctcaagtttatgtgactttttccacctctgctttcccagacagcccctgctgtgggacttgtaaggagatttgtgaagtcagtatctacttttcttgtgtgggtgtttgtttataaattattcccctggaggggaataaatgttagaggtactccaaacccctaacatataaacatctaagcctggcccttttttggtggtaaaatatatataacataaaacttaccattttaaccatgtttaaaggtacagttccatggcatccaatatattcagtgttgtccaaccatcgaatttatccatatctacaacttctttatcatcctaaaatgaaacaccaaaaccatgaagaagtcactgaatagaagactgatgtatttgactccataaaaattaaaactttgtatgagagaaaaatgcctcaaagtcaaaagtcaacaggctggggaaatagatctgcaatatacatgacacacaaaaagctaatttgggatatatatatacacacacacatatatatacatatggatatatgtaaatatccatttttaacaccatttaaaaaataccatcctttccccattgaatagtgttgactcccttgttaaaaatcatgaccgtgtttttcggttctttatttctatcgcattggtctttatgtctgtctctatgctggtacaacattgcttcgggtactgaagcattacagtaagtatgaaaccaggaggtgtttgtcctctaactttgttagtttttaagattgatttggctacttaggatttttttagatttcatctgaattttagaataggtttttctatttttgaatatattggaatttttatagtgattttattgaatctgtagatcgctatagataacaatggcatcttgacaaggttttgtcttccagtccataaacacatgatgtcttttcatttatttgtgtcatctttaatacttttctgccatgtttatagtttttgctgtacaggttaagtgggtttctaagtattttattcttttgatgctatcatacatgatactgttgtcttgatttcttcttcagatagtttattgttattgtagaaatacaactgatttctgtgtattgattttgtatcctgcaactttgctgaattttatttattgtatctgacagtttatttcacagaaactaaaagatttttaatatataaggttatgtcatctgcaaacagataattttactttttaaaaaattggaatatcctttattcttttactcaccttattgttttaactaactagaaccttcagtactacattaaatagaagtagtaaaagcaggcatccttgttttcgctctgagggtaaaagctttcagtctttcaccatgttagctgtgttttttgttgttgttgttttttggggttttttttgtataacattatgttaaggtgttttctttctttttataatttattaagtacattttatcatgaatgtgggttaaattttgacaaatgctttttctttaagatgatcacatgaggttttttccttcattatgttaatgtgatattacactgattttcatgtgttagaacatacttttatttcaggagtcagttatactcattcatagtgtataatccttttaatgtactgctaaatttgaattgctggtattttgttgaggatttttgcatcaacatttgtaagggatgtttgtttgtagttttcttatggtgcctttgtctggcttggtgtcagggtaatactggcctcatataataagttagaaaatgttacctccttttcaacgttttgaaaaagtttgagaaaaactgggttaattctgctttaaacgttgggtagaattcaacagtgtagccatctggtccaggcttttctttgttgctgggttttttattactgatgcaatcttcctgctgaatctccttgctcaataggtttattcaacttttctgattcagtcttagtaggttttttgtttctaggaatttgttcattttatttaggttattcaatttttttagtgtataattccttatggtactcttctacatcctttttttactccaaaagtttgttagttatgtacccattttatttttgagtttggtaatttgagtattccctttttttcttagtcaatctagataaaattttgtcagtttttatctttttcagagaacaaactgggttttgttggtttttgatatctttttctattctctatttcacttatttccactgctatctttatcatttttaaaattttgctagcttttagttgtccctctttaatagtccctctttttccctctgtttttctttccttaggagtaaagttgttgattcggtatcttattttttataatcatttatagctataaatttttcccgtgtggtactgtttttgatgtatctcttaacttttggtatttcatatttttaatttgtctctagatattttctattttctcttgtgatttcttcttttatccattcttgggtgtttaataactatatttttagacataaaatgtgtaacctacaaaattttcttgatttgttacagttttatttgttgtaagtttttatttcagaattaaatatgtgtatcaacatttgttgtgttctcataaactttgtaatacatggagatttctggtccacatatgtaagtctctacattaatattattttgaagcatttaaacttctgttttaatatttcaaaggtctaaatgaaattgagatttttggtttctgagatgaaatcatggtaggtgactgagaaatgcttaaaaattagccaaaacttaaaattaagttaaagtttactaagtcaccctgtattgctggtaataaaaaataagtctttaatggtataaaagcaaacttcagagaatgttttcttttccccagttgacatctaaattaaaagctggaaaaaaattttatggctttatgcgtttttcactttacaatttcaactttttctggttaaaatttttccaaacagattcctgtgtatttgaaagacaaattttttttagttgaaatgcttaagcagttaaataaggccatgaaactttcttgaacctgtgggaatccatgagaaaatctgacattatgttctattctcttggaaggtagaaatatcgtttgacttctgttttgctgacaagaaatatggtcctgagcaaggctccctgggacaatgacctcacacatggaaaacgctggagcccatctgtctccaatctgctgttttccaaaaattagggaacttcagttttccctttgatactctgtatttctaccaaccacaacgccagggctgtcctgcttctacaagtgacaatgacaaatataggcctgaaggaagatgagctgatggcattcccagcttactaccactccttgggtgccttatctcacatacgtggattcaactcatagactcaggtgggtgaggatctattgttcagctacattagaagtgactgcttaagactctggtgtgtggtgaaatgaggcagaattttctcaatgcagtgttaggagaattttctcctcataattaccatcttactatcactaaatcatagctaaaataaggaaattattcaagaagaaatagagatgtaatcttatgaagacataaatttagagatttgtggagagcccttcataatttcatggtgttctctttgagctgggattatagttgacatttcattataatatattagctattctagactttatgcatttatgtaaagttttctttgttgcactttaagttctgtgatacatgggcagagcatgcaggtttgttacgtaagtatacacgtgtcatggtggtttgctgcacccatcaacccatcatctacattaagtatttctcctaacactatttctcccccagcctctcaccccatgacaggccccagtgtgtgatgttcctctccctgtgtccatgtgttctcattgttcaactcccacttatgagtgagaacatgcagtgtttggttttcttttctttttttctttctctcttttctttttttttttttgagacaaactttcactcttgttgtccaggttggagtgcaatggcgcgatctcggctcactgcaacctctgcctcccgggttcaagcgattctcctgcctcagcctcccaagtagctaggattacaggcatgtgccaacatgcctggctaattgtttgtatttttagtagagacggggtttctccatgttggtcaggctggtctcaactccccacctcagcctcccgaagatctgagactacaggtgtgagccaatgctcctggcctggttttcttttcttgtgttagtttgctgagaatgatggtttccagcttcatctacgtccctggaaaggacataaatgcgtagtattccatggtgtatatgtgccaccttttctttatccagtttatcattaatgggcatttgggttggttccaggtctttgctattgtgaacagtgctgaaataaacatacagtgcatgtgtctttatagtataataatttataatgctttgggtatataccccgtaatgggattgctaggtcaaattgtatttctggttctagatccttgaggaattgtcacactgtcttccataatgactgaactaatttacactcctaccaacagtatgaaagcattcctatttctccacagcctcatcagcatctgttgtttcctgacttttaataatagccattctaactggcttgagatggtatctcattgtggttttgatttgcatttatctaatgaccagtgacgatgagctttttttcatgtttgttggccacataaatgtcttcttttgagaagtgtctgtttgtttcctttgcccactttttgatggggttgttttttcttgtaaatttgtttaagttatttgtagattctggatattagccctttgtcagacagatagattgcaaaaattttctcccaatctataggttgtctgttcactctgatgatagtttattttgctgtgcagaagctctttagtttaattagatcccattcgtcaattttggcttcttttgttgccattgcttttggtgttttagtcataaagtctttgcccatgcctatgtcctgaatggtattgcctaggttttcttctagggtttttatggttttaggtcttatgtttaagtctttattccatcttcagttatttttttgtataaggtgtaaggaagatgtccagtttcaatttctgcatatggctagccagttttcccaacatgatttattaaataaggaatcctttccccgttgcttgtgtttgtcaggtttgtcaaagatcagatggttgtatgtgtatgctcttatttcagagttctatattctggttcattggtctatgtgtctgtttttgtaccagtaccatgctgttttggttactgtagccttatagtatattttgaagttgggtagtgtgatgcctccagctttgttatttttgcttagaattgtcttggctatttgggctcttttttggttcatgagaatttttaaatagtttcttctaattctgtgaagaatgtcattggtagtttaatgggaataccattaaattcttttataaattactttggggagtatggctattttcacgaattaattcttccgtatccatgagcatggaatgcttctccatttgtttgtgtcctgtctgatttctctgagcagtggtttgtagtcctccttgaagaggttcttcacttctcttgttagctgtattctgatgtattttattctctttgtagcaattgtgaatgaatttcattcatgatttggctctctacttgcctgttgttgatgtatagaaatactagcaatttttgcacattggttttgtatactgagattctgttgatgtggtttatcagcttaagaagcttttgggctgagatgatggggttttctagatacaggatcatgtcgtctgcaaacaaagataatttgacttcctctcttcctatttaaatacctttatttctttctcctgcctgattgccctggccagaaattccagcactatattgaataggagtggtaagagaggccatccttgtcttgtgccagttttcaaggggaatgcttccagcttttgctcattcagtatgatattggctgtgggtttgtcatttatggctcttattattttgaggtgtgatccttcaatagctattttattgagggtttttaacatgaagggatgttgaatttcattgaaggccttttctgcatctattgagatagtcgtgttgttttatgtttagttctgtttatgtgatgaattacatttatagatttgcctgtgttgaaccaaccttgtatcccagggatgaagccatcttgatcgtggtgggccaagctatccttaacagtcttaagttcagtctttttacataatcccacatttcttgaaggttttgttgttcattcttttttgttcttttttctctattcttttcttcctgtcttgtatcagatagttttcaagctctgagattctttcctccacttggcctattctgctagtgatacttatggttgcattgtgaagttctcatgttgtgtttctcacctccatcaggtcagttatgttcctctctaaactgaatattctgcttatcagctactgtgttcttttatgatttttagcttcttgcattaagttagaacgtgcccctttagctcagtgaagtttgatattacccacctcctaaagcctacttttgtcaattcagccatctcagccttgggtcagttctgtgcccttgctggggaggtggtgttgtcatttagaggagaagaggcattctgcctttttgagttttcagcgtttttgtgttgatgctttctcatctttgtgggcttatctacctttgatctttgacgttgctgacctttgaatggggtttttgtggggtcttttttgttgatattgttgttgttgctttctgtttgttcttaacagtcagaccactctttcctagggctgctgtggttttctgggggtccactctggaccctagtcacctcagtctctcctgcacctggaggtatcaccggtgaaggctgcaaaacagcaaagatggcagcctgatccttcctctgggagtactatccaagtgggtaccgacttgacgtcagctggaacgctcctgtaggaggtgtctggagacccctgttgggaggcctcacccagtcaggggaaacaagatcaggaactgcttaaagaagcagtctggctgccctttggcagagcaggtgtgctgtgctgtgctgatccccgggagtctccagagccagcaggctggaaaggctcagccagctgaactggggagatagcagctacccctctccctggggacttcatcccagggagaaatcagagttctgtccatagaactctggctggagttgctaaaattccaatggggaggccctgtccagtgaggagggatgtgttttggtctcacttaaagaagcagcctggccacaatcaggcacagcagctgtgctgtgttatgggaaactcctcctggaccctggtgccagcaggctagagtggccaactcaaaccacagatatagtggctgcccttccctccaggaactcggtccatctctggctgtctccagcctgctgcctctggccagctggaattccaagccaatgggttttgtgaggtgctgtgggagtggggcctcagaatgatgtcacttggctccctggattcagcccccttcctaggggaatgcacagatgtatctcccactttgctggaattctcggggcataggatgcaaaactcctgggtttccacgcatgccccagtgagccagcgagcattccgccgagactccacacagctctgtgcttcagacccaaggccatggtggctgagctcaccgggggacctcccaatctgcaggttgcaaagatccgtggggaaagcatggtttcccaggcagtcacgcaatcactcaccgcctcccttggctgcgagtgggggctccctagctccgtgccacacctggatgggccatcaccccacttgcttttcctcactccctgtgggcctagtgggcctagtcagtcccaatgcaagaacctggatacctcaactcaaggtgcagaagtcacttgtagttttcattgctctccatgagagccatgggccacagctgcttctaatcggccagcttggccccatctaaagtatgatttcttaatacatgagatgttttaagtacatgacaataatgatatttatcacaaataatattttatctcaatttcatataaaaattgctaacaaatcaattatttttggttaccacaaagctatctggaaatgtaacatctgccatttataaaatttctgtagagttaatagaacttttcctgaagggaggccggcaatatgcatcatgaattcaagcactaccagtgaagttgtggagtttgaagtggtactcacatcttgttactgggattataaattcgtacaaactttatctaatgtgattaaacaatatataccaaaattatcagtggaaatactctctgattcagcaatttcatttccagaaatttaccctacagacatactcatgatgcctggaattatgtatgaatgggagaaagtattataccacctttttcattaacaaaagtctggaaatcaccttaatgtttatcagtcacattaatggttatcaccttactgtgtattgaaattatggttattcatacgatagcatactatgcagctatttaaaaaaataaattttaaaaggatgctcaaaaatgatgtccaatatatgttacaaagtaaaaacaaccctgggtgcagagccatgtgtctgatatgcctccattcctataaaatcagagtgtgtagaaatgcatagaatatctctattaactggtaactgttacaaaattcaaagttaatgcaggcaagacctttcttttttaatgctaacactccaaggaactgcacaacatttgaggattcccaacacatgccaatctacctttgaacctatagattttaggaaatgaggctcttgaaaaatcaagcattaatattcctagctacagttgtttgggacataattagaatgatccattctttgaaagtttgtaaaatttgctcatacaaccatctgggcctagtccttcctttgtgaaagattttattttactagagattttattttcttcacattatagtacttcttaggttttctatttcttcttgattcttgagtcaattttggtaccactttgtaccccacagggtgcttgggctcagaacacatcagtcaaagaaagagagaagaaaggaaggcaggaaggcagggtgaaaggaaggaaggaaggaagaaggaaggagacaaggaaagagagagaaggaaggatggagggagagaaagatggaaagagagaaagaaggaaatgagagagagagaaggagagaaggaaggaaggagggagagaaagggaaagaaggaaagaaacaaggaagcagggagggagagaaagaggaagggagaggaaggaaggagggagagaaagagggaaagggaaagaaggaaggaaagaaacaaggaagcagggagggagagaaagaggaagggagaggaaggagggagggagggaaaggagacagggagggagagagggagggagggaggaaaagaaagagagaaaggtgaaaggtggggacgggaagggaagaggagccagccaaaggctacaggctgtttgttcactcttctacttgacccaagcagttctgccttttaaatattccaccttctgccatgagttacactgttcaatattcatttctcagagcattcaaaggtctatgtgtgccctgccatgatggaccatggcttcagctctcaaacacaaccctcagccaaaatattcatgactgttccctcccatatactcatcaatcccccatgctatggtctgcatgtgtcccccagagctcacgtgttgaaaacttaatcctctatatgacagtgttgagaggcggggcctaataagagtgattaggttataagattctgcccccatgtatggattaatgtcattatctcaggagtgggttagttatcttgggagtgggcttgtattaaaagcatgttcagccccttttgctctctttctttcccaaactcttgctcttctgccttcagccatgagatgacacagccagaaggccctcacgagatgcagacccctcatccttggatttcctagcctccagaactctaagaaataaatttcttttctttatagattccctagtctgtggtattctgttatagcagcacaaaatgggttaagatgccccattacatggagagtgctgatccacagggttcagatcattgacttagggcttggagtcttatacaacatccctatgggagttgacctccatattccctatcttcccggaatcgcaaatggtgatttcagaccaaaatatagcccagatattttgcatttggcaatattgccgacttttccacaactttatcatggcaggtttgatgtgctcacttctatgatccctgaaaggatatgggttcaagatcctgcaaggttacaatccaaggatagaagagcctagacaagagtcccatcacctgggcgatcagtgcagagatatgtcacaaagcccctgtaggcagagcctagacaagagttacatcacctgggtgacaggcaaacaacaatgacaacttattttcatccccacttcagtctttgaggttagacagacctggattcaaatccaagctccacccctcgctgtgtgagtttgctcatgctgctaacctctctgagacttgactcttcatttatgaaatgaggataaagccccttctctcaggggctgtgccaaggatgaaatgagtcacgcattggtcaggacaggtgatgctgtgtaacaagcccctaaacctcagtggcgtcaacagcaaagttgacttcttttcttttttctattttttcttttgttgggggggtggggaggtggatggagtctcactctgtcacccgggctggagtgcagtggtgcaatctcagctcactgcaacctccacctcctgggttcaagtgattctcctgcctcagcctcctgagtagctggggctacagatgtcagccaccaggcccagctaattttttgtatttttagtagagatggggtttcaccatgttagtcaggatggtctcgatctcctgacctcatgatctgcctgcctcagcctcccaaagtgttgggattacaggcgtgagccactgcacccggccttgacttctcaattgatttcacatccatcacgggtcaacaagggggttctggtggtcgtagtcaatgagccgagaccatgccactgcactccagcctgagtgacagagtgagacttcatctcaaaaaaaaaaagtctcaggctatgtctgaactaggagggtagaaagaatagtcattttggttgccacaaaccatcgaaacaaagatgcagatcattgatgtaaaattacagttagttccttcccactccttttcagcttctcttcgttgctatgacccagcgtctcctgtgtcagttttcagtctattgtctcccagcttctagtgcacctttcaatatgtgcactgtgataaactgggaagcacttttcaatataccttctggaagtgaacattctgcaggcatctagatagaggatggagagactgcagggggcaggagctctctggctgggccttgttcaagccccaaccacagagacctaggcatggtccctcagccaccttgcagccttggctagcaacatctcgacacggaaaccaaaacgcagcagagcccatgtgatctgaaggttcctgaaaagttgcccagacctcctcttgtacccacatacaaagagtgtgtccagggtcatgagtgagcatgatattacagaggaatgtaaacaggaaaaccatagcatagagcagtggggatccatagctcacagtgatagcatggaagtttcctggttacatgaagtaattaagacgtatttaaaagccaagagtacaaaattagacctgatgaaaaagcaggagttatcatcccagccatgcagaaaagccaagccttctctcccttctcaagaaggaacagaagacaatgatgtgatctgtgagtcatgtgtaacatgaaagtacaggaaaagttgaatttctgatacacaaatctgaaaagtttttatagtaacagatttcaggattaaaagtcaatatttattacttcattaagagcaaataaatactttaagaaaaccttgttgttttaaccaaaatttttagttttgtatcactatgtttttaatattatacctaatttaaataaactttataaacaatctatctgatctcaatcagttttgacctcgaggtaagatttacgtaaacttttaataaccttgtataattttttccatcttttccaactttttatacacattttatctatcttttttattccttcaatttaaaataatccttaaaaatctctaagcgaatttactttctctgaaacaaaaaccggtatacattttgcatacagaattgtttctcttgtacctagtagtcttaatcacatatatctaccacaatattaatacttagtaacctttattttaataaaaaacctaggaagcaagaaatcttgaattgtcatatagcagtatcttacagatgagaataatttcataatttagaaatatgtgttcctaaaacatttttttttaagatggagtttcgctcttgttgcccaggctggagtgcaatggaacaatctcggctcactgcaacttccgccccccgggttcaagtaattctcctgcctcagcctcccgagcagctgggattacaggcacccgccaccatacctggctaattttttgtattttttagtagagatggggtttctccatgttggtcaggctggtcttgagctcctgaccttgggtgatccacctgcctcagcctcccaaagtgctgggattacaggcatgaggcaccacgcctgggctaaaacataagtttttaaattggaaataacccagatagttaatgagtatctattatttaatttaacataactaaaatttcaaaaataggctgggcatggtggctcacacctgtaatcccaacactttaggaggccaaggcaggagtatcatgagaccagcctgagcaaaatagtgagatgctaactctacaaaaaaaataaaaattagctgagcatggtggtgcatgcctgtaattacagctacttgggaggctgaggtgggaggatcccttgagggcaggaggtcaaggttgcagtgagctgtgatcataccactgtacttcagcctgggtgacagacagagacactatctcaaaaaaatttcaaaaatacattaagatgtcttggatagacatgtatccatttacatttacttatttttaacagtttatctagagtatttgtgagaactgaggtattagacaaagctagtcatcatttctaggttattttcttgttaaccatgttatagcctgtgaatatcaggtgttcacgtaagtgaggacttcaaagttaaatacatgggtattttaccaataactcagaaaattccattacttttgttcaacaaaccgtattaaattggtcttatgtattaaaaaaaatcacaaaaacaaatattcctttttttcctgtgtttatagctttataaccttcatgccaaaccctagcaccttaaaatatctagcaaatgtaaatataaaacacagtcaaaaatgtatgctgacaattctgaagacatttctattttccttttatccatactttttaaattatttgtatttataaaagaactcttttgtctgggcacagtggttcatgcctatatcccagcactttgagaggctgaggcaagaggatcacttgagctcaggagtttgagaccagcctgggcaacatagcgagaccgaatctctactaagaataagataaaaaattgccaggcatggtggtgcatgcctattgtcccagctactggagaggatgaggcaggaggatcacctgagcctgggaggttgaggtaacagtgagctctggtcccactactgcactccagcctggggaacagagtgagaccttagagagagaccttgtctcaaaaagagaaaaaaataaagaattatttcattcttttgtttttcttcagccaagtaaccttgaattggtaataccacagacagtaagtttcatctcaacaccagtagacaagtcagcagattcaaaataggcagggaaaaaaaaatagacaggcaaaagaactgagattttttcattttagggtttttaaaaatataaactatttgagttctgaattttctttcatgttattcggccatcaggtttaaagtgtgcactagaagccaggcgtggtggctcctgcctgtaatcccaacactttgggaggctgaggcaggtggatcacttgaggccaggagttcgagaccagcctggccaacatgacaaaaacccgtctctactgaaaatacaaaaattaactgggtgtggtggtgtgcacctgtagtcccagctactcgggaggctgaggcaggagaattgctcaaacctgggaggtggaggttgcagtgagccaagattgtaccactgtactccagcctgggaaacagagcaagactctgtgtcaaaaagaaaaaaaaaaaaaaaaaaaatatatatatatatatatatatatatatatatatatataggcctgtgcgcagtggctcatgcctgtaatcccagcagtttgggaggccgaggcgggtggatcacttgagatcaggagttcgagaccagcctggccaacatggtgaaacctcgtctctactaaaaccacaaaaattagccgggcatggtggcacacacctgtaatcgcagctactcaggaggctgagacaggagaatcactagaacctgggaagtggaggttgcagtcagccaagatcacaccactgcactccagcctgggcaacagagcaagactctgtctcaaaaaaatgtgtgtgtgtgtgactagaatggtctataatatatagccagctcgagtcccagaaaacctagcaagcttaaggttagagcttctcattttggccttttcaagattaaatctcctttagtaggcccctcccctctagggaagtacttgccggagcgctgcctaaagttggttttctgatgccctgttgtttctgttctgaatggtttatttctcattataagggctcagcaaagcaggcagagttaaaaagcagagacaggaagaatttttaaaatcgtggacttcactcctacactgaatctcaggtccccagaaagacagaaacaccatgggaccacagcaaaggcaggaggaggagtgagggagggaggtggacagaacaacaaacaggagttggctctcagtttttcacgtgtgccattttctttaggtttttctagtttatggagtctctttgttcaagttgagcacacagataaactagagatctcacaaggcttttgctgagaccatcaaagcctttaacctctgttgggccaaatattttagaccaaaaatacagatagacacacaaaagccagaaccagaccagattgagtatctcagtggctgcagcctttattccctttattctttaggatttgaactcaaaccagattcagggttctaacccaaccaggatccccctggggtgaaactgaaacccacagtctagacaaggttgggggtctttttttatttttattttttcattttttttgagacggagtttcactcttgttgcccaggctggagtgcaatggtgcaatatcgcctcactgcaacctccgcctctcgggtttaagcactcatcctgcctcagcctcccaagtagctgggattacaggcatgtgccaccacgcccatttaattttgtatttttagtagagacagggtttctccatgttggtcaagctggtctcgaactcccaacctcaggtgatccgcctgcctaagcctcccaaagtgttgggtttacaggcgtgagccaccacgcccggcccgcttgttcttttcatttcatcctgatgtccgaatacaggagagtagctgagttggtgttcactaacaagcacggaagctttgttacatttacagtgtcattcttggcaaaacctgaagttttgcctcccgggttcacgccattctcctgcctcagcctcccgagtagctgggactataggcgcccgccacctcacccagctaattttttgtatttttagtagacacggtgtttcaccgtgttagccaggatggtctcgatctcctgaccttgtgatccgcccacctcggcctcccagagtgctgggattacaggcgtgagccacgcgcccagccagaagctctgtaatttcaatgatgattgtgcttttaatctctttctcggcatctggctcatgataaagtttcaggtgtcttgatggtatctaaatcagttgttgattcggtcctggagaaacacaagcataacctctacgccaagttattattttacctatttcccaactttttgttattggatctgtccaccaaaccagttgttctgcttgtgtctttgcagctggtttctgtagatgctgttcagctgctggtaacatctggcctttgggaaggctcgaaaaatggaaagttaataatgcaagattcaattgtgtctgggctgtcccgtaatccctgtttccccccttttttgtttttattatcagttgttcatctgtatgaaatcgtaactgagcattttcaattaactgtgtggaatgaaccatgtatgaagaatcagaaatcacattaataggcatatcaaaagcagtcaatacctcaattacagctacaagctccactttttgagctgaaatatagggcgtctggaaaactttaccttttgatccagaataagaagctttaccattactggacccatctgtgaaacaatgaaaacgcttagcaggctgcaggttgtttactgcaggaattgtaaatgcaaatcgttcacagtcttgctcagctaaaagggtagtaaagaaacagtcttttaaatctgtgactattaaaggccaattttttggaattatagtaggagaaggcaatcctggctgttatatttccataggttgtataactgaattgatggctcttaagtcagttaacattctccatttacctgattttttcttaattatgaaaactggagaattccaaggggaaaatgttggagctatgtgcccattttctaattgttcagtaactaatttctctaaagcgtccagtttctctttgcttagcagccattattctatccatattggcttatctgttaaccatttgtaaaggtataggttctggaagcttaacaacggccgccgtcaaaaatgatatcctaatctttggcaggaactttgtctttccacttgaagcagttctttcaaaccttgcaaatattttcctagtcccataccaggaacatgccccatttcatgaattatatgtcgactttgagggctatataattgttctggaattagaacttgtgctccccattgttgtaataaatctctcccccataaatttataggtacagaagttataattggttgaatagtcccaggttgtccattgggcccttcacaatgcaaaatataactactttgatatacttcaggggctttaccaactccaactatgttaaattgagtgggttgaattggccacgcggacggccactgctgtagagaaataattgaaatgtctgctcctgtatctaccaaacctttaaagttctttccctgaatagttatttcacaggtaggacgtttatcagtaatttgatttacccaataagccactttgtcttgtttatttgtgcttccaaatcctcctgttcatttaatttcacttttccccattcccacatatggcacaatcaggagccgatctcctggctctgctttccagggaacagaagtagatataacaatttgaatttccccattgtgatctgaatcagtgactcctgtatgtatttgtaccccttttaaacttaaactagacctttctaaaagtaatcctatcgtccctgctggcaagggtccacagactcctgttgggaccttttgcaggggttccccaggcagagggctcacagcttttgtgcagcataaatctactgcaacactaccagctgtggcaggggacagacattgtacggtggggagggaatggcctgagttggaaatgccccggtttagaacgggcctaggatgggcccctcatggtgtttcccgaaatcgggttccgttcttcatcaaacttagagtgacattggttagcccaatgatttccttttttacattttggacatatttcagcttagcagttctcttttttcccctatctgacagccgactcactgattttttttctacattcttttttagtatgaatagcttctttaaattctttgagtaatttaaaaggaaaaggttcaaatgtagctataatatctccctgttgatctggggggtgtattctaacagggaactgccaagcctctaaatcaccctctcttctagcttgctgaattcctgcctgaatagaactaagagcagtcgctccaggcgctgctcagtcactggggcaactacttttcgcccacagtcctctggaaaagaaatacctggagggtcattttcttcaaaataataatgagggggtgcagaagggtagggatgaacctctccctcctttgccgcttcagctttagctggcaaacaaacctggtctgtaacctcttctgttacgtcgctatactctccttcctcctcctcatcagtgtgaaaaggttccaaggtgaaacgaaccagaccccacgcctgtcccattgttaccctgatgcttccgagctccccttcttactcaccacggggatggctttaagagtactcaggtgtcctccagctagttccacgttctccaaccgtcgctctggcgacccttcgacctggattcgagcccccacgatggacgccacttgcagagaccagctcggtcaggaagaccctaacccagcggcactagaggaattaaagacacatacacagaaatacagaggtgtgaagtgggaaatcaggggtctcacagccttcagagctgacagccccgaacagagatttacccacatatttagtaacagcaaaccagtcattagcattgtttctattaactaaaagtatcccttacgggaaatgaagggatgggccggaataaaggggtgggtttggctagttatctgcagcaggagcatgccctgatggcacagatcgctcatgctatgtttgtggtttgagaacgtctttcagcggttttccaccctgggcgggtcaggtgttccttgccctcattccggtaaacccacaaccttccagcgtgggcgttagggccattatgaacatgtcacagtgctgcagagattttgtttatggccagttttgtggccagtttatggccagattttggggggcctgttcccaacagtaaccaatattaagtcattctcatttcaacatttaaactcttccaactgaatgcattaaaaaacaaaagtcacacaccactgtaccccttatatgtacacagcggtcggcaaacatgtgacaggtggaggtcctgaggcaccactgggagcttgtgagcggatgggcgtcttccagaacgcactctgcaggcactcggcaacgtgaagtgttcacgtcctgtgatgcagcctctgctccaggccacttccggaactgcgagggaacagctgtgggcgcgctcatttcagctttgcttcagatcctgggagttgggggcaccttctttttttttttttttttttttagacggagtcttgctctgtcacccaggctggagtgcagtggcgcgatctcggctcactgcaagctccgcctcccgggttcacgccattctcctgcctcagcctcccgagtagctgggactacaggcgcccgccaccgtgcctggctaattttttgtatttttagtacagacggggtttcaccatgttagccaggatggtctcgatctcctgacctcgtgatccgcccatctcggcctcccataaagtgctgggattacaggcatgagccaccgcgcccggctgggggcaccttctggcccacagtgagggaataagcaaaccagaatggggggtgcctgcacggaatactcctaagtgctcagacacggcgtccacagatggatccaaatcagtgctggatgacgggcactcaccccaggtctgcagtccaataacacgggcctgagcagaaagcacgtggcatggagccccgtggcagatatggggacgagcggccaatacatcagctcaggtgtccgaggggtttcagggacatgagagagagtggggaacgaagggggaaatcgcttggagacccaggacgagcctggcacaccaggatgctgattctgaaagggcgattaaggagattccatgttttaaaaatctggatttctggcttcttctgaaaaaaatcagaagatgtttagcacaacagcgtggcatcgtcagctgtactcctgccccactgtcccccagggagcctggctcatcccatggctcacagaggcccacactgtggccagacaggtccactgatggctcagcacgtgcaccccggctgcagggagatgggtaccagcccaggaagtgggacactggctgaaacaggatgggatgcagggatggggtgggatgggagaccaaaccagtgtgaggaatgaggataaaggagatgctggagataaaatctgggcaagtaagcagggggtggtcctgctggctgaggccagagatgccagcccactcagactcctgcgctggcccttccacaccatcccaggcccaaggcctcccacacacagcgtcacatacacaaacagcaccctcctcatggcaacaggtgaccctgccccttcacagacctccctgcccccacagtcaccccacattttaaagggaacttgagtccatcctgatatgtaaacgtgaggttaaatatctatcatgggggagaacagacaaatctccagtgcagaatagttctaaataacctaagtggaggctccactcttgaggagatccagcctaactccccacctctccaacgcggctcatcgcagcgacctccttcttccaacgtggctcatcgcagtgacctccttctcaggagtgcagagtggaggtcagtggtggagtgaagacggaccagggttaacatcggcagtgatcacttgacctctgcacacttgactctgggtctttctccccaaaaaaaaccagaacctcagtataatcgtgaggaaaatagacaaatcctaattgagggacattctccaaaatacctgactggccctcctcaaaactgccaaggtcatggaaaaaggaaagtctgaaaaactcacagtttaggaacctaaagagacttgattactaaatggaatatatcctgggatcctggaaaagaaaaggacattatgtaaaaactaagaaaacctgaataaaatgtggcctttagttaataagaatccatcaatattggtgcattcgttgtaacaagtagttgtaacaagtgccacgctaatgtaacacgttagtaccagcgtaactgggtgccaggcgtttgtaaactctgttccgtcttctcaattgttttgtgaatctaaaaccgttctttaaaaagagtttatttagtaggctgggcatggtggctcacacctgcaatcccagcacttgggaaggccaagactggtggatcacttgagctcaggagttggagacatgcctaggtaacatggcaaaaccccatctctactaaaaatacaaaaattagccaggtgtggtggcgcacacctgtagtcgcagccacttgggaggttgaggtgggaggatcgctggagcctcggaggtcgaggtggtagtgagccaagattgcaccactgcactccagcccgggcaaccagagtgaaacgctgtgtccaaaaaataaaaaaagagtgtatgtaaagtgaaaacagagagagtacaagaaaagagggaaaccaggggctcagtggaggtgggcaggggctggtccatgtgcattcagcccacctggttggcagctgcccaggtgtctcctcaggtgtcggaacaggagtttcttccacagccttcagtttgctcaggtgggcatgtggcgatggcagacccttgggctgtgagaaactatgttgctgttttatccaagtcttcacagaccaaagacggggctttgcccagaggaggccttgagaagccaggctggagtttgtggagagagtgtgtgtcactcacaggacatatgacgcatttgcaacatgcgttctcaaagtgggagccacagcagtgttcgttttactattgctgggcctgtaaatggagcgttttatctttttcgtcagctggttcattgaacaagtgtttacagagcacctgctaggcaaatccatcgtgacagagactcggtgtgcccccaaggagctcacagtctagcggtaaagatggtgcataaactccctgacactcagggtggcaacagccaccccacctgctcctccctttcctaatgcccacacggagcagacactcgagggctgcttttaggagtgctgactacatgcttccctacctccatgtaggcatgtgtgtacacaagcgtgtcctgttttcaccttttcacaaaactatgtcaaaagtgaaacattttggaatacatttccagttatgcaaaatgtttaaaatatgaatttcttcggttaacacaaattaggcatgaaatgtaggcaaccctgtttaccaagaaacatcagggtgcggtgtgggtctgggaggtgcccatgagcacctcatcttgaggccagtcttcatgctagaccctgggtggagagagcgaggcggctggaggtgggtgtgtgacaccaggtgacttagcggccccaggagggtgacttcccctccggaggtgccatgcgactgtacagctcaggagcactcggggtcacctacaggaggggcaactcctgggtgtctcccaacagagcccaaaacctggaagtggacagagcaccccccgctcatctcctgggccctcgtctcagaggaaggacggccattctggccaacactgaccaatgctccagcccacactgccctgcactgcctagaaggagaacctaggctgggctcccagacaggagagaggggtgcgtttgtggggctaattaatagtaataataggccgggagcggtggctcatgcctgtaatcccagcactttgggaggccgaggtgggtggatcaccttagctcaggagttcaagaccagcctggccaacatggtgaaaccccgtctaaaaatgcaaaaaaactagctgggcgtggtggtgcctgtagtcccagctactcgggaggctgagacagaatcacatgaacccgggaggcggagcttgcagtgagccgagatcgcgccattgcacccagcctgggcaaccagagtgaaactctgtctcaaaaaaaaaaaaaaatcgtcataataataatcccccctcacctgagttctgggaggtcaatccaggttcaagattcctcctttgaaaggtagactggatttggatacagagggtgcccatgcgtgaggggacgagggggcccgggatgcgggtccgtgtgaggggctgaagagttgcccctgtgctagtcagtgccgccgccataaccgagccccgccggctgcgcggcgtcttcagcaagcgtttatttgctaattctgggggctggaggtccgcggtcacggtgtccacagactgacttctccagaggcctctccttggcttgtggacaccgtcttctccctaaatcctcatctcctcttcttatacattgtatcagggcccgccccatgaccccatttcaccttaatcgcctcgttaaagaccccatctccaaacaaccatattctgaggtcctgggggttagggcctcagcacaggaatttggggcggggggacacacactctgacttcgcaccacctccccaccactgcgtggtgtgtgctgcggtttagcttgtgtgactgtgatctttttcgtcaactggttcattgaacaagtgttcaacgggccctctaagaaagtaattaacgtcaaatgaggccctaagggtggggccctgatctgatagaattcgtgtccttataaaagaggcaccagagcacccactccctgtctccgacgtgtggggacagaacaggcggccatctgcaagccaggtaagagccctcgccaggaaaggcccagctcacaccttgaccctggacttccagcccctagaactgtgagaaaattaatttctgtttaacctacccagtctgtggtacagtcatctctcagtatctgtggggcactgattccaggatccccacagataccaaaatccacagatgttcaagtcccccagtgagccgtctgcatccatggaggcagccccagccttggagaccgactgtgtttccttagggcagccctaggcgcagcggtgcaaggagagccacatttacccctggcgctgcacggccctgaggctgggcaaggctgtccaccccgctgtcagaaccccagcagggaaggtgtccagaaggcagtcctgggaaccctgcacagaggcccagcgggcacaaggttggggcagctctgttcccagcaggccgagcccgggtggctggagagggagctctggaaggtcagcctaggggccgtcggcccctgcagaccctgtgcccagcccagcatcccggggagctccctccacatgctcatctcacgaggttcctgctgcactcagagtggaggatgggaggcctggggcggagggccggggctttggaatggctgagggggacaaggatgcacaaggggccagtgcagaggacagcgcgactcccaggggcccggggtcctggtcttcctggtcctgccgtttttattagaagcgagccctccaccccagtgggtgtagagcccaggacgcagcagagggtgggggggtggggggcggcatcggggcaggtggcaaccccttggacgcaggctcaggacgccagggtcagggcgtgagtgccggggccccctcaaagccgcggggtccaaagaggccgccggccccggccccgccctctgctcctcctccccctccaccgccaggcccgggtggccgccgcctcctccgaacgcggccgcctcctcctccgaacgtggcctcctccgaacgcggccgcctcctcctccgaacgcggccgcctcctcctccgaacgtggcctcctccgaacgtggccgcctcctcctccgaacgtggcctcctccgaacgcggccgccgcctcctccgaacgcggcctcctcctcctccgaacgcggccgcctcctcctccgaacgtggccgcctccgaacgtggccgccgcctcctccgaacgtggccgcttccgcagcgcccggcgcaggccgcactccgccaccagggggcgccacagctcctcgcgccgccgcctcccgcaaacacaaagagccgcgcggccacgacggccgcgtgcccggagcgccggggtctttcctgggctccaaagtcaagagctcacgttccgggaggatctgtccgcggaaattcggttctgagcgtcgccggactccgccgcggggaggcgggtgaggggagggggccggagggtcgggggtgccggggggtgcgggaaggctgcgggggaggctgttggggacgttcgtggcgggggaggctgttggggacgttcgtggcgggggaggctgttggggacgttcgtggcgggggaggctgttgggtcccctccccgccccaccgcgtcccagggaaccccggcagggcacccagtgaggggggcccgggcgtccgcccattcctcactgctgtccccgcctgtgcccgaaacccccgttcacgttcaccgagaaaacagacataaacccagccaggcacatccactagaatggctgtgatttcagaaaagcggacgtaagtgctgccgaggagatggaggcgttggaccccctcgcgcattgtcggggcgggtgcagccgcggtgcaaaaggaccttcctcagaaagttgagcacgaagttcccacaggcccggaagttcccctcccgggcgctccccagagagctgaagactgggcgcgtgccggcggcaaatgttcacagcaaagggcggcccagtgcgcagctggaacatcagccccaggcggtcgctgcgacagggacgagcctgggaaacgtgaaaatgtccagaacagggaatccacagataaagaaaagacatcgtggttgccagagctcgcgggagggggcaacagggaccgactgcttaacgtgtatggttccccttcagggtgaggacgtgttctgggacgaggtcgaggtcagggttgcaggacaagatgaaagcgctaaatgccactgaattgtttgctttaacgtcattaattttgttatgtgaatttcatctcaatagaataaataggtcaagctggctgcagggcccaccccaccgcggcctggagcagggtcttctggggtgtaccacctctgccctcacccaggctccaccacgaccagcttcgtccaccccccaggagaccatgaaggcccacgtctgaaatcctcactaagcccaccctcccatctccctgaactacgggtaggacccctctggcccccagccctgcccttgacccggcccaccaagcccccacccagatccacaccaccaggcactcttgcccttggcctgctgccaggctggccccgctccttctgggcctcctggagcttcaacccctgcctccacagcagaccttggcctttagcatgttcagtctcctcagtggcagccccgggagggccatcttcttgggtcaaagccctcctcactacccaccctcttgccaggactagctgtgtcctgcagcagcccagcatgtgccgttgagctggccttttctcaggcccagtgcccaaggaggagctgattgcataggctcagagtttccaggaagagtggggactcagatgtctgcccaggtgtctccaccgcgtccgccagggcctccagctttcctaaccaggaccctggcctctggccttggttgagtatttcaccttcttccatgtttagtcccttgggctctgctaccctcctgctggaggtgagagcatcctgtgtgcaaccagagatgccctctggctttcagacctgcctgcttttcaccctcagccctttctcactcagcaaaattgtgggggtccctagtcagcagctccctgggcagctctctgagcaaggtggtctctgtggtcatgaaggagagccggctaggacagtgccggaaactcagctgcctctccccttcaactcagctggccccccgcacctgaagtgcacaggagccgggaagagagtctggagcccaccccggagggcagcacaggaggtgtctctgcagctggtgtcctgccacccctgcaggcagcacacgtcccgggcattctccttagccacagacagaacagccagtgccagagtctgctgtcgcttcccctttaagcacactcattcaccacacccgaggaggccagaggtgcagggagcatgggctgtcgcttcccctttaagcacactcattcaccacacccgaggaggccagaagtgcagggagcatgggctgggtgcacctccgcaggagagaaggctgagccaccgccgtcccgggagcccggctcccaggcctctcgttttcccctacctccctaagacttttctgtcactctctggccattgaaaggcttctgttccttaaagtgctgttacactctcctttcccaggatgcagcaagccaaaacagtaccactgcacgtcagcctgggtgacagagtgagaccctatcttaaaaaaaaaaaaaattggctggacatgatggctcacgcctgtaatcccagcacttagggaagccaaagtgggcggatcatttgaggtcaggagttcaagaccagcctggccaacatggtgaaaccccatctctctactaaaaatacaaaaattagcatggtgtggtggtgcatgcccataatcccagctactggggaggctgaggtgaaagaattgcttgaacccaagaggtggaggttgcagtgagccgagatcacaccattgcactccagcctgggcaacagagggagactgtgtctcctaaaaaaaaaaaaaaaaaaaaaaaagtcttctttccatgatgagaatgtcaggccctgcagcctcttgcactggccagaggggctggggtcactgtctgtttccttgcccaccctcaagggacaaggaggagaggtgaggctgtgggcgcacctgattttacctgctggagtctgtgttctctgggattagggagcatctggagctgactcttcctccatgggaccctccctttttcaggaaaacttcccctcctcggggatcccgcagggctaagaaacaccctcttcacctccctcctgcccggtccttctgaccagccgagagagtacagaccctccccgatctgggaggagggcccatcactggctccctgccccctgctcgccaagccccccgggacttcccaggctgttccttccacctgaagggtctccctctggccaaggcgaggctcacagttcccctgtcaggatggggccttagacacccagactgacccagtgacaatcaccttaattctccacagataactacctacaagttttctgatttattcattagtggatttgttcgtgatcagccccacacctgttagaatggaagctgcaggcagcaggaaccagtgtggccaagtcggagggcagcacaagccggtcctcctcgtggacagcaggtgtggagcaggccaggcccacaggagggcgggcaggagggcaggcaccgagaggtgcggatggcctctcagaacaggggtgcaggctggtgggggcagcagctggaaggggaaggtcacagagccagaaagatagggtgtccgccacagccagttctttggaagtttccctgaaaaagggaaaagagacaagatatggttcaaaggaaagcagggcctgggagaggcctgtgtgcagtgtgtctgcaaagggaggaggaggcaaagatactgaaggtgaagagggaaaggaggaagggacaggggaggtgacagagggaggggagggggaggaggggcgggggagaggagggaaaagggggaggcgatgggacgggggagggaatgggggaacaggtgggaggggaggagggggtgggggagaggagacaggggagaggggagtagggggaggggatgaggggaaggtgggaggggagaggggaggggatgggggagggaatgaggggacaggtgggaggggagaggggacaagtgggaggggaagggatgggggagggatgaggggacaggtgggaggggagggaatgaggggcaggggggaagggagggatgaggggcaggggggaagggaggggggtttggccctgcagcaggtgggattctgctcagcccatttcctgggccacgggattcatgaagggcaccgggtcaggccccccgggcgcaccgttgctggtatatgcggtgatcggggtcaggcccccgggcgcacctttgctggtatatgcgggggtcggggtcaggcccccgggcgcaccgttgctggtatatgcgggggtcggggtcaggcccccgggcgcaccgttgctggtatatgcggtggtcggggtcaggccccccgggcgcactgttgctggtatatgcggtggtcggggtcaggcccccgggcgcacctttgctggtatatgcgggggtcggggtcaggcccccgggcgcaccgttgctggtatatgcgggggtcggggtcaggcccccgggcgttgctggtatatgcgggggtcggggtcaggcccccgggcgcaccgttgctggtatatgcggtggtcggggtcaggcccccgggcgcaccgttgctggtatatgcgggggtcggggtcaggcccccgggcgcaccgttgctggtatatgcggtggtcggggtcaggcccccgggcgcatctttgctggtatatgcggtggtcggggtcaggccccccgggcgcactgttgctggtatatgcggtggtcggggtcaggcccccgggcgcacctttgctggtatatgcgggggtcggggtcaggcccccgggcgcaccgttgctggtatatgcgggggtcggggtcaggcccccgggcgttgctggtatatgcggtggtcggggtcaggcccccgggcgcaccgttgctggtatatgcgggggtcggggtcaggcccccgggcgcaccgttgctggtatatgcggtggtcggggtcaggcccccgggcgcaccgttgctggtatatgcgggggtcggggtcaggcccccgggcgttgctggtatatgcgggggtcggggtcaggcccccgggcgcaccgttgctggtatatgcgggggttggggtcaggccccccgggcgcaccgttgctggtatatgcgggggtcgtttgtggtgtcatcactgctatcttccaggccgggaggaaggaccgagggtgggcccggcgcgggtgggggtcctgggcaggggcggcggcgcggccgggctggtcctggcgctgggacccgcagctgcgccctctgcctgagcagagaccggggcccccacgctccgcgccagcacccggccgcgccgcggagagggaagggttacggcggggatgggggtgggggggttggcgggggcgcgactgacgggctcgggattggctcggcgcgcgcgggacccgggggcagctgcgggcccagacttcccggacgccctggcgcctctgctgcccacggcggccccgaggccgcgcccgcggagaggggggcccccatctcctgtcagccgcagtgactgcgggtgcctgacggcgccgccagcccggggggcccctcccggccccagcggggtctcccggggctgcctctgtcggtcccgacctgcctggtccctggagctggggtgggagtcgtgctttgatcagtcaccgggggcggggagactggtcgaccacccctgagggcccgggacttgtttgccacacctggggagtttcgcggcggcatctggaggggtcctggttgagcagctaggggggtgtctggtaaccagccgggcccctcaggctccctcccggcaggccctgaacagacagccagggatggaactcgccccctgggcaccctgtgcctgccctcagcctccccactgaggcccaggactttagaggtgggcgtgcccgccaggctgccaggccgtccctccgtgggcagctgagcaggccacagtgtggaagaggctccagaaaacccagccctgccgctgcacacgtgcgtggccagcagataaagtcttccttgttattgtgggcagcgtagctgcacctgcggtgaggccggcactgctgaagagatgtcaattcacagagcttgactatgacccaaaggtgaggtcaggactccgggagaggatggcagcggtcttcaggggaaactctccttttcttctgtctggacactggagccacacactcgcctgtccccatcctcccacagcatagggctcctgggacctcggccctgggcaggatttgggggatggccacgtctctctgagtgggctctgctcatggtcctcacaaggcccgggacatggatgagaccaggcttgcgtcctctgcctccccgccccactgtggctgtgccagcctccctgacaggggctcttccgtccacgtgcccctcctgggccactatcccgttataaacaggcaggagtcttccttccagcctccctctggggcgggcaggcagcacggcgatcacctgcccccactccctcatctatcaccctgaactgtgttcacggtaaaattactcatcctcagccagtgataaatggcatcagtctagagccagcccgcggcagggggtggggctccctgctcagggttcccaggcctgggccagataaacctggtgagctgcgcctttgtgctcacacgcagctggcaatggcaagtcagtggatttgtacgtgtctgatgtgtgcccttggtaaaagcacacgtgtgcacgattctgtgtgcatgtgcttgcgggggctgggggctgagggaggccatctgggatgtggggtctggatgtggtggccagggtgggcgctaggcaggcagcagagtggagaaggtatgtcaccaggagaagggacccaaggaatcgaagagcagggggagccactgagtggggtgcagggaagatggggtgtctgggagctcagcctcgtgcagagggagggaagcaggcagctcctgggtgcacgggtggggcatactctctacagattcaatgctggatttgtatagtgtatagattttcaatagttatttaaaatcatcaaaaacaatcgtgtttacaatttactgggcagccactatatgctggtcaacatctagaatttatcaacaattgtacaagccaagtattttatcctcatttctacagaggataaaaccgagaataaggaactttacattgtcaatgatcaaacacctagtgcacccatggccgtgcgtccgcaggacaaagcagcctttggagccctggaacttaagatgtccagagatcagcagctctcggctcaggcccaggcagctggacagcacccagcgcctcctccaggtcctcctgggtcccctcctttctttcactttcagcccgggaatctctgtgaagtcctagctgataactaaggggttaatgaataatcacagtgatgagctctggaggagccatggcccagagcagctgtggcctcctttgattaaaccacagaagtccggaggatcaggcctcaaacctccaccacctgccagctggcacctgtgaaggaggtgggaccagcacccacctcacagtggctgcagggtcacctgagatggtgattgcaaagtgctgagccatcgggacacatatttccaagacctcctgagtgccggctggcccctggagcagagatgagacccctgtggggcctacagtccagttatgaaggcagggttcctgtgtaagccagcaggcccagttctggaaaggccaggatgtgggttcagaagctcaaggacaatggactcattctgactggagggatccaggaaggcttcgtggaggaagtggcatttgacattggcatcaaggatgaacaggaatagagagaggggactggtgtctgcgtgaaggatcgccaaagcgctgttctggggtgagggcgatcagcccctcctgcccctcctgaactatgaggctcgggagcctttggcagaaggtggctctgcacgccccaggtgcaagcttggagcttccttttctgcactccacagcaggaagaagggcagtgtgaactgctcaccactgtcttcctgggtttgcagctctgcgcctggcacagagacaggctcagtgacggttgaaggaatcggagaaataatgaaaagtgtgttcatcctgcaggcagcagagcctcgggttaaccgttaacgtcaggaaatgacagatccaacgctcctgcttggggcagcgtggaggccagcggaggaactgcaggagcctaaaggagatggcgcgcgggcctggctcaggagagcagccgtctgaaagatggcggcgaagggtgcgggaggagatgccccgggcaggggcttggcggggtctggcaccaaacttcccaaagcagctgcctctgtgaactgtgcctggcagggagggagccacaccgggagtgaccctagacgctggctccccaggggtgactggaggcagtgtctcccgcccatgtgggcctccggcttggggtccccagagctctgccctgctgctggctgcactgagagaggtggccttctgaatgggccctgtccccggggagcctctggtaaagagattcacctgcaccctcaaaacacgccatgcccattggaggctctgggtgcaggctgcccctcaaacagagaaaaaccacacgctgtttaagacccaaaccaaggagacagcccctcatgcccccttctatctccccttctgtccagggccccctgcctgctctggtccaccccgtcctgaccccctctgcctgttcatctgagggccgtgagccaaggcctgggcctggccaagggtcagggatcctgggacctgcttgagaccatgccccatacactccttcggccagaaggtcagccgtagagacaaacccccaccctgagcccgcagtgtcagcaacgccctgtcctcagtgccaggcagtgtcaggctgagacccgggccacctgatccaacgtccactccaagcaagccagagccaggtgctgccagcctgcccatgtgcacacgttagcagacaggtttcctggtgtggcacacacgtgttatgaccgcggctgctgcccccagcccagagtgcacttccgggtaatccagcaccctga

SEQ ID NO: 441 - DNA, 288440 bp, Homo sapiens
tttgtttaatatattagatttgaccttcagcaaggtcaaagggagtccgaactagtctcaggcttcaacatcgaatacgccgcaggccccttcgccctattcttcatagccgaatacacaaacattattataataaacaccctcaccactacaatcttcctaggaacaacatataacgcactctcccctgaactctacacaacatattttgtcaccaagaccctacttctgacctccctgttcttatgaattcgaacagcatacccccgattccgctacgaccaactcatacacctcctatgaaaaaacttcctaccactcaccctagcattacttatatgatatgtctccatacccattacaatctccagcattccccctcaaacctaagaaatatgtctgataaaagagttactttgatagagtaaataataggagtttaaatccccttatttctaggactatgagaatcgaacccatccctgagaatccaaaattctccgtgccacctatcacaccccatcctaaagtaaggtcagctaaataagctatcgggcccataccccgaaaatgttggttatatccttcccgtactaattaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaataccaccaatcaatactcatcattaataatcataatggctatagcaataaaactaggaatagccccctttcacttctgagtcccagaggttacccaaggcacccctctgacatccggcctgctccttctcacatgacaaaaactagcccccatctcaatcatataccaaatttctccctcattaaacgtaagccttctcctcactctttcaatcttatccatcatggcaggcagttgaggtggattaaaccaaacccaactacgcaaaatcttagcatactcctcaattacccacataggatgaataacagcagttctaccgtacaaccctaacataaccattcttaatttaactatttatattatcctaactactaccgcattcctactactcaacttaaactccagcaccacaaccctactactatctcgcacctgaaacaagctaacatgactaacacccttaattccatccaccctcctctccctaggaggcctgcccccgctaaccggctttttgcccaaatgggccattatcgaagaattcacaaaaaacaatagcctcatcatccccaccatcatagccatcatcaccctccttaacctctacttctacctgcgcctaatctactccacctcaatcacactactccctatatctaacaacgtaaaaataaaatgacagtttgaacacacaaaacccaccccattcctccccacactcatcgcccttaccacactgctcctacctatctccccttttatgctaataatcttatagaaatttaggttaaatacagaccaagagccttcaaagccctcagtaagttgcaatacttaatttctgcaacagctaaggactgcaaaaccccactctgcatcaactgaacgcaaatcagccactttaattaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttgcaattcaatatgaaaatcacctcagagctggtaaaaagaggcttaacccctgtctttagatttacagtccaatgcttcactcagccattttacctcacccccactgatgttcgccgaccgttgactattctctacaaaccacaaagacattggaacactatacctattattcggcgcatgagctggagtcctaggcacagctctaagcctccttattcgagccgaactgggccagccaggcaaccttctaggtaacgaccacatctacaacgttatcgtcacagcccatgcatttgtaataatcttcttcatagtaatacccatcataatcggaggctttggcaactgactagttcccctaataatcggtgcccccgatatggcgtttccccgcataaacaacataagcttctgactcttacccccctctctcctactcctgcttgcatctgctatagtggaggccggcgcaggaacaggttgaacagtctaccctcccttggcagggaactactcccaccctggagcctccgtagacctaaccatcttctccttacacctagcaggtatctcctctatcttaggagccatcaatttcatcacaacaattattaatataaaaccccctgccataacccaataccaaacgccccttttcgtctgatccgtcctaatcacagcagtcttacttctcctatctctcccagtcctagccgctggcatcactatactactaacagaccgtaacctcaacaccaccttcttcgacccagccggaggaggagaccccattctataccaacacctattctgatttttcggtcaccctgaagtttatattctcatcctaccaggcttcggaataatctcccatattgtaacttactactccgggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggatttatttttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcgctatcatattcatcggcgtaaatctaactttcttcccacaacactttctcggcctatccggaatgccccgacgttactcggactatcccgatgcatacaccacatgaaatatcctatcatctgtaggctcattcatttctctaacagcagtaatattaataattttcataatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaaaaagatattagaaaaaccatttcataactttgtcaaagttaaattataggctaaatcctatatatcttaatggcacatgcagcgcaagtaggtctacaagacgctacttcccctatcatagaagagcttatcatctttcatgatcacgccctcataatcattttccttatctgcttcctagtcctgtacgcccttttcctaacactcacaacaaaactaactaatactaacatctcagacgctcaggaaatagaaaccgtctgaactatcctgcccgccatcatcctagtccttatcgccctcccatccctacgcatcctttacataacagacgaggtcaacgatccctcctttaccatcaaatcaattggccatcaatggtactgaacctacgaatacaccgactacggcggactaatcttcaactcctacatacttcccccattattcctagaaccaggcgacctgcgactccttgacgttgacaatcgagtagtactcccggttgaagcccccattcgtataataattacatcacaagacgtcttacactcatgagctgtccccacattaggcttaaaaacagatgcaattcccggacgtctaaaccaaaccactttcactgctacacgaccaggggtatactacggccaatgctctgaaatctgtggagcaaaccagttttatgcccatcgtcctagaattaattcccctaaaaatctttgaaatagggcccgtatttaccctatagcaccccctctaccccctctagagcccactgtaaagctaacttagcattaaccttttaagttaaagattaagagaaccaacacctctttacagtgaaatgccccaactaaatactaccgtatgacccaccataattacccccatactccttacactattcctcatcacccaactaaaaatattaaatacaaattaccacctacctccctcaccaaagcccataaaaataaaaaactataacaaaccctgagaaccaaaatgaacgaaaatctgttcacttcattcattgcccccacaatcctaggcctacccgccgcagtactgatcattctatttccccctctattgatccccacctccaaatatctcatcaacaaccgactaattaccacccaacaatgactaatccaactaacctcaaaacaaatgatagccatacacaacactaagggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccctatactagttattatcgaaaccatcagcctactcattcaaccaatagccctggccgtacgcctaaccgctaacattactgcaggccacctactcatgcacctaattggaagcgccacactagcaatatcaactattaaccttccctctacacttatcatcttcacaattctaattctactgactatcctagaaatcgctgtcgccttaatccaagcctacgtttttacacttctagtaagcctctacctgcacgacaacacataatgacccaccaatcacatgcctatcatatagtaaaacccagcccatggcccctaacaggggccctctcagccctcctaatgacctccggcctagccatgtgatttcacttccactccacaaccctcctcatactaggcctactaaccaacacactaaccatataccaatgatggcgcgatgtaacacgagaaagcacataccaaggccaccacacaccacctgtccagaaaggccttcgatacgggataatcctatttattacctcagaagtttttttcttcgcaggatttttctgagccttttaccactccagcctagctcccaccccccaactagggggacactggcccccaacaggcatcaccccgctaaatcccctagaagtcccactcctaaacacatccgtattactcgcatcaggggtatcaatcacctgagctcaccatagtctaatagaaaacaaccgaaaccaaataattcaagcactgcttattacaattttactgggtctctattttaccctcctacaagcctcagagtacttcgaggttaaaatattagatatttcccctgatacagggctcaatctttttctttttaaagcaatatttctcaaagtacttttcacagaacttaagtttcattaagcacttcactaaaagaaaagtctgtgatctaataaatttggaaaatattgagaattagagccccctcttagatatgtactgtagctactcagcttgttacagatgaagtaaacattgtaatattcacccagcttttgagtgatgtctattaacatcacccaaatgagtattccatggaatgcactttgcaaaaacctattattcaagaaaattctggagcatgaaagctattaatgataaacccattcacaaaatcacaccaaatatctaaaatcatgtttaaaatctcctagaaatgggttgaattgcccacttcagagacaaagtgattcttttgtaataacgagttttgtttagtgagtacttattatctcattgaatcctgaggactacctcacaaggtaagtatagctcttttcattacacatgacaaacaaggctcagagaggttaagtaacttgctcaagatcacaaaactgcagagtgacaaaactagaattttgaatctaagctcaaaaggtcaccaaaccaaatttgggtccacccacccagcctatcaaagtcaagcactgatatcggcattgctgagacagaagttgaggaatttattgcaggcagcaagcaaggagtatcaggcagctaatccttaaggcctaatctccctgatggcttatgtgtaagggtttttaaaggtgggaaggcagaggttgcaggcaaggtcatacaatacatggaggctacatattggtttggccaaaaaaggcaaaatatctcaaagtgagggcccacaggataggtgaccattagatgaattcaaagattttctgatttgagaccaggtgcagtggttcacacctgtaatctcagcgctttgggaggccaaggtgggtggataacttgaggccaggagtttgagaccagccagaccaacatggcaaaacaccatctctactaaaaatacaaaaattatctgggcatggtggtgtgcacctgtaatcccagctactcaggaggctgaagcatgagaatcgtttgaacgtgggaggcagagggttcagtgagctgagatcgtgccactgcactccagcctgggcagcagagtgagactctgtctcaaacaaacaaacaaaaacccaaagattttctgatttgtgattggttaagttttggctacaaacttggggtcagcagaaaggaatgttctgctctggcctgtgggtgtgacttcctccaggtccctcaggaagaaatttagaacaaagaacagttgtgagtgttcagtcctcagttcctccttatctgagatctacgagccaacaggtggtattttccatttagcggggtctgggtttctacaaaacaactcagggacatatgttaagatgttatctctagtttctatagggaaacaaacattttgtggctctaattttctttttttttttaattatactttaagttttagggtacatgtgcacaacgtgcaggtctgttacgtatgtatacatgtaccatgttggtgtgctgcacccattaactcgtcatttaagattagtttgtggctctaattttcttgactattgttttaagctattattaccttcttacttatcagggtgctcatctacttcttgaggctagccaggtggctggaattttccttggagggactcaagagtttcctttatttttcatgccttaaatgggtctgttctccctcttcaaagctcaagctcttaaggactatgctattgttagatttttcgtattggagcagtccttccctcctactcaagaacaccccttcttcagacagcctggctgggtcttcatcctgggagagctcatgaaacacaaaccagatcttggccctcacgtgtgtctaggcagagctgagcctgggcaacaccaagcgtgcccccaattttgcatgccccagccaattcagagtcaagatccacgctcagctccttccctgcaaagtgctaatgatgaaggatggggatcaagtcagcaaactccagaaatggtcttagactaggagtcaagccttgagatcctattacacaccagattcattccctgattagagctgctgaattcttttactctcactgcactcatgctaaagtttctttcctccagcctcataaccccagaggaggctgagccatgatacccattgtctagcaataaatatttaaggagcccctgagatatgtcaggcaccatcgcaggtgctgggacaagtgaatgtgaccaggaaagtccctcccctctcagaggttcttttcaagttggaggacagcaaatacagaaatatagagtctaacataacaacagggagtaataaacactttgaagaaaaataaagtggaataagagggtagggttgccatagggttctctgggcagtcttctatggaaaggccacttgttggggcagagaaaaaaaagatgtctgaaaggaggactaccggccccccataagtgcgctccggtccatgcacagggcaatgggcatgtaatttcctatgattaagacctacagtatgtacaatattactgcaacagacactgagactgacttagcattgtttcatagcatccgagttgctctgttggaggaaagtgcatgtgatgggcattcatttgcttccgccatcagacagattctctacctttgtctttcctacaagattccctaggaaggcagggctcagtggctcatgcctgtaagcccagcaatttgggagtctgaggcagtcagatcacaaggtcaggagttcaagaccagcttggccaacatggcgaaaccccgtctctactaaaaatacaaaaattagctgggcatgggggcacgtgcctgtaatcccagctactcaggaggctgaggcaggagaattgcttgaacagagacccgggaggcagaggttgcagtgagccaagatcgcaccactgcactccagcctgggctacagagtgagactctgataaataaataataaataaataaatgattccctaggaagctgactcccactgaatgtgccactcaggagtccctgctctctagattacagttgagtttgctcaatgcaaggccccagcagaaatgttgaaagtaagagcaaatagatagttaaccactctttaagacaacaatggatgtatacttctctggcctcagctcctgtggggaagctccagtgccagtccctgggtgcttcaccattttccgttagttcctgaaccttgtaaactgacccttcactaaattcttcctagttaaccctttgagaatgaaaccatttcctgccaggactctgacagatacaaagaacccacagccgactgctgggtgcgcggcagacctagtgcatggctccacactgccatcttgggggctggcacaggctggcactgagtctggggaagggagctggggctggaggtgtggaggggaagaccgtgcatagttgcttcctgatcagctctttattcgattgagagtgaggcagggaagattagagggaagcttacagtggaattcagggctgaggctgctattcttttgctccttgtaacttcctacagtgttgtcagcatccacatacttctctgtggggttggtctcagagccaggttaccttgtcttaggtccagtggcagcctgactggcttggtgtccttgaacaagttacctaacctctccatacctcagtccctcagctgtaaaatttttttaaaaaaaaagaagaagagtacctactgtatagcattgatttgaagattgaatgagctggtattatacaacgtttagaagcagtgcctgacatgcaaaaggctctcaacaaatactatcctttactaatatcctgtgtgtctgtatcagagctggtggggtggagggacagaaagaagtaggagaaggtaaagagatgggaaaatgatctctaaagtctctctggcactaacacaattctttattatgtgttttgtctggctctttatattgatagctgttccagaagcaatcaatagctattagtcggttttattcttatttttctgtctgatcttacaggggagcaaactgtggcaaagcatgaacttacttctcagaaaattaaccattatgttggcaatcactgtgattatttgaacttcagcatctggacaaatttagtcacatgaaatacagaagagagatttctcatggttaaaatgaagctctctttatttgcttctgctaattaaaaaatcagagctaaagatacttaaacactacagttaaaatgccatggttgtctattggcttaatgaattctcttatgaaatcaactctaaaatgttatccatcataaatcatgaaacacaatttttcttattctctttagagctttacaattcatcttaaagaccagtgtttacactctcttccgtaggttgtacaataacctttggcgagaaaaaataaatgtctggctttctgactcataggtgtgttccctttaacagaaaaagaaaatatgtcctctttaaaactgatgatcattggtcacctcaattttattgaagttcacttctgacctctttagatgtagttctctacataaaactgcccaacagaattctctgtctgaatgcctcctccacaaacaaaattttaagaactaaaatcatcatctttccttccaaatgtgctctccctatgtccccagggctctccatgtgtagagctgagaccatttgccactcagtttcctcacccaattaattacaagtcccaacaattttccgttgtttttttttttttagacggagtcttgctctgtcaccaggctggtgtgcggtggtgcaatctcagctcactgcaacctccactgcctgggttcaagcgattctcctgcctcagcttcccaagtagctgggattataggtgtgtgccactacatccagataatttttgtatttttagtagagaggggatttcaccatattggcccagatgatctcaatctcttgacctcatgatctgcccaccttggcctcccaaagtgctgggattacaggcgtgagccaccatccctggcccagttttgcctttttaacatccctcagctcttcaaatccattttctcttctctaacacctccccattccccagctcgtaatgaactcttaagtagattactacgatcacctcccaaatggtcttcctggctccatcagccttgtgaccttcaagttcattctccacatggatgtcagagtaactttctaaaatgaaaatctgaccacgttactctcttgcctaaatccgcctatggccgctgttaggatcaagtctaaactcccgaccctggaacatcaggtctttgtgctctgttcagtgcttctctacctcacctgcaaccaacaccactcccacatccatattctgctcaccgtgtatcaacatgaacaggaggtgggtgcttcagtccccaggaagacactgggccttttcaatcatctactgctgtgtaataaccaccctgcaaactgaccacatgatttcattttgcaagggttccttccttgggctgtgttcagcaaaagggtttactgagctggcaggtccaagatggcctcactcacaggactggctgttgatgggagccttgatgctcttgggctcaccccttatcctccagtaggttagagcttcttacagtggtttcaggcagcatctgaagacagtaaatgcagaagctccaaggcttcttacattctagcctggaaaatcacatcacattgcttccttcatatttttttggcaaatcaggttgcaaggcttgcccagattagggtaaagaggcaaagaggctccttttcttttctttttcttttttttttttttgagtcagaatcttgctctgttgcccaggctggagtgcagtggcgcgatctaggctcactgcaagctctgcctcctgggttcacgccattcccctgcctcaggctcccaagtagctgagactacaggcacctaccaccacgcctggctaatttttttttttttttgtattttttggtagagactgtgtttcactgtgttaggcaggatggtctccatctcctgacctcgtgatctgcctgccttggcctcccaaagtgctgggattacaggcgtgagccaccgtgcctgaccaagaggctccttttcttgatgaaaggagtagtgaagtcacattgcatgtccttgcaaagggacatgcagaccacattagtgagaatatgtgcctgtattttgcaatctgtaacatgggcataaactaaatgttttccaaagggaatagggcaaaacaaaaaggaccttgaccactcctttggccctgaataaatctaggaagcctaagagtatgactatcctgaggtagaaagagggtcacatgctggataagaggtacctgggctctccacttacaagaagagagcatggttacatttataatcaccattcccaacacgctgtgagtgcaggcagctaccaggaggagaacaaaggaaataaccaggacacccatctctaaacctgttaatttaatcacacggaacacttctatttaaaattcccgagggttaagatgtaagaatgcttatcaaggtaaatgctgttcacactgcttggagtgtcaggcctagatctctatccatcagaaacaacaatatcaataacaacaacagcaacatgatgatggggcaatttctgaaaagcaccatgtattttatcgatacatgtccgttgcagaaaatccaggtgaatccaaagaagaaataaatgtcttccacaatcccatagcccagagctaactaaccactataaagaacccagcgtggttttaactaatggatcaaaagatgctcatcaaaggctctgagctttcctgagtgctaacaggaaacatccagcatcactggtctctccaaggctgcaggtgtctttgcccatagtgcctgttttgtgtcagggaaagaatcaacctgggagccaagcccaggaatcaggatgaccaagacatactggacaaggagggaacaaacccatccaaggacactcaaggacaaatcaagcaaatgaatttaagggagacctgctcatggtctgctttgctgctcagcatggctgggaggcacagtggaagatcatgcatccttcccctgggactcctctgccagagcctgagagctttctcctgcacacaggctaggggtagggcagttggaattgatccatgccttctagctagactgtgggtcccctcagtcttgggcatggtgacagcccagcatcagacagaggtcagtatcaaactagaaaatttaataaatgctgtcagatttgtagacccaagaaaatataaactgccaatcacggaggaaaaaaatctctcaatgatcttatctttatatgattcccttgctgcctggagattgacatttccttggggataatctggtcataggattggtgaaggtggaagggaggcaacctccgaaggtggggccctctgctcacctgggacagggagggcctgaggtaggtgtctgtgtgggctggggaggaggatgggagcagtgcttctagatgtttccactttctcctcattagataataatgaatgggtgatttccctagtcactgcagtgtgaggaaatctacaaaattaatttcacaatacactttacaggataggtggagaaacacatgaagcacaactgcagtgggttataaaaaatggcctttcgagttgagcagtaaattcgttcaagcagccattctgaaggacaaactggctctgtatttaacaggggcattccagcacttctctagctactgggttgacaatgactcaccaaagcctctggtagccaccacaggacgcccagagcacgttttaaagctgaacaccaaactgcggacttcgggagtaagtgaactgactggtttttattttgttttactgcttttaacattacagtaactgttacaggttccagcaggataactgggtggaaatgagtttggtttcacttagtctctctaaagagaaagcaagttggtagactaatacctaataaaagcaaagctgccaacaattgaaattgcctggactgctctgtgtgtcccacatgcatgggtgtgggtgccagtgtgtgtgcgtgtgtgcatgcatgtgcatgtgtgttgggatagagtggtaagaaaatgggaaataataagaatgttcagtccatagcccttcattataaaaaggtgagctgtaataaatactagtgccacatttagccaaaactttactccagccaaaggtgatattttcatgataacatcctgtgattgctttgttcttcgtcttttatgttcttcctagatgggctcagaacatacaagaattaagtacacatcttattttccagtgataatgctaccggcaaattctgttgtttgtataaacatcagccatgtttatataactaaactagtgttttgttttgtcaattcagcaagaaattagaccacatggtggcttaatgctgcattgatttggctatcaatttgttttcacttttctgcaaaatatttaatacattattaaattgaattatgctgatgccacagttgttcttatctcaattgtcttaaaattcatttaatttttttttcctttggtttcattattcaaattttaacttcagttctcaacattttatctgatggaagagatggagtccattactaaggactccattgtgctccatcatgccagagttgtaaaatagatcttttaaaggaaatttactgtgatttttttctatttaagagcttcctctccagttgagcatgtaagaaaattataccaggagaatacagtaaactctatgaggcaagctataaacatgtagcattgtgattagggctggttctccttctagagacatggtaggattgcaatttcataccatccttgaagttagagagagccacgtgactcatttagccaatgaactgtgagcagaatgacatgtcacttccagcagaagctttaagaatctgagagacattcatacgttttccatgtgctgtagccttatacccaaagcctgggtcccaagtgaccatgacaggcagagctccctgttgagccacagagatttagagaatggctgttaacacagcataatccagcccatcctgactaatctgatattaacatgtataataaagaattctatcaatgctgagggaagatgattagttaaggtcctaggttgcaagtctcaaaacctcttctaaggattgtagacaggaaattaaatgacttctagtccctagagttcccaatctcctaccatcccatcctaatatgacagaagtaattcctgagttgcttctgaaaccagagcttccctcagaacccttagcctgccagatggcttcttggagagccctcactcacttttctccttctgctattgctgctcattcattccagcttttaaaaattcatctttatccaggaacctcgcttctagaaaagtcatacaggtgcttccaggaggctacatgggcacccatatttttctagccactttcattagaccaatgcagcagagaagaaaagcctcaataattattatgacatggcatgttaggataccaggtaaattgcatttgtaaaatgtgattttctgttggtgttcacttcggctctactgacatttggtaagtattattgactgactgactaactaatgtggtcattagtcttcataaagaaaggctctctacaaaaacggagggatgccctttttctggcatttaatacgtaagaaattgcctccgatagaaaccagagttgcctgattactatcagcacaggagaaatgtattaatgtgcctttctagtaacaggtttttagaaagtcaaatataaacaaatctgtctatttgtgtgtgtgcatgtggtagtggggagggaagaaaaaaggagggggagagaaagagaaataagaaccaagtttattatactgtattcagggggaaaacattttcccaaggttctaacagaagagcaaagtgccactgtcaatagcctcagtagtgtgagggttgcttttatgtatttatttatttacttatttatttatttttcctttttttttcctttctctttttttcttctttttttttttttggacagagtctcacactgtcgcctgggctggagtgcattagcgcaatcttgactcactgcaacttctgcctcccaggttcaagtgattctcctgcctcagccgcccaagtagctgggattacaggtgtctgccaccgtgcctagataatttttttatatttttagtagagatgaggtttcactatgttggccacgctggtctcaaactcctgacctcatgatccacccacgttggcctcccaaagtgctgggattacaggcgtgagccaccgcccctggccaggattgcttttatagccagtcttcaggtgcccactgtaggaacaatgtcatttagccctcgggattattctgtgccaaatatggataatgactaatattcaacacagatattctcagctcagaagagcaattagcaaattcataaattaagtgcttgcttcctttttagtcaaatacaaacatttgttaaaagatattattttgctttacactttgtctctcagaaataaacagatgcttgaattcccacagtgctgcttgagcctcacaccatgtcatcctgccaggcacccagatccagttctagagtttcacatgatcatgagtgttggttaataagtcactgtgaactgggaggggagatttttcaggagtgccacagggctctccctttaatcacatacactccctgctttcattggaaagtgtataatgatgtcagagtgccccagaatggagctagttggaagactgccgtcatagggatgccttagtgaatcaatcaggttttaatttctggctctcaactttgtagatgtaaaagttgatttatcaatatgtgagaaaggatgaatctttctgaaggttatgtcatcacactcactaagcacacagagaataatgtctagaatctgagtgccatgttatcaaattatactgagactcttgcagtcacacgggctgacatgtaagcattgccatgcctagtacagactctccctgcagatgaaattatatgggatgctaaattataatcagaacaatgtttggtgagccaaaactacaacaagggaagctaattggatgaatttataaaaatatacctcagccaaaatagcttaattcagtctcccttatcataaggatactcttgcctaaagggacagtaatattaaagacactgggaataacctctgtactttggacagtagacctgcatagcccattaggcctcaatgaagtcttatgcaagaccagaagccaatttgccattttaaggtgattctccatgtttctgctctaactgtgcttcacaatactcaagacactgaatcaggatgtttcctggagtgcagggagctgtccgtgttactgagcagttctcagcaacacaaagatcctactgactcctcatcagacttctttctcactggaattttacacctgggctgttaacaccaggccaggtcaaattcaaaggagagaaaaaagctcattatgaagggtaaaatccaaaacactgtgcataaagatatgtgtgcacaatttttatacataaagatttcataaagccaaagcatcaggaaatgaaaagagatacagaaagaaaaatgatggtaaatgagacattaatttacccttctaatctctatcacagcaaaaaggtaattaaaaaatctatatgaggaccaaaaaatacacaaagattatgtagcaaagcctatagcctaaaaaagtaaacattgaaatttgtatgtccataaaatgtttacaaaattcagtacatattacacaccccaccctaaaaacatctaagcaaagtagagaatgtagaaatgctacagattatattctctgattatgacacgacaaaactagaaattacagcatggaaatttaaaagctttctcttaaataattctatgtcaaaaagaaatccaggccgggtacagtggctcatgcctgtaattccagtactttgggaggccaaggtgggcaggtcacttgaggtcaggagttcaagaccagcctcgtcaacatggcgacaccctgtctctactaaaaatacaaaaattagctgggcctggtggcgcatgcctgtaatcccagctacttaggaggctgaggcaggagaattccttgaacccagaaggtggaggttgcagtgagctgagattgcaccactgcactccagcctaggtgacacagcaagactctgtcaaaaaaaaaaaaaaaaaagaaatccaaataaaatttccagaatatgtggaaaatagtgacaataaaaatattacacatgtgtaatcccagcattttgagatgccaaggtggcaggatcacttgagaccaggagttcgcaaccagcctggacaacatagggagactccatctccacacacgccaaaaaaaaattttaaatagccaggtatagtggtacttcttgtaatcccatctacttgggaggctaaggtgggagaatcacccaacctcaggagttcagggcttcagcaagccatgatcatatcactgcactccagcctcagcaacagagcaagatcctatctcaaaaaaaaaaaaaaaaaatcacatgtgggaaatagctatagcacaataaaaataaatgtattaagtatgaacaacaaaaaagctagtaaaggttgaacaacaactatccttaggaaagtggaaataatgtgttaataaatatgaaagcaggctaggcacggtgactcacatctgtaatcccagcactttgggaggctgaggcaggcagatcacctgaggtcaggagttccagaccagcctggccaacatggtgaaatcttgtctctcctacaaatacaaaaactagccaggcttggttgcgcactcctgtaattccagctacttgggaggctgaggcaggagaatctcttgaacctgagaggcagaggttgcagtgagccaagatcatgccactgcactccaactggggcaacagagtgacactccatctcaaaataaataaataagaaagcagaaactaataaattagaaaacagaaacatagaactaatttataaatcaaagcactatgccttgaaaagagggagaaaaattgtgaattaaggaagggaagagatggttggagaggaggtgggagaaggcagagataattgaaggagcaaaagcatctggagaagcaaagccactgaaagatgaacagggctctgaaagaaatgcttgattgctatcttttcaaatgactgcagttcccagtgacatcatttttctcctccctggaagtctgaggggcagttcacttatctcctcccctcccctactcctcaccccacactcaaaacctgtctatgctcctttcattctcatatgacagatttcagatggcattcttatttccctgatttctttttgagatagcttgcatttccctactctatataaagccaccgtttatcaaatgcctacatggaccaagcagtccacaagggcttcacagacagttttactaaactcatgccaaaactttcaggttttatagataaagatctataccttatagataaaggtatctataaggtatagataaaggtaaggtatctataccttatagataaagaaattgaagcttatagagtttaagtaatgttcccaaagcctcgtggctagtaattcaaacctaatttctgcctactccaaagtctatttttcctcatgatactatactgcctctccatggataaagacagagatcacatattaataaaatttgcacaaagtcggcaaattgttgaaagggaaggctaagatgattaataaaatcaagagccagatgatctcaacaacctgaaataactggctgacaaccaatttgaataactccctgcgggtgaagttcaaagtactatttggggtttttttttaagtttggctgggtgcagcggctcacgcctgtaatccaagcacttagggaagccaaggtgggtggatcatgaagtcaggagttgaagaccagcccggtcaacatggtgaaaccccatctctactaaaaataaaaaattagccgggcctgctggtggatgcctgtagtcccagctactcgggaggctaaggcaggagaatcgcttgaacccaggaggtggaggttgcagggagccgagatcgcaccactgcactccagcctgggtgacagggcgagattccgtctcaaaaaataaaataaaataaaataaaaaataaaagtttgatatattcagaatcagggaggtctgttgggtgcagttcatttgaaaaattcctcagcattttagtgatctgtatggtccctctatccgtcagggtcctagcaggaaattgttgcactctcaaaggattaagcagaaagagtttaatgaagggtctctttccagggttaagggaactgctagggtttggatatttgaccactccaaactcatgttgaaatgtgatccccattgttggaggtggggcctaatgggaggtgttttggtcctgagtgtggacctctcacgaatgtcttggtgccatccaagtgagttcttgctcgctctttttttctttttgagatgtagtttcactcttgctgcccaggttggaatgtagtggtgcgatcttggctcactgcaacatccacctcacgggttcaacccattctcctgtgtcagcctccagagtagctaggattacaggtacccaccactatgcccagctaatttttggtatttttagtagagacggggtttcaccatgttggccaggctggtctcaaactcctgacctcaggtgatccacctgcctcggcctcccaaagtgctgggattacaggcgtaagccaccgtgcctacctagttctagctctcttaattcccacaagagctggttgttaacaagagcctggtacaaacccctctctcttgccacgtgatctctgcacatgccagcttcccttccccttctgccatgagtggaaacagactaaagccctcaccagaagcaaatggtggcaccatgcttcttgcacaccttcagaactgtgaaccaaataaacctctcttctttaaaattattcagcctctggtattcctttataacaacacacacacacacacacacacacacacacacacacacacgcaaaagcagactaaaacaggaactaattagaaatggtaatgcaccgagggattggcaccgaggctccccaacaggaactgaggccatggatagaaggacacattcatgttatttttttctaatggttaagtaattatttgctcttactctcaaaatttctgccaaggcctcccatggaccaaactcaactaggatctaggaagcagagaacctgagtgttgcattcagcagaagtcagcttcctagggaatattgcaggaagggtgaaggtagagaatctggtggggaagcaagcaaatgcccatcacatgcactttcctccaacagagcgactcagatgctataaaacttgctaacgcagtctcagggtctgatcacagtaacatacaagccaggttttagtcatcagaaatcgcagtcctattgtcttctgcacagacccaaacacacttggaggtcatgttcaatatgaatacctcacagagaaggaaatttacacacgagaagtacatctgcagaaagccagctggcatgtcaaccattcgaaaactcagggtgttcgggataaagaagactcaggaagacaagtatgaagcataatctgtgacattattgatatcttcctgatatcaatattattgatatcttcctgaagaacataattcctgcctaccatcaacaagcatcaatactttctaccagctattctcaaccctcatcatcggaagagacagacactgactgtgtcaaagtattagtcccatcattcagcaattaactttagctcaatgcttcaaaaattcttcaggccctgtgtaatttcagctatgtacattaatgatgagtacccatacaaccattctgtttcttattttcagtaccatatttaataaatatcagttattcaatactttatttagacattttgttagattattttgaccaatgaagtctaatctaaatgttctgagcatgttcaaagtaagctaggctaacctataatttttggtgtgctaaatgcatttttaacttatgatattttcagtttacgggggtttgttgggacataacttcatcatacatcaaggagcatctgtatatgggatatagttaaagcagtgatcagaggaaaatctatagccttaacacatttattaataaaagtgtaggaattaaattatcagctgaaaaatgtaaaaagtatctaaaagagtaagcagaaagtacaagaaagaacccatagtagaaaaaagtgaaaattaataaaataagaagccaaaaaacagatcaaatcagtaaaccaaaaatcttgttctttaaacaaatcaacaaagttgacaaaaaattagatcttttaatcatgaataaaaaaagagaaagcacaaaaatgaataaggaatggtgagagaaataactattgataatcagcaaataaaaaatcattaaaaacaatgttgttcacatctatgaaaaacattgaaagctagagggaatgggtaattttccagaaaaatacaattcaccacaattgacttcaaaaaaaaaaaaaaaaagaagtacagcacttatgtgagcaatttccatagagaaatacagttgtcatggaattataacacacacacaaacactaggtttagatgttttcacagagaattccaccaaacctttagaaatcagatcatccaaaggcaaattaacaaccctcagccatttgaggcaaaatattacaattgaggcaagatatactgtactgaaaacttgaggaaaaagcaggagagaaagttcctttgggaaattcgaatactcaaaagtgcttacatacaatgaaaaatttggaaatccataagcatggccaaggtgggacacatgctcagaaaaggcctgagaagacactaataactcacctttagtaattcctaggctcacagcaagaaaaaatgaaggctaaggcagaattatatatggctccgctaagtgttgagggagccccaatacagagtcagtaagcaaagtctgggagatgtttttcatatttttttcttttttggctccttgcagtcaaggaaatcatttttaaatcactaaatgctaaatgaacacaagctaaaggaaccgagccgccttcaaacatcaaacataaaaaagaatgcagatattacaaaaccagtttacaaaagttactaaacaaataaaaactacatcccacagtgggtaacaaaaataaccttgaagaagggaaaaatttggtttccagaataaacacattataatatccaaaatgtccagttttcaacaaaaattaagaagcatgcaaataaacacaaaactatggcccatttacagaagaaataaatgagactctccctgagtaagcagatattggaaatattagacaaaaactttatataactgtcttaaataaacttaaagagctaaagaaacccaagagaatgacatataaataaataagaaatatgaattttttaaaaggtacaaaaaaattctgaggctgaaaagtacaataactaattaaaaagttactttttacttagggttccaatagaagatttgagcagctggaaaaaagaatcagtgaacttgatagatcaagtgaaatgattcagtctgaagagcaggaaaatgaaagaatgacaacaaaaaagaatagagcctaaagacctgtgtaacaacatcaagaatgcctacatacagaatcctggtggggagtgaggggcaggaagactatttgaagaaatgtgtttgaaagcttcccaaatttcactaaaaacaaatatatacattcaaaaagctcagtgcacttcatcaaggaaatatacaaagatattcacaccaagacacactatgtttcaaattgtcaaaaggcaaagcgaatgtttgaaagcagcaagagaaaggcaacgcgtcatttacaaaggatcctcaataagtttgacagcagatagtgcattataatccatggatgccagaagagcttaggaaaaaggcaatgcatcatttacaaaggattctcagtaagtttgacagcagagagctcattataaaccatgggtgccagaagagcttagaatgacattttaaagttctgaaagaaaaaaacactgtcaaccaaaaattctgtaacttggaagatgccccttcaagtattaaggataaattacacattcccagattaaaaaaaaaagagagagagaaagagaaagaaagaaagaagagagagaaagaaagggagagaaagaaaaagaaagaaagaaagaaagagaaagaaagaaagaaagaaagaaagaaagaaagaaagaaagaaagaaagaaagaaagaaagaaaaagaaagaaaagaaagaaagaaaagcaagcaagctttaaaagttcatgtttggtaggctgtacttcaagatacacttttaaaaaaaaagactccttcagatacaaactaaaaaacactagaaagtaactcaaaaccacataaagaaataactccagtaaagataactacataggtaaatataaaagcaattatcatattttttgtaagtctttttaaatattctatatgttttaaaacaaatgtgtaaaataatgactataaatctatgttaatgaagcatgatgtataaagatgtggtttgtgaaattaccaacataaagaaattcataggaaactaaataataatagagattttgtatactattgaagttgtttcaatttactctaaattgttccaaattaagaatgttaattgtaaatccccatggtaaccactaagttaatatcttttgaaaatacagaaaaggaaagcagagggtaaacacagtgatatgctacaaaatagcaactaaacacaaaagaaggcgataattgaggaaattaggaacaaaggaggtataagacatacagaaaacaaaagcaaaatggtaggagtaagcccctctttatcagtaattacattaaatacaaatgaattaaactctccaatccaaagaaagagattgacagaatggatttttaaaaaatgatccaactatattgtccacaagatactcactttagatcaaaatacacaatgagttgaaatgaaaggatgggagaaaatattccatgtaagtaataaccaaaggagatctgaggcaaatatacttatatcagacaaaatagactttaagtcaaaaactgttacaaaatacaaagaacagtatatattgatttcaaaattaaacaagaagatataacaattataaatatatgtacaccaactaacagggctccaaaatatataatgtaaccattgagagaattaaagggagagacagacaattccacgaaaattgttgggcattttaaaacccaactttaataaaggacaaaacacccagagcaaatatcaagggaggaattagaggatttgaataaaactataagcaataactatagataacacttctctcaaaaactgcagaatacacattcttctcaagtgaacatggaacattctccagcacagatgatatgttaggccataagataagctcaataaacttaaaaagattgaaatcatgcaaagtatcttcactgaccacaatggaatgaaataagatatcaataacaaaagaaaaactagaaaatttacaaatatttggaaattaaacaacacagtatttaccaaccaatgaatcaaagaacaaatcatgagggaaattagaaaatgtttagagacgattgaaaacaaagatataacaagatgggtgtgatatatcaaaagcagtgctcagagttgtaacacctacattttaaaaaagaaacatgtcaaatcaataaccaaactttactcaataaaccataaaaggaagagcaaacaaaatccagagctagcagaaggaaggaaataaagattagagcagagataaatgaaattgagaattaaaaaattatacagagatcaacaaaactaaaagttggttcttttaaaatatcaataaaattaatatacttttacatagactaagcaaaacatctctattcagctgacttttttttacaagggagccaacattattcagtggggaataatagctttttcaacaaaaagtgctgggaatactgaatattcatatgcaaaaaaaatgaagctggacccctacctcacattatatacaaaatctagattggatcaataatgtaaatatacgagtgaaaaccatacatgcttagaagaaaacatggaaataaaacattgctgtggattggcaatgcattcttagataatacaacaaaaatacaagcatgaaacaaacaaatgtagccaaaatgtaccagaatctgaaaacatgtattatctataaagaattagaggggaatttggtgaaagaaatatgggagaatgggatattgctctgtgaatgcttttgtgcataattgtacatttttaattaagttaatcttttacactctcaaagtgtgatattaagcaagcaaagataagttattacaagactctaaaaccgaatgcaatgagaaacaagtgaatccaaatatatttcaaatgaatgaatgacataatcaaacttaaggggaaaataataattaatctgattaatttttgactgttctcttatttcaaattgacttttgaacatactttgactacatactattgcttgaaaaaataaaatatctgcaaaaaattattaaatcttcatgataggattttttctttttatattagtataaatataacaattctgaaacaaatgtatgtgcattgtaagattaagccaatgagtaaatattaatatatttgtattgctagaaccccagattctcactgtgaaaggacagagatacagatatggaataagacaaggaaagaagcagcccactgagttacattagaatcagtattatcaacataaatatacaatgtgctctctcacatgctctttccttctcttaaaaaatatataatatgtacatattatatattatatgcatagacacacgtgtgtctatacatatcctacatgtacatattgaggattaacaggtgctagtagaaaatattaactttctttgtattaacaggtgttagtagaaagtagtagtaggtgctaagataaaagccataattaaacctcctggtgaatgaacacaccatcacctacaatcttaccaaaaatagaaccaagcacgtgtcctagtcaaacctctggattcaactgtcatttggataaaacgcaaaggatagtgaaaatgtcgatcttcactgagagtctaaccagcaaaattcacagtgtggacaccaagtgacaaaaatcccaaatttttcaacaaatatattgtatgggaaagaaaactttgaaaagaaacctgtatgttagaagggattttaaaaacacgacaaatgaaaacaaatgggcaagactaaatcatagtgtcttggaatgcatgcaggaaggacacagccgtgaaaatgcaaggacgcctctactggaacagtcacgtttatcgtcacttttcaggagaaaggtggctgcaactgaggagagtcacatgcttcagggctggcaaagtcctatatcttgacttatgtgatgattacagggatgtttacaaaaatcaaactataagtttgttttgtgccatgttttgtattgtgtgtgtgtgtgttttgtttttcaacttaaaaataaataaaatcaaaaccaaggcttcattatcaagtagcacaaagtctccaatctataacctcctttgtctggatatctgcatttaactaccattgccagagctaatcctgacaatgcattcatatttttaacactgaaacacagtaaacagggaaaattttgctcctctaaaacagggcatcttcaggcaatcagaacaactcagaaagtttctgtctgttgcataaaactcccctgtgcaaagagttacacaaaatgctgtcatagtaaaggtagttaactaacggcactaattgttcttgggcagtggccaagtggaacttcagagacctggcattgccagccagaaatcacttgtcatgggaattgtctcctggaatcactttggttgtcccagggtaacgcagggaaagtggttaatgggtcacttgggggtggcatcttcatcagtaaatcacatttactttctcctactaagaattttatttttggccatgaagccaaaagtcagctcttaaataacaagggaagcaaataatcattgaataaaaatagcaggaagaaaaagctgtgcaaagaaatttatgtttttaatttgttatatatgtatatttttatcatactttaagttctagggtacatgtgcacaatgtgcaggaataaaatttatgtttttaaaatttattctacattatgaattctacattagaaaaataaaccatagcctcatcacaggcacttaaatacactgaagctgccaaaacaatctatcgttttgcctacgtacttatcaacttcctcatagcaaactgggagaaaaaagcaatggaatgaataaaatgatagccacaaaaatcaaggtgggagaaatacttattatatgtccataaaaaattttaattaatgcaaagtattaacaccaatgattgcagtaatacagatcttacaaatgatagttttagtctgaacaggactatccaaaagttaattttctatagtaacagtttttaaataaaatatcaattcctgaaacacataaaatggtccatgagtatacaacgagtgaaaaaaaacaaattcagagcaaagataaattaagaagtatctaatattcaaacatagtcaaagagagggagatttctggataatcacttaaacccatggttaaacataaatgcacatatgttaatgtttactgaataacttatctgtgccaagtggtgtattaatgattcatttttatttttcactaaatcttttctctaaagttggtgtagcctgcaactaaatgcaagaaatctgacctaggacctgcacttcttaccattttgctcatatttattccctgtgcatttttgtaacatgtatatgttatatatatagaaagagagagaggcagagatggaaagtaatttatggagtttgatgttatgtcagggtaattacatgattatataattaacaggtttctttttaaatcagctatatcaatagaaaaataaatgtaggaatcaagagactcattctgtccatctgtgatagttccatcatgatactgcattgtcaagtcattgctccaaaaatatggtttagctcaacactgagtgactataggaaaccagaaaccaggctgggcgctaaagatgcaaagatgaatgagacatcatctctgccgtccaaaagcttactgtctagtgggagagttacacacgtaaggacagtaatctaataagagctaataagtgaaaactaagataaattaataatacaagattacagggaaggtttccaaagtcaatgaggcctcaaatgaatcttgaaagtgtgcaaggattaaccaaatgaagaaatgtgtaagtttttcaaacaaaaaggaacagcatgagcaaatgcaaggaggcctaaaataaagagatgtgtaaagaggtgtaagcagctttgtactgctgcctgataattagaagaatatcgggagtaacaagagctatagaagagagtcacaattacggaaaaatatttattaaattataagaaatttatagcataaggaatagtaggaccgttaaatgttttaataaagatgatgcttctttttttaatatttatttttattatactttaagttctagggtacatgtgcacaacgtgcaggttacatatgtatacatgtgccgtgttggtgtgctgcacccattaactcatcatttacattaggtatatctcctaatgctatccctcccctctccccccaccccacaacaggccgcggtgtgtgatgttccccttcctgtgtccaagtgttctcattgttcaagtcccacctatgagtgaaaacatgcggtgtttggttttttgttcttgagatagatgatgctttaaattgaccactctagctgcattgtgggaggaaaaaagattttagaacaagactagaaacagaataattagaaaaatgcaactacaatgcagatgagtgattatcaaggtctgaactgaatagtggaaatagagataaggaggcaaattcaagatatgtgcgtgacagtaaaattaacatgacctggtgtttgattgactctgtaaagtgaaaggaaaggatgaataatcaacaaataatatttattctaccaaatgcctccatgccgctttgatgacaggataatatgtaagcttttctatatttcagaaactatatgacatgacgaaaagtaaaaaggggatgggggtaaggaggtatcctgaattgactgagaaataaggaggtattccacagagaatataaaaaaacatatacttagtgttcaaggaataataaaaaagagaacatctatgtgtccaccatacaggatatgaaatagaacatttgccggccatggtggctcacacctgtaatcccagtactttgggaggccgaggtgggaggatcacttaagcccaggacacaggttgcagtgagccaagatcacactattgtactccagcctgggccaccatgtctcagaaaaataaaaaaactagatgtcttggaggattggaaacaaaatagaactttactagtgccttagacgcccattgggtgctccttgccaattgtgttctcctttatttcctgctggatatgaccactgtccttccattgcattgtatgtgttttttaatagactttaatggttctcaagtgatgcattatttagtttggttctttgaaacttatataaatgaaattattttgtagaagttctttcacctttatcagaaggtactttcaccttgattcaataataagtttgcatattacaaccttgttgaatgttggtgtaattcatccattcgtattgctatatgatattccactacatgaatatgtcggacttcattcctcagatctattgttgatgaacacttgaaatttttccagtttttaactattacaaacaatgctgctatgaacattcttttgtaaatcacctggttcatatgtgcaagatatcctctggggtatatatttaaaagtaaaattattgagttattcaacattaccatgaaatgctacactattttttttaacaatcctaccaatttacacttctaccacgaacagataagcattaccattggtcttcatttgtaggaaccatatttgtcttttgctctgggggctttgttttgttttgctttgttttttgcttagaagtgctttggctattagggatctttttttggctccatgtgaactttaggatttttttttaattttgtgagaaataacgttggtaatttgatgggaattgcattaactctatagattgtatgggtgatatggtcactttagctattgatttttctaatccgtgagcatgggatgtttttccatttgtttatgtcatctataatttctttcattagtattttgtagttctccttgtagagatctttcatttatatagttatgcattcctaggtatttttcatggctattgtaaattcagttgagttcttaatttggttctcaacaaattaatctcaacaaacattcaaacagcttgaatgtatttggtgtatagaaatacaactgatttttgtggcttgtttatcccaagactttactgaagtcgtgtatcaagtctaggagtcttctgaagactttagggttttctaggcctacagtcatgtcatcagtgagcagagatcatttgacttcttttctaatttgtataccttttatttctttctcctttctgatagttctggctagcacttccagtactgtattgaataggaatgatgaaggtgaacatccttgcttttttccagtttctagaagcaacacttctaacttttgcccatccaggatgatgttggctgtggctttgtcatagatgactcattttttgaggtatactccatctatacctatattgttgagggtttttatcataaacagatgttggattttatcaaatgcttattctgcatctaatgagatgatcatagggtttttgttctcagttccatttatgtggtgaatcatgtttattgatttgtctattttgaaccattcaagcacccctggaataaagcccacttgatcatgatgaattatctttttgatgtgttgttagcttcagtttgctagaattttgttgagtatttttacatctgtgttgatcagggataaggatttgtagttttcttttgtgttctttttaaaattttccttgttaattttactgcacagtattattttaatgatgaataaagtgttgagctggacatgtgtaccttgttcctcatgttacaatgaaactgtttaatatgtcatgattatttataatgttgagagtagtttttgtgtatatattaagatatttacatcagttctcttctattcctagtttgttattattacaaatagtttcaaatgtgaacaagtgcttttcccacagctattgaaataaccatattttgttcttttattcagttaatgtggttaatttcattgtttggttttctaattttaaaccatacattcttgaaattactgcacttagtcacgatgtatttttctttggagtatattgttggattatatttgcaaacatttttgtttagaattattatgtagtatattagtctgtaatttcatttcttttaatatccctgtatggttttactatcatggaggtaccaccatataaaacaagttggaaagtgttatgtcttcccaattctctaaaaatattcatgtaacattggcattatttctttattaaatatttggtaatatttctttattaaatattgcatccacctagccctggagttctttctacaggaaaaaaaaattttctaaataaaatttctacaatgaaaaaaaaactactcagtttttctagtttttttctgatcatttcataaaagtaggtatttttcataggaacttgaccattccttatgattgtcaaatttattaatataaagtttcatattttatatttattttatcagataaataaaattatatgttttgaaatatatattcattgtaaaatagccatgttaagctaacatatgcattaccttacatgcttatctttttttatgagaacacttaaaaatctactcttagcaattttgaagaatacaagtacatcccctatggagaacagtttgaaggctcctcaaaaaagtaaaaatagagctaccatgtggtccagcaatcccactgctgcatatataccccccaaaaaagaaatcagtatatcgaagagatatctgcactcccgtatttgttgcagcactatttacaatagcgaagttatggagtcaacctaagtgtccatcaacagatgaatgaataaagaaaatgtggtacttatatacaatgaagtattattcagccataaaaaggaatgagaccctgtcatttgcaacaacatagatgaaactggaggtcattatgttaagtgaaataagccaggcacaaaaagacaaatactatgtgttatcacttatatgtggaatccaaaaagcaaacaactgaactcatggagatagagagtagaaggaagtataccagaggctgtgaagggtagtgggggttgggagaggtgggggatggttaatgggtacaaaaaaagaaagatttaataagacctagtatttgatagcacaacagggggattgcagtctaaaattcaattatacatttaaaaataactgaaagagtataattggattgtttataacacaaataataaatgcttgaggggatgaatatccaattttccattatgtacttattgtacattgcatgcctgtaccaaaatatttcatgtacctcataaatgtatacacctgctatgtacccacaaaaattaaatttaaaaacaatacattgttatccactatagtcaccatattgcacaatagatctgttgaattcattcctcctgtacaatgcaattttgtaccctttgaccaacatctacccaatcctcctggtaaccatcattctactctgtacttctatgtgttcagccttcttagacctccacatacaagtgagattatgcagtatctggctttctgtgcctggattattttactcagtataatgtcctcccggttcattcatgttgtcacaaatgatactttttttattttttaaggttgtatactattctattgtgtatgtgtaccacattttcttcatccactcatgtgtcgatggatacttaagttaattccacatcttggctgttgtgaataatgctacaataaatatgggagtacagataactcattgacacactgatttgatatctttttaatatatgcccagaaatagcattactgaatcatatggtaattctatttttacagaatcatttatactgtcttttacaatggctgaaatagtttacattctcaacaattacaaggttttccttttctccacatcctctccaacacttggtatcgtctgccttttctgtaacagccattctaacggatgtgaaatggcattttattgtagttttaatatgcatttctctgatgatcagtgataattagcatttttatatatctgttggccatttgtatgtcttcttttgagaaatgtctatttagatcctttgtcaatttttcattagggttccttgttttcttattattgtgttgtttgagttcctaagatattttggacattagcctcttatcaaatgtatagtttgcagataatttctcccattttgtaggttatcacttcactctgttgactttcttttgctgtgcagaagctttttaggttgatgctattccatttgtgttttgttgcttttcttgcctgtgctttagagtcatatcataaaatattattgcccagaccaatgtcttggagttattcccctgttttcttctaggagttctatagtgctaggtcttacatttaagtctaacttattttgagtttatatttttatatggtatgaaataagggcctaatatcaatcttgtggacattcagttttctcaacaccattttttgaagagactgttctttccccatgtgtgttcctggcacctttgttgaaagtcaattgactataatatgtagatttatttatgggctctttattctgtgtaattggtctatgtgtctgcgtttatgccagtaccatggtgtttcgattgctatagctatgtagtataatttgaagtcaggtaatgtgatatctcctgccttgctttttttgatcaagattattttggcttttcagagttttttgtgattccatacagatttgagagttgtttttctatttctgtgggaaaatgtcataggaattttgatagagattgcattcaatatgtacatcactttggatagtatggacatttcaaacatattactttttccaatccatgaacatgagatatctttccatttatttgtggcttcttcaatcgctttcatcaatgttttgtagttttcagtgtaaagatcattcacctctttgtttaaatttacatctaagtattttttgttgctattataaataggattgttttcttgatttctttttttgtatagtttgttgttgatgtgtagaaatgctactgaattttgtatgttcacattgtatcctgcaactttactaaattcatttatgaattctaaattttttggcagagttattggtgttttctatatataagatcatgtcaactgcaaacagaaacaatttaacttcttcctttccaattttcatgccttttatttctttcttttgcctaattgctctggctaggacatccagtactatgttgaatagaagttctgagagtgggcacccttgtatgaagtttcccacaacatctcttatctttttattagctatatattaatacggatgtttcttcttcatcaggagtttgaaaaatatgtcttttctctatattgttcttaatcagtcttcctagaagtatttcaatttcaaaaagtagcaacaactgtgggagttcagtcaggctggtgggaaaaattttaaagatagttttaagaaatcgacacaaaccttcatggaaggctgggggtgttgtatagcttcagtaatagatctgaatgaaggcggcctaatccttccttgagtaaacagcttaaagtaggtgcaaaggaatgtaagggagtttatctaaataacttgtttactcatgtggtcctgaagccaacctttgatcattcacaggcaggatggctctctctcgggggagggtgaccaggttaattaccctctatttgtgttgactaaaagcccctgtcatttaatgttttttcaataaatgctggcagggctagctagtcagggctcgtggctgccagaactctttctgtgcacggcccagccccctagcggctctttcactgaataattggtgtctgagtacattattcatccctcgtgcagctggggtctgcaggacagacccccacaaacaacaatttgcaaaagcaaacttccctgttttgttttttttcccgagatgataaattagaggcttttagtgtgcctcggccacttagaaatagcaagagagtgcacaaaggtcaactctgtgagctctacgtcaagaaggaaaatgggaatccaccagaatcatgaaggacatcatagatcccaagaaggagaatgtgagcaaacagtcaacatgacagcaaccagcttataaaagtgagcgaagtcctagtatgtgagagaggcagagagcctccctctgtaactgacattttcactgtgaatctgagcaaccccagccaagttgttgcattttgtttctcccaaggcctggagtcaacatggggagaggcttggagatgctgtgaagcaaagacactgggaacagctgcagacattttcccagaccaggaagtaagagcaagatgccattttcaatctggatgcatgcaaagtcagctttttttttttctttttgtgacccagcagaatgcctgcacaggcattttagtctcaggccaaagattggaacaactgctttggggcttggtagggaccttcacagccatattgtgggaaacacctcagcagtatgtgctggaattgtgctttcccccatcgcagcctcggggcaacagaaaagctgctacagctgtaatttctcccaggtgatgaaacttgcagccagggccagcttggagacctacaaccagtctgcaggtgtcattgctgggtgccccagcctgttcccctgagaatgtgatacagcagggctttctctgcttcacccccaggcagaaattcaggcattggagcacctgtctacctggaccagcatcctgagctaccccaccgtttgtaaacataggttgtggtgcagtggggccctctccagtctatggccaggcagatttccaggtatgtggagtacccacttgactggatcagcagcctgagcttccccaaccttcctgtgctgagattatagtgcagtgaggccctctcatctccacacataggcagacctccaagcaattagagcacctgctcctatggagaacttaaatttacaagaaaaaaaaaaccatcaaaaattggccaaaggacatgaacagacaatcctcaaaagaagacatggatgtggccaacaaacatatgaaaaaaagctcaaatcactgatcattagagaaatgcaactcaaaaccacaatgagatactatctcaaaccagtcttaatggtgattatcaaaaactccagaaacaacagttgctggtaaggctgtggagaaataggaatgtttctacactgtttgtgggaatgtaaattagttcattcactgtggaaggcagtgtgaaaattcctcaaagatctagaaccagaaatgccatttgccccagcaatccctttactggatatatgcccaaaggaatataaatcactctattataaagatacatgcacagggctgggtgcagtggctcacacctgtaatcccagcactttgggaggccaaggcgggtggatcacctgaggacaggagtttgagaccagcctagccaacatggggaaactccatctctactaaaaatacaaaaattagccaggtatagtggtgcacacctgtaataccagctactttggaggctgaggcaggagaatcgctggaacccaggaggcagaggtcaaagtgagccaagatcataccattgcactccagcctgggcaacaagagcaaaactccatctcaaaaaaatatatatatacatatacatacatatatatacatatatatacacatatatatatacatatatacatatattatataggtaaatgtatatatatgtgtatatatatacacacatatatatacacatatatatacatattataactacatatatatacacacacacatacatatacatgcacacatatgtttattgcagcactatttatgatagaaaatacatggaatcaacccaaatgcccatcaatgatatattggataaagaaaatgtgatatatattcaccatggaatactatgcagccgttaaaataaatgagatcacgttctttgcagggacatggatgaagctggaagccatcaccctcagcaaactaacacaggaacagaaaaccaaacaccacatgttctcagtcgtaagagggagttgaacaatgagagcaaacacgtggatacatggaggggaacaacacacaccagggcctctcagggggacaggggtaggagaccatcaggacaaacacgtggatacatggaggggaacaacacacaccagggcctctcagggggacaggggtaggagaccatcaggacaaacacatggatacatggaggggaacaacacacaccagggcctctcagggggacaggggtaggagaccatcaggacaaacacgtggatacatggaggggaacaacacacaccagggcctctcagggggacagggggtaggagaccatcaggacaaacacgtggatacatggaggggaacaccacacaccaggacctctcagcgggacagggggtaggagaccatcaggacaaacacgtggatacatggaggggaacaacacacaccagggcctctcagggggacagggggtaggagaccatcaggacaaacacgtgggtacatggaggggaacaacacacaccagggcctctcagggggacaggggtaggagaccatcaggacaaacacgtggatacatggaggggaacaacacacaccaggacctctcagcgggacagggggtaggagaccatcaggacaaacacgtgggtacatggaggggagcaacacacaccagggcctctcagggggacggggggtaggagaccatcaggacaaacacgtggatacatggaggggaacaacacacaccagggcctctcagggggacggggggtaggagaccatcaggacaaacacgtgggtacatggaggggaacaacacacaccagggcctctcagggggacggggggtaggagaccatcaggacaaacacgtgagtacatggaggggaacaacacacaccagggcctctcagggggacggggggtaggagaccatcaggacaaacacgtgggtacatggaggggaacaacacacaccagggcctctcagggggacggggggtaggagaccatcaggacaaacacgtggatacatggaggggaacaacacacaccagggcctctcagcgggacagggggtaggagaccatcaggacaaacacgtgagtacatggaggggaacaacacataccagggcctctcagggggacggggggtaggagaccatcaggacaaacacgtgggtacatggaggggaacaacacacaccagggcctctcagggggacggggggtaggagaccatcaggacaaacacgtggatacatggaggggaacaacacacaccagggcctctcagggggacagggggtaggagaccatcaggacaaacacgtggatacatggaggggaacaacacacaccagggcctctcagggggacagggggtaggagaccatcaggacaaacacgtggatacatggaggggaacaacacacaccagggcctctcagggggacggggggtaggagaccatcaggacaaacacgtgggtacatggaggggaacaacacacaccagggcctctcagggggacggggggtaggagaccatcaagacaaacacgtgggtacatggaggggaacaacacacaccagggcctctcagggggacaggggtaggagaccatcaggacaaatagctaatgcatgcagggcctcatacctaggtgatgggttgatgggtgcagcaaaccaccatggcacacatttacctatgtatcaaacctacactttctgcacgtgtatcccagaacataaaataaaatttaaaaaatatatacactgattcatgatctcctttctctccttctgaaacactctttaaaactttttagcatttccccctctgtcttccatgtctcctaactacatgtttcttattttccatttccttattcctgtgttcattttggatagccccttctgacctatattacagtttactagttcactcttcaactgcttctaacatactaatattctgttaaaaccattcatttgggtttaaatttcaattatgttattctctatggacattctatttgttttcttttaatcttcttggccattctctagagtttcctgttccattatgatatttttaattttttgttttactttaaacatactaaatatagttattttattttctgtatctgatactttcaataactgcagtcttcgctagtcttttttctgtgctcttgctcatagtttttttcgtttgttttcatgattagaaaaacagagagagaagaaggagagtaaagggaggaggaggaggaggagaaaagaagaaagcagagaagaagggacagagaaaaaaaggaagttggttctaacgtttctctaacaactgtcttcagtgaaacgctcccaccttgtggatttttaggttattgaaattaaccagtcttctgggtgcagcacaccaacatggcacatgtatacatatgtaacaaacctgcactttgtgcacatgtaccctaaaacttaaagtataataaaaaataaaataaaaagctacacaaattaaaaaaaaaagaaatcaacctaattcctagattaccacctcttgattcaaatgctttaaatctaggcttttcatctgagtctttctttttagttattctgtttatcttcaaaacactcctgctttgaatcattcaaaatctacctccctccctctgtttgactaccatcaatttttttgctcattcctaatgcattaatctattagctgtgaatatccaaaaaccctcatttcactgaatctttgacagacccctttgcatcctcttgttcttctaattatttcctcagacactttatgttctcttttctttacaagcatgccatagtttatatacaatgtgtgtattgtttttatatatacctatatatagcctctttttaaaagcactgtacaccatgctttgaaatatattctaaaatcaggtagcatgaaaatggaaacataacatactaaaacatatgggatgcaacaaaagcagttataagagggacacttatagcaataaatgcctacatcaaaaaagaaaaaaagatctcaaataagcaacctaatattatgcctaaaggagcgagaaaattagagaacaatacaagcccaaagatagcagaaggaaacaaataacaaagatcagagcagaaataatataatagaaactgaaaatttcaataaaaataagaattgttttttgaaaagataaacaaaattaacaaattcttacatagactaagaaaaaagaaaacaaactcagaaatgaaagaagagacattaaaactgataccacagaagttaaaaaatcataacatactactataattaattattcaccagcaaattagataacctagaagaaattgataaactcgtaccaaaactgaatcatgaagaattcaaaatttagaacaaatcgtgaataaggaaattaaatcaccaatgaaaggtctctcataaaagaaagacccaggattgaatggctcagtggctggattctaacaaacacttagataactaacaccaatccttctcaaacgcttccagaaacatgaagaagaggaatacttccaaattcatttttcaaaaccagcattaccctgataccaaaaccagagaaggacactataataaaaataaattgcagaccaatactcctgatgaacttagatggaaaaaccctcagccaaatattagcaaatattatttttaagaaaacacagcaaaaaaattcaccatgcttaagtgggattcatccctgggaagcttattagtcttatttgattcgtgtaatcagaaaatttctatgtctagtgaagagaaatgagagcaatagagactcatagcacctcaacaaatttccaggcttgagccagttaacaaatacaagtccttcaaatacaaaaagactgtgaaagaaaatagaacagatcaatgaaactaagaatttgttctttgaaaagataaacaaaactgacaaaccattagctagactagaaaaacgagagaatactcaaagcaataaaatcagaaatgaaagaggaaatattgcaactaataccacagaaatatagaggatcataagaggccactataaacaattacaagccaacaaattggataacctagaaaaagcagataaatttctagaaaaatgcaacttacctagagaaagtcaagaagaaagataaaatctgaacagaacaatactgagtatggagagtatatcaataataaaacatctcccatcaaagaacatcccaggaccagaaaacttcattgctgaattctaacattttaaaaaataataatacaatccttctgaaattcttccaaaaacttgaaggagaaagagtatttccaaactcattttaaaagatcagcattattgttttttttttaaagtgatgttccccttcctgtgtccatgtgttctcattgtccaattcccacctatgagtgagaacatgcactgtttggttttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacatttggattggttccaagtctttgctattgtgaatagtgctgcaataaacatacgtgtgcatgtgtctttatagcagcatgatttataatcctttgggtatatacccagtaatgggatggctgggtcaaatggtatttctagttctagatccctaagaaatcgccacactgacttccacaatggttgaactagtttacagtcccaccaacagtgtaaaaatgttcctatttctccacatcctctccagcacctgttgtttcctgactttttaatgatggccattctaactggtgtgagatggtatctcattgtggttttgatttgcacttctctgatggccagtgatgatgagcattttttcatgtgttttttggctgcatagatgtcttcttttgagaagtgtctgttcatatcctttgcccactttttgatggggttgtttgtttttttcttgtaaatttgtttgggttcattgtagattccagatattagcactggggcctgttgtggggtggggggaggggggagggatagcattaggagatacacctaatgttaaatgatgagttaatgggtgcagcacaccagcatggcacatgtatacatatgtaactaacctgcacgttgtgcacatgtaccctaaaacttaaagtataatttaaaaaataaataaataaaaataaaaataaaaaggcaaacaaggacactataagaaaagtatgggccaaccaatatccctgatgaacatagatacaaaagtcctcaaaataagtactagcaaacagaatttaacaacatattaggagaacatttaccatgataaagtggatttatcctccagatgtttcagcaaacacaaatcaaatgtgataaaccacattaacagaatgaaggataaaaaaatagctatctctatatatgcagaaaaagcatttgactaaattcaaaatcctctcatgacaaaacctctcaacaaattgggcgtagaaggcatgtaccttaacacaaaacaggacatatataacaagctcacagctcacatcatacccaacaatgaaaaagtgaaatcttttctgctaagatcaagaacaagacaaggatatttattctcactacttctattcaacttatttctggaagtcctagccagagcaattaagccaaataaagaaataaaagatattcaaattgaaaaggaagaagtaaaattgtctctgtttgatgacatattatatataggaaaccctaaaaactccaccaaaaagctattagaaatgataaatgaattcaataaaattgcagaattcaaaatcaatgtacaaaactcagtagtttctttacactcacaacaaactatatgacaaaaataaagaaatcaatctcattcacagtagcatcaaaaaaactgtattttttttgtttaggagcacatttaggattgtacttaggagtacatttaaccaaggaggtgaaagatctgtattctgaacactataaaacattgatgaaaaattgtagatgacacaaatacatggaaagatattttatgttcatgggtaggaagaattaatattcttaaaatgtccttactgcccaaagcgatttataggtttaatgcaacatttatcaaaatttcaatgtcattcttcacagaaatagaaaaaacaatttgaaaatttatatggaaccacaaaggaccctgaataactaaagcactcttgagcaataagaacaaagctgaaggcctcacaatctgacttcaaaacgtattacaggaaaagaacaaaagaaggaagaagagggtagaggagaagtgcagcaagggtggagggaggtgcccgcgctgggtcggaggagcaggagtatggagggaagactcctgggtggcatggagctcttgcacctctaggcactgcccagccctgtgtcagccagggctgaacccccacaggataaggaagcctgtgtgtgtaccaacaatcaaagctacatctgtgacacaacaggacactgctatgggcagtctcagtgttgtaactactactatgaacattggtggttctggctcgcgtggaccatcaccatcatcctgagctgctgctgtgtctgccaccacagccaagccagccctcaagtccagcagtagcaacatgaaatcaacctgcctgcctatccagaagcccgcaattactcagtgctaccattttatttcaccaaactatttattaccttcttatgaggaagtggtgaactaacctccacctgtttccctccctgtctgtccattgtggatgagctctgagccctgttttcctgtgaagattctttgaattgcggccattctattcacatgaactctcacatctggagcacagatggccctctcaaggtaatttattgtatgcattgactgtttaccaaacaaatgtcttactatgtactcaggtatattcagcagcattgtcgactgcagtcccctatgcttgccagaagatactgtattcaaagtagaagtttcacagtgatgagtaatcactgcaattttcccattgctccatggactctcagaggccggtgttctgttccctgtaaatagagatgtactctgaacctttctgcctccctcagctgttcctagtccttggtatcagcccctggagatgtccacaaccacttaggacaaaaggcaaaagtggaatttcagacaaaactttgataggatcttcagtgataaacttggactaactgtggcccaggtatcagcactcccaagaattgccaggaggaagctttggcagacaccacaggtatggcaaggcctatctccctctgctgaatccaacaggggcaagcaagctggcatgtggcttgaggtgacccgaatatgtcagcacccctcagatgtctttctttgcacttttaaaaaaaatctcagaatttgctggcaacatggccaaataggaacagctccagtctgcagctcccagtgagatcaatgcagaatgcaggtgatttctgcatttccaactgaggtacctggttcatctcactgggactggttggacagtgggtgcagcgcacggagggtgagccaaagcagaatggggtgtcgcctcacccgggaagtgcaaggggttgggggaattccctcccctagccaagggaagccccgagggactgtaccatgaggaacggtgcactccacccagaaactatgcttttctcacggtcttcacaatccacagaccaggagattccctccagtgcctctgccaccaaggccctaggtttcaagcacaaaactaggcagctgtttgggcagacaccgagctagctgcaggagtttttttttttttttcatgccacaatggcaactggaatgccaacaagacagaaccattctctctcctggaaagggggctgaagccagggagccaagtggtctggctcggcgggtcccacccatacagagcccagcaagctaagatccactggcttgaaattcttgcacagcagtctgaggttgacctaggacactcgagcttggtggcgggaggggcttccacattgccaaggcttgagtaggcagttttacccccacagtgtaaacaaagccaccagaaagtttgaactgggtggagcccaccacaactcagcaaggccacagcagccagactgcctctctagatttctcctctctgggcaaggcatctctgaaaaaagggcagcagccccagtcagagacctatagataaaacccccatctccctggaacagaccacctaggggaaagggcgcctgtgggcacagcttcagcagacttaaagcatctttgaaaagcctgatggctctgaagagagcagcagatctccctgcacagtattcgagctctgataagggtcagactgcctcctcaagtgggtccctaacccccgtgtatcctgactgggagacacctcccagtaggtgccaacaggcacctcatacaggagagctctggctggcatctggtgggtgcccctcttggacaaaacttccagaggaagaaacaggcagcaatctttgctgttctccagcctccgctggtgatgcccaggcaaacagggtctagagtagacctagggcaaacaccaacagacctgcagcagaggggcctgactgttagaaggaaaactaacaaacaaaaaggaatagcatcaacatcaacaaaaaggacagccactcagtgacctcatcagaaggttaccaacatcagaaaccacaggtagataaatccatgaagatggagagaaaccagagcaaaaaggctgaaaattccaaaaaccagaacgcctcttctcctccaaaggatcacaactcctcaccagcaagggaacaaaagaaaactggatggagaatgagtttgatgaattgagagaagtaggtttcagaaggtaggtaataacaaactcctccaagctaaaggagcatgtcctaacccaatgtaaggaagctaaggacctggaaaaaaggctagaccaattgctaactagaataaccagtttagagaagaacataaatgacctgatggagctgaaaaacatgccatgagaacttcatgcagcatgcacaaggatcaagcactgattcgatcaagcggaagaaagatatcagagactgaatatcaacttaatgaaataaatcaagaagacaagattagagaaaaaagaatgaaaagaaatgaacaaagcctccaagaaatatgggactatgtgaaacgaccaaatctacatttgattgctgtacctgaaagtgatggggagaatggaaccaagttagaaaacactcttcaggatattatccaggagaacttccctaacctagcaaggcaggccaatattcaaattcagaaatacggagaacatcacaaagacactcctcaagaaaagcaaccccaagacacatagtcatcagattgagcaaggttgaaatgaaggaaaaaatgttaagggcagccagagagaaaggtcaggttacccacaaagggaagcccatcagactaacagcagatctatcagcagaaattctacaagccagaagagaatgggggccaatattcaacattcttaaagaaaagaattttccacccaggatttcatatccagccaaactaagcttcataagtgaaggagaaataaaatctttacagacaagcaaatgctgagagattttgtcaccaccaggcctgccttaaaggagctcctgaaggaagcactaaacatggaaaggaacaactggtatcagccactgcaaaaacataccaaattgtaaagacaattgacactatgaagaaactgcattaactaacagcaaaataaccagctagcatcgtaatgacaggatcaaattcacacataacaatatcaaccttaaatgtaaatgggctaaatgctccaattaaaaaacacagactggcaaattggctaaagagtcaagacccatcagtgttctgtattcaggagacccatctcacgtgcaaagacacaaataggctcaaaataaagggatggaggaatacttaccaagcaaatggaaggcaaaaaaaagcaggggtcgcaatcctagtctctgataaaacagactttaaaccaacaaagatcaaaagagacaaataagggcattgcataatggtaaaaggatcaatgcaacaagaagagctaattatcctaaatatatatgcacccaatacaggagcacccagatgcataaagtaagctcttagagacttaaaaagagacttagaccctcacacaataatagtgggagactttaacatcccactgtcaatactagacagatcaacgaaacagaaagttaacaaggatatccaggacttgaactcagctctggaccaagtggatccaatagacagctacagaactctccaccccaaatcaacagaatatacattcttctcagcaccacattgcacttattctaaaattgaccacatatttggaagtaaaacactcctcagcaaatgcaaaaaaaaatgggaatcataacagtctctcagatcgcagtgcaattaaattagaactcaggattaagaaactgactcaaacccacacaactacatgtaaactgaacaacctgctcctgaacaactactgggtaaataaagatattaaggcagaaataaataagttatttgaaaccaatgagaacaaagacataacataccagaatctctggtacacaattatagcagtgtgtagagggaaatttatagcactaaatgcccacaagagaaagcaggaaagatctaaaattgacaccctaacatctcaattagaagaactcaagaggcaggagcatacaaaaagctagcagaggacaataaataactaagatcagagcagaactgaaggagatagagacacaaaaaaaccttcaaaaaaaatcaatgaatccaggagctggttttttgaaaatatcaataaaatagatagaccactagccagactcataaagaagaaaacagagaagaatcaaacagatgcaataaaaaatgataaaggagataccaccactgatcccacagaaatacaaactactatcagagaatactataaacacctctacacaaactagaaaatctagaagaaatggacaaattcctggacacatacaccctcccaagactaaaccaggaagaagttgaatccctgaatagaccaataacaaggtctgaaattgtggcagaattaatagcctaccaaccaaaaaacagtccaggaccagatggattcacagccgaattctaccagaggtacaaagaggagctggtaccattccttctgaaactattccaaacaacagaaaaagagggaatcctccctaactcattttatgaggccagaataattctggtaccaaaatttggcagagacacaacaaaaaaaaagaaaatttcaagccaatatccctgatgaacatcgatgcaaaaatcctcaataaaatactggcaaaccaaatccagcagcatatcaaaagcttgtccaccacaatcaagtcagcttcatccctgggatacaaggctagttcaacatacgcaaatcaataaacataattcatcatataaatagaaccaatggcaaaaaccacatgcttctctcaatagatgcagaaaaggccttcgaaaaaattcaacagcccttcatgctaaaaactctcaataaactaggtactgatggaacatatctcaaaataataatacctatttatgaaaaacccacagccaatactgaatggtgaaaaactggaagcattccctttgaaaaccagcacaagacaaggatgccctatctcaccactcctattcaacgtagtattggaagttctggccagggcaatcaggcaagagaaagaaattgtctctgtttgcagatgacatgattgtgtatttagaaaaccccatggtctcagcccaaaatcttcttaagctaataagcaacttcagaaaagtctcaggatacaaaatcaatgtgcaaaaatcaagcattcctatatgcaaaaaacagacaaacagagagccaaatcatgagtgaactctcccattcacaattgctactaagagaataaaatacctaggaatccaacttacaagggatgtgaaggacctcttcaaggagaactacaaaccactgctcaaggaaataagagaggacacaaacaaatggaaaaacattccatgctcatggataggaagaatcaatatcatgaaaatggacatactgcccaaagtttttatagactcaatgctatccccatcaagctaccactgactttgttcacagaattggaaaaaactactttaaatttcatatggaaccaaaaatgagcccgcagagctaggacagtcctaagcaagtagaacaaatctggaggcatcacgctgtctgacttcgaactatactacaagtcttcagtaaccaaaacagcatggtactggtaccaaaacagatatgtagaccaatggaacagaacagaggcctcagaaataacaccacacatctacaactatctgatctttgacaaacctgacaaaaacaagcaatggggaaacgattccctttttaataaatggtgttgggaaaaccggctagccatatgcagaaaactgaaactggatccctttcttacactttacacaaaaattaactcacgatgtattaaagacttaaacataagatctaaaaccataaaaaaccctagaagaaaacctaggcaataccattcagtacataggcatggacaaaaacttcatgactaaaacaccaaaagcaatggcaacaaaagccaaaattgacaaatgggatctaattaaactaaagagctcctgcacagcaaaagaaactatcatcagagtgaacaggcaacctacagaatgggtgaaaatttttgcaatctatccatctgacaaagggctaatatccagaatctacaaagaacttaaacaatttacaagaaaataacaaacaaacccatcagtgggtgaaggatatgaactgacatttctctaaagaagacatttatgcagccaacaaacatatgaaaaaaagctcatcatcactggtcatcagagaaatgcatatcaataccacaatgagataccatctcacgccagatagaatggcgatcattaaaaagtcaggaaacaacagatgctggaaaggatgtggagaaataagaatgcttttacactgttggtgggagtgtaaattagttcaaccattgtggaagacagtgtggtgattcctcaaggttctagaactagaaatatgatttgacccagtaattgcattactgggtatatatccaaaggattataaatcattctactataaagacacatgcacacatatgtttattgtggcactgttcacaatagcaaagacttggaaccaaccaaaatgcccattcagtgatagactgcataaagaaaatgtggcatatatacaccatggaatactatgcagccataaagaaggatgagttcatatccttttcagggacatggattaagctggaaaccatcattctcagcaaactaatccaagaacagaaaaccaaacacccgatgttctcactcataaatgagagttgaacaatgagaacacatggacagagggaggggaacacaacacaccggggcctgtctgggggtaggggctgggggaaggttagcattgggttaaatacctaatgtagatgatgggttgatgggtgcagcaaaccaccatggcacgtgtatacctatgtaacaatcctgcatgttctgcatatgtaccccagaacttaaaatataatttaaaaaaaaatctcaaacaactcactgaagtgtctcaaagctgaacaagttttaccaaaatgaatccttctcagttaactgatcaaatggatgaatcctgaccctctgaagtctctttcctgagttagagcagggaactgctctgagtgttaactgttggattcactgcagtgtcctacaatattttacaagaagatgaacaggcaacctgcagacctaagcttgattcccaagtcacagtctgacccctgctacaggaggttaccctcctcaggaagagatagaaatagggaatttgaaggaatagtgaggggaccagggagatttgattgagtctggtttccaggtgaattaaaaggaagggtgtcatccagggtttgttactacagtcaaaagaataaataaatcaatgaagaaataccttcattgtctgtggttttcatgcagatatactcatggaggttgtatctctccaaaaacagacaaatccaaggctgtgaacaagcatccgcatttgaattccattaaaccaaaatctatgttgaacgaagtgaagtctgtacacagcattgcaaatgtgaacacattcctgtgtgaggcacatcaccatttgtcagttattgtgaatatgtgtatttttaagcaataagatgcagctggtcagttttctgggcaatcttggtgaggcatttcctgtgctgtggttgttctctaaccactgtgagaaacccaaataaaaatcgatcccccccaaaacaagtacgtatcacaaaaccatagtaatcaaaacaatatgacacttgcacaaaaacagacacattgaccaggggaacagaataaggagcccagaaataaactcatgcatttatgaccaataaatttttgacaaaggtgcccagaaaacgtaatgaagaatagacatttgtttcaataaatggtgttaagaaaactagatatccacatgcagaagaacacgaatgtgtatggtgtgtatccttatctcacaccatacacaaaaatcaattcaaaatggattaaaggtttaaacataaaactgtaaaactactagatgaaaacataggggaaaagttccacaatgttggtttggtcaaagatttcttggatatcacccccaaagcacaggcaacaaaagcaaaaatatatgggattgcatcaaactaaaaagcttctgcacagcaaaggaaacaatatggtgaagagacaacctacaagttgtgagaaaatatttgcagagcatacatctgatgaaaggctaatctccaaatatataagggactcaactcaatatcaagaaaacaaataaccaagtcaaaaaatgggcaaggtcctaaatagacatttctcaaaaaaaatacaaatgactaacataaaaaaagtttgtcatcctaattatcagggaaatgcaaattaaaatgacagtgagatgccacttcatacctgttagaatggctactatcaaaatgataaaagataacaagtgttgaagaggatacagagaaaagggaaccctcgtacactgttggtggaaatgtaaattaatactattatgaaaaatagataaaagttactcaaaaaactaaaactagaattactatatgatccagcaatcccacttccttgtatatatccaaaggaatttaagtcaatatgctgaagagatatctccaggctcatgttcattgcagcattattcacaatacccaaatatgaaatcaacacaggtgtctatcaactgacaaatggatgaagaaaatgtagtgtatatatacaatggaatactactcagccttaataggaaggaaaacctgatatatgtgacaacatgaattaacccagaagatatcacgctaagtgaaataagccaggcacgaaaagacaaatatcacatgatctcactgatatgtggaatctaaaaaagttgaattcatagaagtagagaatggaatggtgattatcagaggctagtagttgggggtagacatggaaaaggtagatgttgataaaagggttcaaagtttcagttagacaaagtttcagtgaactattgcacagaatggtgactgtaataaataacaaggtattgtatgtttcaaaatgactaacagagtagattttaaatgttttcaccacaaaaaagatatgtatgtcaataagatagacctaatctttccacaatttaaacatgtatcaaaacattacattgtaccccataaatagatacaattattatttgtcaatttaaaatttttcactaatttatattgttattgttgcaccaactcctttccaccaggcagattctcataaagactattttctcttttacatgaagcatttcctacacacctcttaatcacggtagcattgacgtcattccaccagattctatctccagtgttaaaataatcaagaacccagaaatctccaccagggggcaaccaatgcgtatcaaagtttcccactttcctttagatttacttatgggtaacttatgggaaaaaatacttaagtacttccctttttaaagaaaaaaattatatgaattctacaaaattatggcagaaaatttaagaagagcagatgcttcccaactcattctaaagggccagcattaccctgattctgaaacgaaaaagctttacaaaatccaagatccattcctgactaaagataaaagaaattttcagcaaactgtgaatacagaaaactttctcagcctgttaaagagtacctatgaaaaaaattatagctaacattatacttaatgatgaaatatttaatatatttcataacaggaacaagtcaaagatgtctactctaactaattctactcagcattcaacaaaatgaatatagtgaattcatactagaattttaaaagcaaatgtctttattcactgacaacataatcatctataaagaaaatcctacataacctataaaaaactgatggaacttataagttttgcaagtttacaggatataatgtcaaacaaagatctattatgtgcccataagctaagaataaacaattgtaaattgaaataaaaatgtcacttaaaagggcatcagaaatataaaacttagagataaatataaagtacatatgcataaagtacctgttcaccaaaaactacaaaacattgctgaaagaaattaaatgggcataatatagatgtagagatgtgttgaatttatgactcattttgaacaaggaatatattcatcatatattcatcagataagaattatgttacaggtctaataacattcaaatcaatacataatgtctcatagttcctgaatctaaaatatcaaagaaagaaacataaagccatatcatgtttaatgagaagggcttattatatcatttatgagatcctcttgtaaatcactagctgtttgcatactctctttattgctgccttcatctccttattcctgaatgtatagacaactggattcagaaaaggagtgagaactgcatcaaaaatagccagaaacttgtccatctgtgaattagggtgtggccgtgtatacacaaacatgggtggaccaaagaacaaaaggaccactgtgctgtgagctgaaagagtggaaagggccttggatgaaccacctgaggaatgtttccaaacagtaaacaggatgaagacgtaggagattagaagtatgaagaaagtacccacacagataaacccactgttaacagtgaccatgaactgcaatctgtaggtgtcggtacaggctagtctgagaagccgaggaaggtcacagtagaagctgtccaacacattagggccacagaaggctaaattaacaagaaatgccagttggaacagggagtgactgacaccaagggtccaggcaacagccagaaatgaaaggcacattcttgggctcataatggtcagatagtggaggggcttacatagggccacatatctgtcaaaggccatggctatgagcagcaccatctccacaccaccaacgacgtggatgaagaagatttgagcgatgcagcctccaaaggagatgactttgcgctttctgaacaggtcataaatcatcttgggagaagtgacagagcaggctcctaagtcaatgaaggagagactggccagtagaaagtacatgggggagtgtaagtgagggtcagtggtcacagaaaacacaatgaggatgtttccagtaatgcttgccacatagagcacagaggaaaacactaggaggaggagctggatctcccatgaatgagtgagtcccagaaacaaaaactcagataccactgagtgattctctccatccattggtccagccaactgggctgtggctaaaattatgagaactaagaaaatggggaggaaattgtgattatgaagataataatatgtactaaaatcaatattgcaatgtcactatgaataaatagtatacagttattctgttcctcacatattaaaaacaaaaaatcaacataatattatcacaacatgtgagctgcaacctgatttaaacccatcatcaatactttcagtgtaatgtctgatctaaaattaacagattaggtaagaacaagattcctgactatccatgaaattcatcaggtgtttaaatgacctgtgatattaactattcctcatttccaacatattccatttgtacttatacatattcttataatttccttcccttcccagtttgcacccacaattctctgacagaaagtagacataagaggaaaacatgattaacagatggattatcactgcagtaagaggtgcctgggacagacttagttgaggtaggctgtggattgagagaatatagagactggggtatgtgaaatcggaaagcccacaactgtagcagactagagtaagtggactttcacaagaaatagaatcaccaccattatctaccacattttctcatgcttactgctatttaagtgcctcagtttctatacaatctttcacaattacgaagccctaaatggcttcccatcctgcaatgatttcataaggagcctatgccacctgtcatgtaaggctttttccatgcctaataaatatgttttggagggatttcaccagtgtttctgctaagatacatgcataaaatggccacagaggttgtgagaaatctctgcagtttctctttgtctatacacatgaaagtattgaagaccagcacttggattagttaagataatgttttaattcatcactgtctcctcctccccttggtaccagcttttatgttcattgcattccccacccttttaagtactcagtacctcctgcatggtaacctattctgatatttgatattatcatgcttaatttgactgaatccattcggatattttatctttaagaaatttgtagttttatacttttaatttatgataaaattagattaatatcaaacattaacaagtgacttttaggaaggtatatgagctttcttattgacttcaaactataaagtacaaactgtgacactagaaatttagtcctttaacacatattgtatttatatgtgaagtggagggtgagcagaaaacagtgttatatttctctgtgtccagatggatactcacctcaatcattttcctatagtagaaagtagttcctgaaaacacttaatagagattattttagaagttgctgaggtacaaataaaactgctatgctgacatcatacttttttgcaccaacaactccagttcttctgacacaaaggaccatcttcctagtgccataatttatcttagaccccaaaactcacagaggcacacatcatatctctaatacttgctcaccaccactggcatgagtctctctctatcctcttctacgtgaagtgattatactgtcacctctggagctaactgtccacagtctcaagatgcacactttttacaaccagaagcctatggactgggtgagggagcagaaacagccacaggtactgcccatcagggtaatgtaagtcagcatgcaaacaactgatcagatgaacatgaatagcaaggtgctgaggcactgggaagagggaccggaaaactctataattgttgaaaaagactcaagcccttgggaagggaaatgcctacgaaattatataaagaccattttatccaagttggtcatcattcagatgaaaaccatgaggcccagaaaagtaaactgagtttccagaattcacacaattgatagaataggaaccagaattcaggcctcttgcttcctattccagaaagacaaattgcaataataatcaaataatatgagcaatcatccagtaaaaataatctagtaaaaacagcaaaactcaaaagagtgatttttcctggttaagaccaaaactaaccatagattgctatacatagtatctattataaatactgaattatatagcagcctgacaataaatacataaaatgtgtacacaaagattattgaacctgtacaatacagtagtaaatagtaactttatatttgcaaagtgactgatcattactatcagaatttgtacccattcttcatattttgttggtcatataaccagttactacaactgcaaaaacaacctaaggtcatgtttctgtgaagtccatccttttggtctttaaattttattatcctcaaaggtcaattatgatctcaatcttttcttgtaattttactgacaattctccttcacactgatttgttctttctctaattcctgtaaatagaaagaaccaaaaaaagttgaaaaaacatgtattgtacatataacaaacaatcatatgtggtatacaatatatatcaaatgagtattaagataaacattcaaagagttttaaagaaaaaagtgttatagatattggagggcagaagagacgattgccattaagaacaggtggaggaggttatgccaaggacattgacctgaccctttaggaattagtgaaaattgaataggagaagaatgaggtatacaatgtgtgaaaaatacctaaattgatataacaggaggagaccttttcatatcaattatcattacttctgtgtatataaccatattagatacccacaaacgaatagaaagtggatagttcttgattgacaagtaagactaataatcccagatcatagtaaggtcttaacttcaagtcaataatctttattacttatggttcattcctctccctcatgttttccaataattttaaaatgcataattaaaacaattctcatttaaaaacatagtagccatgactaatgatcttccagtgggaaggtactaagactttacaacatgtttcttgctggggataagacagcctacagccagcattcaactcatttttctaaagtctatggatcaatttgaaatacagaaaaagtagaacagagataaagttaaaaaaagattaaaaatatgggaagaatgggagaaaggggagattagaagatatgaacaatgatttaaaaataaaagagcctcaaaggagaagagaaactgctaagcaagactaaggtaggatgaaatacagtagtctctgtttctgagaacacaggttaaaaagaacataaataaaataaatttatcacctttaatacactcattcaaggatgctactgagtttgactttgggaatttctcacctttaatacactcatctggggatgctacggactgtgacattgggttgcatttaaagggggagagaaagggcagttgcttctattatcgccctgttggactcacagagtttctttgaaaagcacagatgataataaatggaaatattgccttttatactatacaataatatacacatgcaattcactggaaaaagtatacttgttactatgatttgaggatactaccatatactaatcaagagaaacacatgtacagaacaaagaaggcacatgaaatttttactagtgtgtgttttccttgtgttctaccaccccaggagcagcttctgctactgaagatcacagtagagttatttccaaaagttgtgggtctgcagggtggacttatcacatagctgtttgccaaaattcaaaagtccagaaaccatttccaaattttcacctcttttatcttcaaatcctaaaactatgaaaattcacaaacttagctccatacattatggtagaaaggttaataatttggactttgaggttgaccaggcctgatttttgaataaattcacaaacttacctccatacattatggtagaaaggtcaataatctggactttgaggtcgaccaggcctgatttttggatccaggctgcaacactcacttgctgtgttaacgtaacaaagttcctagaccatgctgagcttcagtttacttgttattgaattagggatatagcgttcgaaggaagaagttctagtatttgattgcacagcagagaaattatagttattgaactggggatatgtagatagacataataaattttagtattcaattatacaatggagaaatcgtagggaacaataatttattatatattctaaaatagctagcagagaaaaattataatgttcccaacacaaagaaaagataaatattcaaggtgatgaatatccaaattactctgatttgatcattacacattgtatacatgtatcaaaaatatcacatgtaccccaaaacatgtacaactatgatacatcaataaaaaacaacaaaaaaaccaaaagaatagaaatcaaaaataaatacataaatacataaaatagggataataatacctcccttgtttgcttgctcccttgctccatttgtaagaaataagtgatataatataggtaaaaatacttaacctcatgcctaccacatagtatagcacaataaatgttatttattataatctgaggcctacctacataagtgactttcaagtatagaaaattatttctcaaattttaaatactccctgattctcaggtatggtaattagacctggctttaggtaaagctctcatgtctacacttggatttaatcacttaagtatatttcccagtgccccccccaaaaaaaattgctcctaggtggacacactaatcaaagacttcctgagaaatgcaggaagaagttttgtcctctgaccacgctacgccctttccttgatggtaagccccataatctaaagccataagtttcaattcctcacataaaaagaaaaaaaatgtcttttatgaccacttcagataacactggatatttcccttgtcattaggaatgagaaatgggaggaaggtaaacttgtagacaggagaattggtagatgcttgaaaggatttctgaaaactgtgcctatccaggtgtacaaatgtgttgaccagccaaggcaaagcagtcaaaccatacaataccttatcctcaggaaaatggacttttctcccaaattgcctttttcatgaaaaatataaaattctccagtttcaacctcatgttaaatttcacatgtgaagaaaacagtcatgcacatcagaaaattaaatggcgagtcaagaccaaattcctagtcacagttatgttctgtttccagtattaccttctcacttattcattttgttaaagtggagccaaaatagaagtgggtgtcacacatcaagaaagactgaagtcgtacaaagccgatccttatccaacgtgcattaaaatatgcatcaggcatgtgtgatgcatacagtagaagtggaacaaatcaggccaggtgcagtggctcacgcctgtcagcccagcactttgggaggccaaagcaagcaaatcgcttgagatcagcagttcaagaagtgtaacaaatcctctacaatataagtagagtgaaaagagatagctacagtgatgagggaaggcactatagtgatgtggcatttgagtatagccataaaagaggataaatattacaatacatgaatatagggtctaaagaagtcttttcaagtagattgtaaaatatttcaaaaatggtaagtttggtgtatgttgaagcatacagattgtctacatcctaaaaatcattttggtgaataaaggaaaataagaaaggtagtcaatattcatttgttgcctatcattagaaacttctcaaaggtatatgagaattattaaataaatttaggaagccagtgaaggtatgggtcccgggaattgaggatgaagccagtaattagggaagatgccccatctataagtgtgatgtatcaaatggaggaaaagaaaaacggagggaaggagttcccttaagagaagattgaaatagagcagacttggggggctacacagaggaactgggactacacagttccagctttaaggctatagaaacagaaatagaaatactggtaagtaaaaacccaaaggattggtgacttatcacagctggagtgaatacgaaggagcatgaactcaaagaaaatatcaagatttaagcaagaataaataggacaatggtaggtccatttttagaaattagaaagttgaacataaaatatgtcagggtggagaaaataatcacgtgtattttaagcaaataagagtattagatattgagatgctcaggtgaaaacatatgacaggatatatgggggaaaagtacaaattcaacatgtaattgtatagtaatccatataaaaataatagacggatgtgtaagagtgcataaggtccctgaaggaaataatacacaggaaaaaaagattaaaaagcaaagacccaactatagaaactatccacattgattatgtaaagtaggaaaaggaatcaataaactagacagaacatcacagaggtaggaggacaagtgctggcctcgaggagccaacacagaagcaggtatcaagaataaaggaggagaagagagaacaaagagagagagaagagaacttctgtggcagaagatcaagtgggatggtagaataaaggagaagaaatacaagaaaattgaaataaaatttacagaaatgttctacattgtaagtgggcagttttgacctggcacattgttggcacacattataaatgtcaaatgtattaatgaatgaatgaatggataatataatgaatgtgatggagttgtcaaaagctgaattaattaaaagtccccacgagaggttagatgacaaaattttcagaaactttccatgccactctgttgtgacatcaacagtgctggacccttgaaatcaaaccaaaaggattccaccatgagaatgaaaagggctgagaaggggaatgctgggtgacacagaaggtgacaaagggcgaaaggtttctaggcatttgatagactgatggacgtccgcgctgaccataaggcacaggccacacaggaaggaaaatgagacccaacgcgaagaaaagtagggctaaacagtcgggaaaatgtgggaagaaggatgaatagtcatacgatcaactcagattcctccctgacattcttctacagctttattctcgtcctttgggagccgagatgttcattttcctacattcttagctgcctacacacggcgacttttctccacggtgcctgatccctgctgcatcctccttctctagtggcaacagcaaatggccacacagaaggcagacattgcacccaactgaggagaatgtaattcactcattgccagtcacagaccttggctcaccgatttactaagtatagattttatttctatccctcacctacctgttttgccaagggaactaagaaaagagcatcatcaaaaattcagataggtatagttctcacaagatgaaccagatccagtacggcatcactgcagacatacacacagagctgcataaaacaggaagagagctgctaatcacagccccagagggtagtggccaaagtgatgccttggagatccgagaatgccagactgagatcacacggcctggggaattaccgcctatggtcattttggttttcccgggatagccatgttaattgggtgaaataaagcatatttgattttcttatgacaaaaaagggcttttgccattgtctacagatgatactttaaatctttattttatgactaaaggtgaattccagagcaacattaaatgttgtccctttaaatttttaatcatttacataacgattaccataatattcaatttaaacataaaatgtaattgaaagtatgagattaatatgtggacatgaaatcatataatgttccatggaaaaaatagaatgtataaggcaaagaggtttaaagtaacatcaaaactaatgctcactatacaaattctatgaaatcctcataattacactgtgaagcaggtgttgttagagccacataatctcaaacaaattatttattatctaaaattacatagatattaaaaggttaggccatatatgaatttaggattctctcaaaaattttttctctttctcctacatcaaacttccctaaattatagaaaagtcacaatgttaccaaacatattcacaaaacacatataatcttgaatccaaatttcagttacagcagaaaaaataaaactctagatcaatctcaatcgtgtaaataaattcagatttccaatctaagagtctcaatttgacatacttctttctctctcttctttcaaaccaggagaaatataaatatgagccacaaccttacaaaagctagaaaatatttacaattccacacaacaacacatgaagaaaaccttctggacatcaaaagtttaaaccagtcaagactgaacaccaagataaagtgcatgcctctgaagagcttgagctagtcaagaagcccagaaatccctaaaagaggtgtgtatactgaggactgaggatcaaaacctgtgatctttacttggaacagaaatattgcagcatgtgaaccctccacagagtgacagagggaaaggagtttaaagggaaacatgcaaatgtatcacctttggaataattaggacacgtgtgtggtgtaatgaaagaaggcaaaaagatggggaagaagccagacagatggcaattttcattctattatgaaaagaaaaggataagtcacaagtcacatgatgaaattaacaactatgaatccactctaagccatagtcaatcctatagcctaggagtcattctaacagatgagagtgttttggagacaagattccaaaactcgtctgccttccatcatacttactacccccagctcctcctccacaatatcctttcacaagtatctagaatattcaaagactaataatattatataattatttataataattgtattacaaaaataaaacttgatgacctttataaaaatactagaagaaaaagggaaaattacataaggtacagaacatacaaattataccatgaagcagtaaaaaacaggatcaaattttctatgttttttaaaaatatgccttctctaaaatgttttctctctgaaatgatatttagaagacataattgaaaataaatacaaaataaagtgataaaaaataatctggcaaaattcaggatgtaatgagtaaagacaaccatgaaagaaatgaagatcaataaaagcaggaaaaaaagtgggaagtggagagaataatgctgctaaaaacacagataagaatataaatgacaggcttaaatatatcctgagcaaaacgaaatagaaaacacaagaaggtgaaatgtaacattaaagtcaggtccaacaaatgagaaattagtgtgaaagagctcacaatatctggttaaaaaattcaaagataaaagaaaacttttctgaaatgaagaaaacattgaatctaatggttaaagggcttatctttatccagaaaaaatgtgttatagtatgaccacatcaaggcagatgcaactgaatttaccggacttcacaaacacaaaataaacaacccacaaaaaaaaaaaaaaatagagtccccatgaggctttaatgaagacaactattagaggccaggcgcaggggctaacacctacagtcccaacactttgaaaggccaaggcaggagaatcacttgagcccaggagttcaagataagaccagcctgggcaacatagcaagaccccatctctatcagaaaaacttaaaaaagaaaactatccactaaaaatgaatagagataacatgatacaagtgagcattctgaagcctaatatcaaaatgttctggggtttgcggttaaagaacagaatgcaaatgttacaaaccataactgtataaagactaattatattcataacaaaaataagaagagaaagatagtagaaatatattctggtccattcaactttcacagtgggagagaatcaacaaattatgttatgggtgattaaatattattttaaaagataaaggtcattattagaaaaattaaaaataacaaaatcaaataaagttggatgacgaaggtgggagaggaaagtgggtttaaggggtaaagtggaactatattaaaagagtcaatggagagcacccttggaaataacacaaaaattaaagaactaaatataatttatacagcacataactaaactataaatcttcaaattaaaagaaaataggtacatacaaaatatcacatacagagaaatattaataccatgaaaatattaaaataaaagcataaaattaattcatttatttaccctattagtattttttgaacacctatgtgccaggtattgtgctgaatgccagtaagatatagttcctgcatcttggagttttcgtggaggagacagagattaatcaaacaatcacacaaatgtaaaattgcaaccataaaaattactctgaaatacaatgaaaattactataagagagggatttgatgtgagtcagagaagtttcccctaagaaagcaacactgaagctgagatctaaagggtaaacagcagttaactgagtggagaacaaaggttttcctgcagggggaacaatctgctccccgaggccagagtggggccttgggagttgtgcctgaaaccacattgtgaggaagtgaggggaagcattgtgcagataatgctgaaataagtagtggaagatgcttcctaagagaatgagaaatccaagactactaagcagaagaatgatttgaccagatttcacatttgtaaatatcactatggttacaatgtatagaatggattttaaggaattcaaattggatacaggtgagtcaattagaaagcaacatgcttgctaaggcaagaaatttgattacttaaactagatatgggagttttggaaataagtagataaatttgtcatatatttgagataataaatcaccatgacttgatggtagacttagttggagatgccctcactaatgcaccatctaatgcttcaagtctaataattattcaattcctccagagccaccaatccaatggttctaccatatttatgctgtcattcactttactgatatccttcttaccttacctcttttcccactttatattccatgatcaataccttgctccctcgtaatgattgtactcactcttccaaacaacaatcctgataaatcctactctctgccttctacatcttgataccacacagctatatgtggctagataaaacaatcacactgacaatcatcctatactttctgaatccatcactcttctactttttcagatcttttctttctccctcatccttaccatgtaatgaactcattttgcatgtcaagggctaaaagttgaatattttaaaagttctcattttcccactactatataaaccaacaaatatctttagtctgcattcacaaataacataacaaatgagctcttcatatttctatccgtggtgaattaagatgactagaaattttgtggcaccatcccgttgaaaacgtggggacatattctttctccttgaacctgggtgggctctttgactgctttgaccaataaaatacagtgaaagtaaaacttccagttttgatgtccagatgttaaaagccttgaagcttccatttctacatcttggaaccaacgtgtgtgggtgctgagtcagtatcgaagaattctgcttattctgcttgcattagtccattttcatgctgctgataaagacatatccaagaccgggtaatttatgaataaaaagagtttcatggaatcacagttccatgtggatggggaggcctcacaatcatggcagaaggtgaaaagtatgcattacatgggagcagacaagagacaatgagagctgagtgaaaggggaagccccttgtaaagtcatcagctctcatgagacttattcacgaccataagaacagtatgggggagccaccccatcattcaattatctctcaccaggtccctccacaacacatgggaattatgggagctacaattcaagatgagatttgggaaaggacacagccaaaccacctcattctgcctctggcacctcccaaatctcatgtcctcacatttcaaaaccaatcatgccttcccaatagtccccaaaagtcttaactcacttcagcattaactcaaaagttggcagtccaaagtctcacctgagacagggcaagtctcttccacatataaacctgtaaaatcaaaagcaatttagttattttctagataagataggagtacaggcattgggtaaatgcagccgttccaaatggtaaaatttacccaaaacaaagggactaaaggctccaaacaagtccgaaatccagtgggacagtcaaatcttaaagctccaaaatgatctcctttgactctatgtctcacatccaggtcatactcatgcaagtggtgggttcccatggtctcaggcagctccacccctgtggttttgcaggggagagccttcctcccggttgctttcacaggctggcattgtatgcagcttttccaggcacacagtgcaagctgtcggtggatctaccattccggggtctggaggacagcagccctcttctcatagctccactaggcagtaccctagtggggactctgtgttgggggcttcaaccccacatttccattccccactgccttagcagaggttctccatgaagacctcacccctgcagcaaacttctgtctggagatccaggcatttccatacattctctgaaatctaggtggaggttcccatacctcgattctggacttccgtgaatccacaggctcaacaccacatggaagctgccaaagcttgaggcttgcaccctctgaagccatggcctgagctgtaccttgaccccttttagctgtggctggagcagctgggacacagagcaccaagtccctaggctgtacacaggcaaacagcagaggggccctgggcccagcctatgaaaccattttttcctcctaggcctctgggtgtgtgatggaaggggctgccacaaagatctctgacatggcctgaagacttagcgattaacatttggctccttgttacttatgcaaatttctgcagccagcttgaatttctcctcagaaaatggatttttcttttctatcacagtgtcatgctacaaattttctgaacgtttatgctctgttttcctgttaaaactgagtgcttttaacacacccaagtcactcttgaatgatttgctgcttagaaatttcttctgccagataccctaactcatctccctcaagttcaaagttccacaaatctctagggcagggacaaaatgctgccagtctctctcgatagcaagagacacctttactccagttcccattgagttcctcatctccatctgagaccatctcagcctggatttcattgtctatatcattatttgacattttagtcaaagccattcaacaagtctctaggaagttccaaactttcccacattttcctgtcgttttctgagccctccaaactgtttcaacccctgcctgttacccagttccaaagtcgcttccacatttttgggttatctttacaacagcaccccactctaccagtaccaatgtactgtattagtctgttttcatgctgctgataaagacatacctgagactgagtgatttatgaagaaaaagacacttaatggactcacatttccaggtggatggggaggcctcacaatcatggtggaaggcaaaaggcacatctctacatgatggcagacaagacagaatgagagctaagtgaaaggggaacccccttataaaatcatcagctcttgtgagacttattcaagaccacgagaacagtatgggggaaatactcctgtgattcagttatctcccgttggatccctcccacaagacacggaaattatgggagctacaattcaagatgagatttgggtggggacacatccaaaccatattgctgctgaatagatcatgtagacaggctctcaaactacacggagagcaagagaggcccaccttaccacaacatttcatccaatccactaataaaacaggcacatcactgaagccaccttcaactctccagactacccagctgccagctgaataccacagatggctacagttaataccacatggagcagaatcatgtagctaagccctgcttgcgctaatacaagtccacaattttttttaagtttgttgttttaagctgctaagttttgaggtggtttgtggtacgtggaataagatgtcactctaatataatataaacttaaactatgtggcattggctttggaatcagacaatggatagaagccagaaggatttcacaaagactgttagtgaaaagtgaacagacttcaaggaaaatgatagcaaaacctgtaaaagcattctgggaactgacagtaaacactgaatggtccttaaggagactgaaaacttgaaagagcttaagaagtctactggaaagggctttaaggataatgagaaaaaatcatcagtggaggctgaggaaaacgcaccaaagtcatattctgatgggagaattagaaaacgcttgcctggaatgatataaaaaataggaaaaataccgaaaaagtttgtggatctggctggggagatttttggtgtcaactaaagaaaaaaattaagcttttaagaaattaaagttagatttatttaggggtctgagaacaagagactgaggattacagcctaggagaagtcttccagagaggttctgtcagactgctctggtgaaggtctttagcccacagtttatatgcaggctgtacatatacaccatggaatactatgccgccattaaaaaatgatatcatgtcttttgctggaacatggatggaccttctattatccttagcaaactaatgcaggaacagaaaaccaaatacagcatactctcagttataagtgggagctaaatgatgagaactcatgaacacaaagaataaaacagacactggggtctacttgagggtggagggtgagaaaaggaagagaagcagaaaagataactattgggtactaggtttaatacctgggtgatgaaatgatctgtacaataaccccctgtgacaccagtctacctatgtaacaaatgcccctaaacttaaaataaaagttaaaaaaaaagaaaattaaaatctccttatcatctacctggtaatatgaaaaacacaaatctttcattcattcctttcaactgatgaggaaaatgaggcatcgggagttagtaaaagtccacattgagatatgagacccaccactggctggacgcagtggctcacacctgtaatcccagcactttgggaggccgatgctggtggatcacctaaggtcaggagttcgggaccaggctggccaacatggtgaaacccccatctctactaaaaatacaaaaattagctgggtgtggtggcaggcacctgtaataccagctactagggaggctgaggcaggagaatcgcttgaacccaggaggtggagtttacagtgagccaaaatcacgccattgcactccagcctgggcaacaagagcaagactctgtcggggaaaaaaaagaaaaaaaaaaaccaccgccatcattttgcaagtgttaccactattgtgtgttaatattgtagaagtattcctaattatgatttctttgtattcctaattgtaatagctttgtatttgaaaaattattgattcatactctatatgttattattttgtatgtgatgacaacagaatatattatcatgctccttttgtgaatctcattcataatataaagtataaatttgtgattttgctttaatttgaaatattaacttcaaatatgttatcacaatttgatacaaactattgacagtaaatctgtggattaagtaatgtcttagtaggtattgggaaaatttgaaactagtaacatggaggactattgtcattgtttatttcaaagccagttaaaattctgcaaagcagtgtacataaaaataatttcaagaaatttataaaataccgagattatggtgtataaacaactttagattctttgtttaagaaattctgccagtttgtaatatatgcttcattcaaagtagctaagggctgtacctggctaatagtaggcacctaatatttgttgaaaaggaatactgagtagctgggacctcctgagtagctgggaccacacacatttaacctgtatttataaaattactgtttagagaataacatttgatggaatcatgcttttactttctgcttacgactcaattgtttgtactgacattaacatcccaaatccttagcatggcctacaaggccctgagcaatgtggcacctgctgaagcctgctgcctcatttaataactctttgtctctttcccagatccagccactctaacattttttagctcctggaccaagacaagctcttcccagaacctgacctttgtacctgttctttattcctggagtatttttcccctgacaaattacttatcatctatcataattcaggttaaatggcactaactcagggaaggcttccctaactgcctcccttctccaaccaaattaggaacaattatatggccacatagtatcgaatcaagtttataattttaaaataattgggagattttgttgtttaacacttgttttcactataagactgtaattacatgcaagtaagaaccatgcctgtttgttcactcctgccacagtcagaatagtgcctggaatatgcagtaagggctgaacaagcactaaataaatgaacaagtgaataaatggatattgtctcatttttagaacagagtactgaatggatcatgaacactatctggtatgtcacgtaggtaatttacaagggctacaatttcagctcagatttaccttttcctggatacaggtcttgataggtctcttgatgtcatttcacttcagattcttctttagaaaacttggacaatagcatttgctgtcttgtccaaattgttactaagaatcaagagagatatctgacatgaaatgacattggaaaacattaaacacgattgaaataatgctagccaatatggttattattagaaaccaattacattttcaacttaaaaatagtaatacttattgcagactcaaatgtgcttattctaaaacaagtaaatgtttgcctatggtctgagattctaatccacggagttcattctaatccacattcaacactatcatgtaccagtgggcctcataacccacctagccctgtgatttttcaggttcacttttctaaacttgtgaattaaatatttattttcttagttcagaagaggaaaaaaactcttgtaattgttgcccatttcaggagaaatcttgcatatgaaaacaagagataaatatacacaactgagggctgtggtttaaacaaaatcttgagaatgttttttgaccttacacatttgtgctttagtataacaaaatgatatagacaaaggtaacttttaatagaaccagtcactaaattaaaaaaatgacaaattcttctgcttagctaagcaacagagaaggtaaaatactaattcaattcatcaatttaagcaatactcattaagagccaagtatgtgctcactgaataagctgctaaggtttggtggttacagagtgtgcggtgaaatgatgtctacatcacagtccaacattcacagagtttaaaagcctaccaagaatcaagacagacacaaatacctaacatagacatttgtatatgataagagagccagagtacaatttaggagaagaaattgtatggaaggaaggttcatttccattagaccagaaaagacagcacatttgaaggcctgaataagaaatattctggataagatattgtggctgctaccagaatggctcttgatgatctctacctcttggtatttatacccttatataatctctttcctatagtgtaagctggtcccaggtacttgtttctattgaatagaatagaacaaaagaaatgagatgccacttctgagattagattataagatactgtgaatttcttcttgtgccctctccctctctctctttctcttgccctctcatttgaatgaagccaactggcatgctgtcagtggcccagtgtaagtcctgttacaagaaattgatgattacctgtagccaaccctaagtgaagaactgaggtcctcagtcctacaaatggagagaaactgaatctagctaagaaccatgtgagtgagctgggaagaagatccaccctcagttgaaatttaagatgacatattgagcagacatactgagacacactgaaagtaagagagcaggaggaaacaaaaccagggtcatacaaagaacacaactgattttgagattctcacataagtattacaccttcagtgagcacgtgtactagaaatttaaaaaataaataaaataaaccttcaaagtgagctagcaaataaatttccctatggtctcagctctgagtggagagagaaaatgttccctgtggagtttatagccagaatccagctctcaaacaggtttcagcctgaactcacacaatctgtgtggcttccaaatttgcaagctgagaatttaattcaaagtggtctcaggttgatagcagtccaaaatgctaggtaggaaaaaaaatcctctctggacaaataaatcatcaaagcaagctcataagagcaggtttcaaaggtcatgagcttctaacacacacacaaaaatcacacacacaaaatgggggtagcagcaacatgggtagcgtattcaaacttgaaaagactttaaatatttgtattattagatgtagattatgaaacacatattttaatgtggttaatttttttaaggaatcaaaactatgagtaaagaccaagaaaattgtgctggatggccacttccaccatggctcccctcctatttaagtctgggtactgtgtcacccgaagtcttcaggcacattgttccaggtctgggtttgcctatgaaagaaactcatgagagctggaaatgaggagtgaagaggaggtcttcaaataaagcaggcttaaggattagacatagcaggtttgacagatgtgatggcttgcagaatcctttatgagctcccactgtccatctggataagatttacagacctttcagaaattcctataagcttgggttctgtgcccacactctagactgtcaggctaagatctctgatataaaacagacctcttctgattttgtctagctgcttttctaatatctattcaccaagctcttccaataatagcataaggccctaattaatattaaacttttatcattataatacataggatgtcttctgttttcctgatcaaattctgactactattaaaatataaagaattgtccagaaatatataaaaaaagaatcacacattgatcttctttaaatgaaaatataacaattgtatggactaggatgattacagttgttcagttctgactgttatttgaagaaaaaagcaataagaagcctcagcaacttaacagaaggagctgccatttactaggagaaaagattgtggatgagagtgtagcaaaggtcagaattctgtgaagcttgagatgtttattataatgaattatcttttatactcactacaatttcctaacaattttggggtttatatttttgaaagagatatacctttaattttctttctttgtactattgttaggtaactttgatgtgcagattatactacagtgaaagttgccaatgacaaggcaaagtcacttacatcagacccaaagcaaagtggagccgggtcatgaaaaaggggatcttgtgtgtctgtccacgataagcactatcacaaggactttctataaactcacaagaaatttctgcccacccagcacactctgtttgtccagctcatcctgtaggtgtctctataataggacctatcataaaaaattcctcaagactgcagcatttcagataagccaccctcacaagaacacttgcctagcaatggctgtttctgccagtaagttaacaccagctcctgcatcagaccctgtgaccaatgatgtttgtttcaaaacagcttgcatggacttctttttgtctttacatattttccttacctcaacctcttgggatgcacctatgattgatcatagcacaaatatctcagattataatccttgtttatttccaaataaatttatttctttggagatccactttttctgttattatacattgacattgttattatgaaattggttgggtgatgtgtcttattttcttgtctccagaagaatttctgtaacagtgcaattaaacgttctttgcatgtttgctagaactcacctgtaaaattgtctgagcaaccaaagcctggtttttgtgtttagtttttcttttgtgattggggaggggggtttatcgtactgattcaaggtgtgaaggtaacatcattttgattttatacatcttcttcagtccatttaagcatgttacatagcgttgtttgttcttttcatgatattctttacagtagtctcctaaatgttccctctgcttctgccatgagcccctacaatctatttcaactcagaagctatagagtttgtttaaaacatgtaacatattatgccacctttcttactgtaaaacatcccatggtttctcgtagtatttatagtaaaagtgaaatttttatgatggcttgagaaacttttcccattagatgcccaagtgctggtctggtctgatcttctcatcttcccttgggtgattctgtggcagtcacactagcctccttgctgctccacaaaaactccagcatgatcctacttcaggatatttgccattgttactgcatctgcctggaaccttttctcccatataaacatagagattgctcttgcctgtccttcaagtctattcttaaatgtcccattctctgtgaagctttcctgcccaccctatttaaattacagacttcactcccaattccccatctactttaagagtcttcatttatcattccttgacaaactgtaaatatacatgttcacttttttatcgtctgtctccaaatactggaatgttaagttctgtaatgtcagatatttctgtttggttcactggtgtattcttaaagcatgttacatactaggtatactcaatgaatatttgttgaataaatatcacattgggcttattccagaaattcaagcttgtttcaatagttagagcaatctacaaatgtaattccttacattaactaattaaaggagctaaatcacatcaccaccacaataatgcagaaaaccacatttgatacaactcaatattcatgtctgcctaacaaacatctcatgatactaggaaaagaggaagggatatattattttcatgtataaagcactaaccattgtagcatgccaatatactcaaaattcaatgaaattcctatcaaaatcttagcattcctcttagccctcaacaaagcatttctaaaatgtgtatagaagaccaaagggccaaaagagtcaacttctgaagaagcgcaaaaagaaagttgaggaaatcttaaaacatgttattgagcttaaagttgcaaaaataaactcatgtgccataattcatgagtagaaaaatagactagtggaataacataaaaataaaaacaatgcttacataaaatgttgtaactgatttggatgtcattagaaatcagtaagtaaatagatggacaatgtaatgaaagatgctaggcaaataatgtggtagggagaataatggccctcaaagatgcccatgcctaaccctggaacctgtgaatatgttacactgaatgcaataaaggcttatcagatgtgattaaggatgcaaaccgagatggagagatcttcctgggttacccagatgggcccagtctaatcacatgagttcttaaaaatggagaacctttcttagctgagtccagagagagatgtgacaatgaaagaatggtcagagaaatgtgacattgccagctttaaaaagagagaggagaggcaatgagaaaaggaatgctgatgttctctagaagatagaaaaggccaggatatggattctaccctagccaccataaagaaacatgcctgtcgacaacttgattttagttcactaaaattcatgcctgatttctgacttgtgtacactgtaagatgacaagtttgtgttattttaggtcacttagtttgcagaaatttgttacagcagtaatagaacaagtggttatccatatgaggcaaattagattggatacctatctccaatagaaatcaattcaaggtgaattccaggaaaatacttaaaacatttagattaaaaataaatgagaatttttgttacttttggtaggtcatagaaccaagaaaaacaaacattaaggaggaaaaatgaacatatgactacatcaaaatataaagcttctctatttggaagatatcataaggtgacaaatcataaactgtaatatttacaacatatatataagtgaataaatatacatttagaatatatatgaactcccaaaaatcaacaggaaaaataagacatagaacaagcaaaatgcataaacaaaagaaggcaaaacaaaaataatgactcataattatatgaaaagaagctcatcttcatagatgagcagataaatgcaaattaaaaccaccctgagatgctttttacatccatgagcctgataaaagttagagtctaaaagtaataattaacaaagatgggaagtaacagaaaatcttgtccattactggttaaagtataaactgatacagctactttatagaatattacattatagaataaagttgtgagtatgtatatgcagtgactcagcatattcattgctagtatgtactcaagagaaacttacaggagtggactaggaagtaaatacaaaatgattacaacattgtttgttatatcaaaaaataaaaaagacacccaattttccagcaaaaaaaataagtaaaaataaatcctggtgtattctaacaatggaataatatatagccattaaaataaatcaactattactgtacatatgaatgtaagtatcagcaaaacatattgtttagtgaaaaactaagaagctgaagaagaatatatacaatatggttacatttatatgaagtcccaaaacttgcaaaataaagaaatgtatttagaaatagattcacatgtgagaaaactagaagaaaattaatgaaaggataagagggatagcagtaattctgagtagttgagggaatttcaattggaaaaaaataatatcatattctttaagtcaggtagtgggtattagcatttgttttaccatcgttctttattcttatagctacactatatattttcaatgtatttaatatattttttgcataattaaatattatgcaataaaaatgagaaaacaaaaaagtagaaaatgataaattacaataaagaaatggagaaaaaattataatctagttgagtaatggtatattacatagctattttcttaagtagatgtatgtacatgatgtatgcacgattgtacatacatgttcttaattatatataaatatatatgtacatatttttaatataaaatactaaacaaagtacaccaaaatattagctcctatgttagtgagataatgttttgtttttttgtattttaagttttacatagtaggtgtatttttctgttttcatactgctataaagaactgcccaagactgggtaatttataaaggaaagaagtttaattggctcacagttcagcacagcttgggaggcctcaggaaatctacaatcatggcggaagacaaagaggaagcaagccagcttcttcgcaaggcagcatgaagaagtgccgagcaaaggggaaagaatcccttataaaaccatcaaatctcgtgagaactcactatcacaagaacagcacaggggaaactgcccccatgattcaattacctccacctggtctctcccttgacctgtggggattatgggggctatggggattacaattcaagacgagattcaggtggggatacaaagcctaaccatatcagtaggcatgtattgaattttaaactcagagaaaaatactagtgtttttataggattcttactaaagaaaaaccagaaagtaataaaccatctacgctaagacataaaattcagttgtttagttacaagatagaatgtggccttgtaagaaagcaaattaacttctaacatacaaagccttagagaagattcaagtgactgacggatcttaaacagagctattattacaacttgaactgcagtaaaatatcctcagcaacatagatgtgtatgtttcactagtcagagcaatacaaatttaacgaaactccattggtggtgtttttaatcagacaatttctgaagatgtcctggcttattcacagatgcaagccaaatctctagaagagtaccataataagaaaaaaaagaatacaggcaattgagagctgttccaaagtttagggagtttttgtaaggaattaataaataaaaatgttcttgaaagagagaaattaatatgcagttcatactgccagaattgcaggcaatttatcaaagtcccctaatcctccaaaatcgctatttttttttttgacacacactttacagtacagaagaaaatgtctccggcaataaatcacaaagttaaaattacctagtctacaattaactacacagtgatggtaaatcattttctaccaaaagaaagaaatgtcttgtctattcaggttctgctctacttaaaagttttccttgttggcgagcaagtggttagaaaatcatattttatacgtacattcagcttaactatcattcagctcaggaagatgactcagggccttatccataccttcaagtttgctcttagcaagtaattgtttcagtatctatatcaaaaatggcttaagcctgcaacatgtttctgaatgattaacaaggtgatagtcagttcttcattgaatcctggatgctttatttttcttaataagaggaattcatatggatcagctagaaaaaaattaagaggaaaatcacatggaaagttatatattatatatctattatatataatattatatatctattatatattatatattgtatatctattacatatatattatatatgtattatatatattatatatctattatatatataatattatatattatatatcatttccaaattccccagcgttcatatttgtcagtgcaagtaaagagccttactgctgatgaggtttgaggtatgaccatttggccagaatttatgaactctacatgtcgcttgatgtgtgcctcagggtatactttttttttttttttgagacggagtcttgctctgtcgcccaggctggagtgcagcggtgcgatctcagctcaccgcaagctccgtctcccgggttcatgccattctcctgcctgagcctcctgagtagctgggactacaggcgcccgccactatgccctgctaattttttgtatttttagtacagacggggtttcaccgtgttagccaggatggtctcgatctcctgacctcgtgatccacccgcctcggcctcccaaagtgctggaattacaggtgtgagccaccacgcccggccagggtacacttttaagcagagacactactttgaaggtcataaaaaatataataagagataaggctaatttcctttaataataataaaatcctttaataaaaatataaaggaataatataataattttatttaataaaatataataagagataaggctaatttcctttaataaaatatagtaactacataccaacagaattccaaaaaaagaaatggagaggaagggagcatgggtcattaatcttgtcaaaaatataaaattatatacgaggaattcctagaaactgttttccttgtctgcggccattgtgctgctgctacacaactaccgcaagcagcccttcacgccctcctcccagtacaaagctaattgacttgtgagaaatgttaagcttggaagagtcagcatcgctgcacttattttttattctactctgacattagaataatccttgagtgggggaaaggttaaaaacccccctggataagtgttactaattaatgatgattgttttaaacaatgtttggataatttttccttgtcccttgacataaacttgataaataactgagaagtgagaaggagattagtgggttgattaaattccattcaggtacttaaagttagctccaaaaatttagctatttgtaaattgtcatgcattgttaatgtataagagatgtagatttcatttatctttggtggagcgagatgaagcagtgaatcattgaagactgaaagaaagaaaaaggtcttttcccttttctttaagaagcatcattagttaaaaacatgttagttgataccagagaactatatttaaagggacagcaataagcaaattgattactctggtgattattggagtgacattgccttttagttgtactttcacaaaaattcacaatatttgccaaagtcaagttatccattacactattaatttgtcattcttttgtttatatagtcaatctctatctcaattggatctatctcaactgcttctaaacaagccaccatagtctctcccatttcaacaatctcttccaagtaccacttcatttcttcttttcatatttttgaaaacttttgaaaaactacctattttcctcctccatttcttgttcattccattctagtggacatggaatctgttcctcctccaaaacggaatttggtaacccttaaattactaaacccaaaacaacatgttgtctttatctttacctctctgtggcatttaatgataagaccactactttcttctcttttacccttctttcttgaattcagtcaaacaacgtacttacatttttcgtcttattctccatcttagaaaccacctcagctttctccattcagctataaaattgtgcttttcctcaaagattaatctgcctctcctctcactctatactatctctgttagctaattttatttgtgcacattgcttatactgggcattatatacacatatgcatgtgtgtacatgtgcatacacacactgtatgtggacatgtatatatatatatgtgtgtgtgtatatatatagtatatatataaattacaataacataaaggtggcattttaaattagtggaaattaccctgatttgatcactacacattctatacatgtaaagaaaatatcactctgtatcccaagaatatgtacaattatggtttgtcaaatgaaaaagttcatacattgaaaaattttagataaatatcaaactttctctgaaactgtaactgtaaaatgtaaaaaacagtaattgctatattgcttatttctgagtagaagaatatgagacatttccctaatcattatgtgtaattacaattacatagaagaatatgagacatttccctaatcattatgtgtaattacaattacatatatatatgtaattgtaattacacataatgattagggaaatgtctcatattctatatatatagacagaaagagagaaaatatatgagggagagaaggaatctttccatctcctttgagttccacggtgttgagagtcaggacaactgcaattgcttcatcatgcctgcttgcaattatagggcttttgaaccatttgttccctccttagatatcctcatttttttcagattcttgcttagaagtcactcctccgtggacctcctctgacatattaaacattgcagtccattataagctgcaagaggacagggatttttgcctgttttattccctactgtatcaccaggggctacagcaatatctgacaaacagtgggcatgtaatgaatatatgttaagtgaagtaataaattcaatcaaatcacatcacctgtttaaagcacttcattggcttcacattgcacttagaataaagagaaattctttttatacaatataagttcctgcagaatgcagacactttctacttctccagcctcttttcgactcctctcctactagcttctgtatttaagccacattagacctttcttcagttttttatatagactttgtcgcatcacacctcagagattctgtacatgttcttcctcctgcctagaaaggatcgtccctccactttcgccaactaatccctgctcaacttttcatctcagcaggaggcccattctctttggcaatcctctggcctccagcccatttattatatgctcacatgtcaacatgtacttcgtacagcatgtaacacaattgcacttttatattttaacaaattatatttcccatattgaactgtaagtctcctgaaagcaggaattttgttcttgctcatcatcaactttttcaacatccagtgcaccatttagaacttagatgtagtcaatacaggtttgtggaatgaaagaggaaaagaaagaattaatattcctttaaattaggatggcaaagatcgtatatagaaaattggctaagttgtggtccattcatgtttgctcccaattaaggagcacagctatgaaaaggaaggcttcaaattaataaccaatagatttttttaaaaagaaaactggccaggtactgtggcttatgtctgtaatatcagcatgttgggaggccaaggcaggattacttgagcccagaaattccagaccagcctgagaatttggcaaaactctgtctctacaaaaaatacaaaaattagccaagtttggtggcatgtgcctgtagtaccagctacttgggaggctgaggtggaagaatagcttgagtctgggaggtcaaggctgcaatgagctgtgattgcaccactgcactcaagcctgggtggtagagtaagaccctgtctcaaaaaaaaaaagaaaaatcactaagcaaaataagacatgtgaaggatcatgtcaaaggtaagaaaaattaggggaacattaaaagctttcttcccaagccactaaatcaacttgactaacaaaattaccacttgatttagcattagaaaattacattacatatcaaacataaacccattaatcaaatactaaagaaatttctgagttaaatggtataatgttagcttatgccagagctgaccttgaaagattgttcaaatatggctcagtgtgattgaaagttctgtgtgaatatgtttttggaaagatccaacagcaacaccttagtgtatgtttttgaaataaaatgtatctgagtagcagcaaagttattctcaaatttccattttatagctggagatgtcataccgtgacgtatatgataggacccaatatggatcaatcccttttagaagtcaatcaggaagaggggagcagttaaaacagttgcttggtttacaaacattagaacaattttcttattcacaccatctgattattgtattttattttttccccaacgtttagactacacaatgagttaagaatgataaaaataagctcaccaatatactatgtacatatttaccaaaatctgtgcatgcttatacatataaacacagctgataatttattagttaggctcatttgtaatttttgtcactatagaccagttttttatttaaattgaagattagtatacattttaaatgattagtcaaaataaaaaatctaaaatgtgctctaaatacctcttaggtcagaaaaaaaaagtcaaaagctagagtatagagaaattaagaaacgccctaaatttctaatctgacaaaaattcatacaagatttaaatattttaatggaaaatagaacagaactaattattgaagaaattatagaaaggaaacaaaataaacagattatatggaggatttttagaagataagtaaataaattaatatactaggaaaaaacaagggaaatatacttgataaataaatacaggtaagagttcttttgaaataatgataaaatagaaaatctctgtcaaaactaaaaggaaagatgcataaatatataaataaatgataaaaaatgttgcatacatatatgactttttcagaatcaaaaaatttaaatttctgtaataaaatttaaatgtttataaatttaaaaaactagaagaaagaatgttgactgttcacaatacaaataaatgacaaatatttgaggtgatggatatgctaattatccttatttgatcattgggcattgtatacatgtatcaaaatatcactctgtatcccatgaatatgtacaattatttgtctcaaaaacaaacaaaaaaaaagataatgggagaatgttgaaaactcagagagaagagcaactctcacagatagggatccagataacattagcagctgatttctcggcagaaaccttgaaggccagcaggcagtggattatatatttaaaataatgaagaaacctgtcaattgagaaatatatagctggaaaacttatccttcaaaaatgaaggagaaattaagacatttccggatttttttttaaaactgaaaaaaatccatttatccctgaatttgacattcaggaagtgttaagtccttcaggttgaaataaatgaactctaggcaataactatgtaagtaaataagcaagctgtatgaatatacaaagctctctggtaaaggtaaatacataaacaaacataaaaacagtcctattgtaattttggtttgtaactctgctttttattttctacataatttaaaaggcaaatgcataaaatgtaattgtaaatctgttagctggtatacaatgaataaagatataatttgtcacatcaataacataaaaagagtagagctatatatatagcagtagaattttggtatgtgattgaacttaagttgaaataaattcaaattaaaatgttataactctaggatgttatatgtaattctcatagtaaccaaaaatgaaatatatatagaatataaacaaaaggaaatgagactagaaacaaaatgtgtcactacaaaaaaatcaactaaagataaaaaagaaataattgagaaaatgattggcaaaaatcagtaactctgacgtattaaaactttccatgctacataaatctgaaaactctatttcacataaaactggagctgaaagaaacaaatatttacctataaagttaaaagttatatagggaacaaacactaattttttttagaaaaaattataaaaagtaaaaatatgccttatactaccgtaatttcatgttttacagctctgggaaaatagaaaataaaatgttctgttagcatgaatccctctgtgcccccaaaaaaccctatggattgcatcattattacctaaaaagtctattctcaaatgcagcagagtgatattttttacaaggtagatattaattttagatatggaataatattgatgatttcaattttataacactgggttaagatgaaagaatgagaagataaaggtccctcagcaatataactcacaaacatgttcagaagcagtaagaagttacattaattatcttttgaaagtcgataatctacatctttaatgtatgcatatagcatagctaatgtactatcgctgggtccatttattcaatgaataattgccgctatgtgtcagacatttttctaggcctaggaatggatacataagtgaacaaagcaaagattctggttcttgtagagtttccattaaaagacaatttagtaaaacttttcttcccccaaattataaaatctgtaagatgatttaacaacatgtgtaaaagtcattgtgggccaggcacggtggctcataccaggtgtggtgactcatagcactctgtcacccaggctggagtgcagtggcacaatctctgctcactgcaacctctgcctcctgggtacaagcgattctcctgcctcagctttctgagtagcaaggactacaggtgcacaccatcacgcctggctaatttttgtactattagtacagacggagtttcaccatgttggccaggctggtctcaaactcctgacctcaaatgatccgcccacctcggcctcccaaagtgctggaattacagatgtgagccacaatgcccggccttattttctacaactttggtaactttagcatataccccaaatctgtaagacataatattataattcaaatgcaactcatggcttctctttgtactctttctctagcttttgaattatttattctaataccagttttaattctgacacaaaatcatgggagttctaatcaaaatccaaccttttatcataaaaactatgaagaaattatgagtagaatttaaaaaggaaaataggcctattaattagatttgtctttgtagcatttaactctataataaataatattttatgcctatgagtccccaacaaagcctccagcttctatttagatacaaactgtaaaagtcactactggatccacaagcaagactatggtaaataaatttctccacctaaccagcttcttttacatgatgttacatgtttcttttgttttttcattttggcaaatattgattgtcatcttcgtgtttgtctatgtcctaagtgctgggatacagaatctgaaaagatggacacaggacctgccttcaagttcacccccttttttttttttttttgagatgcagttttgctcttgtcacccaggctggagtgtaatggtgagatctctgctcactgcaacctccacctccagggttcaagtgattctcctgcctcagcctcccaagtagctgggattacaggtcccagccaccacgcctagctaatttttgtatttttagtagagacagcgtttcatcatgttggtcaggctggtctcgaactcctaacctcaggtagtcgacccacctcggcctcccacagtgctgagattacaggcatgagccaccacgccctgctaggagttcacgctttagttggggaaaatatacaataagcaagccagtttttaaaatgagaactgcaattagagttaaatgctacaaagacaaactcacaggaagatgggatgtagaatgataaggctctcagaatagtaagagaaactattgcttcttacgatgtttgtctttctttgtatcggtgctcagctgagtctgcagtgcttcagaggcagctttcattttataaaaatctatgatttctccttccagttgttttttctcttcctcgagcttccttatctcctcctgttgaatcattttaagatgctcgaacttgtcctgcagctgtgaaaccaatgtgcagttgtgacaccaaagcagtgtggctgaacacctaaaagaatacgctttttttctgattatcaaacaaacccaaatcatcacagtagagcacgatcttaataacaatctcaaaaactcaggagtaaacactcagatatggaatttttcttttctttcttttttccttttataagatggagtctcactctgttgcccaggctggagtgcactggtgcgatctcagctcactgcaacctccatctcccagttcaagtgattctcctgcctcagcctcttgagtagctgggactataggcatgcaccaccactacaggcgtgtgccaccacacctggctaatttttgtatttttagtagagatggggttttgccatgatggccaggctggtctcgaactcctgacctcaggtgatcctcccgctttggcctcccaaagacttttttttttttttttaatatagagacaagttctcagtacgttgcccaggctggtctcaaactcctgagctcaagtgatcctcccacctcagcttcccaaagtgctgggactgactggatgcagtggctcatgcttgtaaactcagcactttgggaggccaaggtgggaggatcgcttgagcccaggagttcaagaccagactgggtgatataacacaatagtcaacttcaacaggagagagaatctgtaaacttgaatatagatcttccgaaattatccagtcagaggacagagaaaaaaagaataaaagagagaaaagaaggctgggtgtggtggctcaagcctgtaatcccaacactttgggaggccgaggcaggcagattaagaggtcaggagttcaagaccagcctgtccaacatgacaaagccccatctctactaaaaatacaaaaattagccgggtgtggtggcacacacctgtagtcccagctacttaggaggctgaggcaggagaatcgcttgaacccaggaggcggaggttggagtgcaatgtgagccgagaccacacattacactccagcctgggtgacagagcatgactctgtctcaaaaagaaaaaaaaaagagacagagaaaagaaagccaacaagacaccattaagcaaaccattgtcaggttatgggagtttgagaaggaaagtagagaaaggagaataaagcttatttaaagaatggctgacaactgcctaaatcatgggaaagatttagacatctaaatccatgaagcttaaagattcctaaagaggttcaaaccaaatagatactcaccaagtcacaatataatcaaatagtcaaaagttaaagaaactttgcaggtcaggacagaatcgaataatacattcaaagtgctgaaagaaaaaaactgccagcaactaatactatgtctgacaaagctgtccttcagaaaggaaaaagaaataacgtgtttcctcgacaaacaaagctgagggcattcaggaccactaggtctaccttaaaaaaatgcttaacggagtttttcaagtaaaaatgaatgaagttgggagcggtagctcatgcctgtaatcccattttgggaggctgaggtgggtggatcacctgaggtcgggaggtcaagaccagcctggccaacatggcaaaaccccacctccagtaaaaatacaaaaaattagccaggtatgaaggccactgagatcgtgccactgcactccagcctgggtgacaagagtcaaactacatttcaaaaacaaaaaacaaaacaaacaaaaaaaacaaaacttgaggcctggccttctgctcctctccaacctccccttctctgggcccaagccaccttggctgaggagggggcgaggaggtgtgagcccctgccaggaaccccctgcccggaccaagtgctcggcccccaggcctgcgttcagtgaggcctcccgtggcgtcagcatgttcgtgtggaggaatgtggaaggtcactcttcggccgtgttctcctggtactccatccccttcctgacccctccctgcagccacacgaggcccagcaacctgccagtcactcagagtctctggcctccaaccagagaaaacaacctgccaagttggcagccgttgctcatgagcgtccaccaagtgggacagggagtgttgaccctgggcggccccctggagccacctgccctgaaagcccagggcccgcaaccccacacactttgggggtggtggaacctggtaaaagctcacctcccaccatggaggaggagccctgggcccctcaggggagtccctgctggacagtgagacagagaatgaccatgatgatgctttcctctccatcatgtctcctgacacccagttgcctctaccactcagatgatgtcaggcccagtccctcagtgccctgcgcaaggaaaaggactcatcttctgagaaggatggacgcagccccaacaaatcagacaaggaccacatccggtggcccatgagtggcgctcatgatcttcagcaggcggcaccaggccctggcggggcgcaccagggtcaccccaaccaggataaccggaccgtcagccagatgctgagcgagcggtggtacaccctggggcccaatgagatgcagaaatacaacctggccttccaggtgaaggtggcccacttgcaacaaggaccgaaagaagtccagctcagaggccaagcccacaagccaggggctagcaggagtgtaacaagggctcgtgggagcggagcatatcagagacgggcactgccactgcccctggggtgtcctctgaactcctgtcagttgcagcccaaacactccagagctcggataccaaggagcagcttctatggggcagaacggctgcacacagtcagggaacctggctcagcctggcccaagccttctcccacagcggggtacacagcctggacggcagggaaatagaccgtcaggcactacgggaactgacacaggtggtgtctggcactgcatcatactctggcccaaagccttctactcagcatggagctccaggccactttgcagcccctggtgagggaggtgacccgtgggcagccctgctgccgcccacgtgagctgctcattcccagcacatggccagcgaggtcatagcgagtgacgaggagcacacggtcatccatgaggaggagggggtgatgatgtcattgctgatgatggctttagcaccaccgacaccgatctcaagttcaaggagtgggtgaccgactgagagtggggacaactctggggaggagccagagggcaacaagggctttggtgggaaggtatttgcacctgtcattccttcctcctttactcctgccgccccttgctggatcctgagcccccagggtcccccgatccacctgcagcttttggcagtctatggtcacaccctgtcctcctcctacacatactcggatgcttcctcctcaaccttggcacccacctccttcttactgggcccaggagccttcaaagcccaggagtctggtcaacgcagcagagcgggccccctacggccccaacccctggggatgggggcccagggacgccttccaaggtggcctgtttcctcccaatggatcctgccaccttctggtgcaagagacctgaaagtgtgggtgacctggagctaccaggctcctcagtcatcagggtccctcccaacactaaggctttcctaggcaggagctgggctgagccacccggggggcagagcctgaagagaaactgactgggctttcggggtcggggcagagggaaccccacggacatggatcccacactggaggaccccaccgcgcccaaatgcaagatgagaagatgctccagctgcagtccaaagcccaacacccccaagtgtgccatgtgtgatggggacagcttcccctttgcctgtacaggtggagaagccgaggacaggctcagggaaccggagaccgagaaggcgctgtcctcttcactgcacgtaccctggaccagtgccggccctgatcatgcagctcttccaggcccactgcttcttcctgtccactaggccacagccgccctccaggcccactatgcacacatcttcccctccaaggtttgttctgcccctgccctgactcccagccctgtgggggtcctgaccgcacctcacctggctcagactcttgacgctgccctggctgccccaccactgcttctgcccgagagtcacgtgaggctgagagtaggggcaggggcagcagtggtgccagttggggggcggtccagtgggaggagcctcagcctcgcaggctgctccgtgggactgatgactgcatgatcttctgggcacctcacggatcttcaactgcaggtgaaacggatgctggtggtgggtgcagggccgctgggagctgctgcatggttcccagaggctggactgaggcaggtgccaactgaagctgctggggcagcatgggcaggatgttctgcacacaaaccttggagaagaagatgtgtgcatagcaggtccactgctgctgcccctgccctgactcccagccctgcctgaccccacctcaacctgctcaggctctggcacaaccctggctgccctgccactgcctctgccccagagttggggccttgacagcctggttggaaggggacaccccagccctgcctcaacacctgggggtctccataactaccacaggcaggtgggcaaccccaaagatcccaggactcacagtaccccctgagaacatggacagtatgtgggggtagcaatggagggcaggatggttatcttctcccaggtgaagccatttaatcctttcagtttgggacggagtaaggccttcctctttttttttttttttttttttttttttttgagaccgagtcttgctctgtcgcccaggctggagtgcagtggtgcgatcttggctcactgcaacctcttcccgccgggttcacgccattctcctgcctcagccttccgggtagctaggattacaggtggacgctaccacgtccggctaatttttgtatttttagtacagacggggcttcatcatcttggccaggctgatttcgatctcctgacatcgtgatctgcctgcctccccctcccaaagtgctgggattacaggcgtgagccaccacgcctggccaaggcctgctcctcttatctataccccctacccctgcagctgtgccgggggaaagctgggcagtttccctcctccgagcccctgtacataccatgaattgtgggaccttcagagcttttcacttttcggaaaatagctcctgctggggctacaagatggagtgtgaagagggccttgggccacagggaggcgcctgtggactagggggagttcatgcaccccttctttccccagaggggctggactcaggtgagtatgggggtgggggctcctgcacttcgacacaggcagcgggagggttttctccccattccctctgcactcccaacttgagctatactttttaagaaagtgattcaccctgcctttgcccccttccccagaacagaacacgttgatcgtgggcgatatttttcattgtgccaaaaagttgccatgaccgtcattaaacctgtttaacaccaaataataaggaaaataaaataaaaaattcgggcttggcgcagaaactcactccaaataaattacctatcaaaatatttacataatggtggaaatattccaaaattcaatattttgggatttatacacaaaagataaacaaattagaggccaagaggctgccggaagggaaaaacggggcctggaatggccgacgtgaggaatgagctgggcctaaagaggccactggcaggcaggagctggacctgccgaagtggccgaaaggcaggagctttggactggggaggccgcagtgaggcgagagctagctgggcgtggagagtctgctgtgaggccgaggccgaggccgggcccgtgcaggccttcgagaggcaggaggccgggcctgcaaaggccgactggagatcaagttctgcgcctgaagaggctgccaaaagtcaaaagcggggcctgggaaggccgccgagagccatgagctgggctgggccgaaagaggccactgggaggcaggaggagctgggcctggagaggctgactcgaggaagttttgcacctggagaggccgtcgagaggacggagctgggcccagggaggccgacttgctgctcttccaggcccacttccaggccgacttgaggacgacttgggcctgcagaggccgccgggaggctggagctaagcctggagagactgacttcgggacgatttgggcctgcagaggccgccgggaggcccaagctgggcctagaggagcccaccgaccggaggccatttggggcctgcagatgtcatcggagggccaggagctgagcctggagaggccaccgcgaggcctgagctgggcctggggagcttggcttagggaagttgtgggcctaccagggccgctgggagctgggcaggagctgagtccaaagacgttgttgggacctggagtcgggccagagtccggcctggagatgcagccgggaggaagagctgggcccggagggggcgccgggaggctgcaagtgggtctgagaggccaacttgaggaggcctggcctctgcctcccgcattgcccagctgttcctcctggctgcatctcccacctcccagcaaacaagctcttttggctcagctcccgcctgcgtttgtagaccccgaagtttctgcaaccaagctcttcagacccacatcccttctcccagtgactgaacagtcccagctccggctggagaagggcgtctgcagaccccgctgttgcctcccaggggagtctccaggcccagctctcgccccaccgcgacctcccaggcccaagtccctgcctacctcccagcagcccgagtgcgatcctgttcctccctcacggtggcctgttgaggcaggggatcacgctgacctctgtccgcgtgggaggggccggtgtgaggcaagggctcacattgacctctctcagcgtgggaggggccggtgtgagacaaggggctcacgctgacctctgtccgcgtgggaggggccggtgtgaggcaagggctcacactgacctctctcagcgtgggaggagccagtgtgaggcaggggctcacgcctctgggcagggtgccagaggcatgagttgggcatcaacaggccaccgtgagggaggagctgggccgcacgcgggctgctgggaggcaggcagggacttggccccgggaggccgccgtgggggcaagagctgggcctggagaggcccctgggaggcaagggaggggcctgcagaggctgttctccaaccagtgctagaactgtacaggccaccaggaggcaggaggtgggccctcagagcttggctggagaaagttcggggcctacaaaggcggttgggagctgggcaggagttgagccaaaagagcttgcttacttgctgggaggcagggccgggagagcctgacttcaggacaacttgggcctgcggcggtcgccgggaggcccaaccttggcgtggaggagcccaccgaccggagaccatttggggcctggagatgccatcggagggcaggagctcatcctggagaggccaccgtgaggcctgacctgggcctggggagcttggcttgaggaagctgtgggccgaccaaggccgccaggagatgggtaggcactgagtccaaagaggttgttgagaggcaggaatcgggcctggagacccaaccaggaagaagagctgggcccggagagaacgcccggagggtgcaagtgggtctggagaggccgacttgaggaggttctgggcccggagaggccgccggaagggaaaaactgggcctggaaaggctgttgtcaggaatgagccccatgggcctgaagaggccactggcaggcgggagctgggcctgccgaagcggccgagaggcaggagctttggactcgggaggccgcagtgaagcaacagctagctgggcgtggagagtccgctgtgaggcagaggctgggcctgtgcaggccttcgggaggcaggaggctgggccttgtcgaggcctgcagaggccaccgaaagtcaaaagcggggcttgggaaggccgccgggaggcatgagctgggctgggccgaaagaggccactgggaggcaggaggagctgggcctggagaggctgccgaaaggcaggagcttcgcctgaggatgccacagtgagacaccatctgggtctggagggtccactgtgaggcagaggctgacctgtagagtccgacagtagacagaagttgggcaaaagcctgatttgaggaagttttgggcttcaagagtcagccacgaggcaggcactaggcctggaaatggactcacagtcatgagttgggcctaaatgggccactgtgagggaggagctgtgcctgttgaggctgctggcaggcaggcagaaatttggcctggggcagctgccatgaggcaagagctgggcctggaaaaagcccctgggaggcaagagcagggcctgcagaggctgttctcaagtcaaagctgggcctgttgatgccaccgggaagcagaaggtgggcctggagagtttgacttgaggaagttttgggcctacattggccgccatgagctggacaggaactgggccaaaaaaggctgttgtgaggcagcagttgtgcctgtagacccagccaagaggaagaggtgggcctggagaagcccccatgaggcagaggttgggcctgtagacgctgacaggaggcaggagctgggcctggacaggtcaacttgaggagattttgggccttcataggccaccaggaggcagcagttgggactagagagtctgacttgagtaagttttgggcccggagatgacgtcctgggacaggagttgggcgtggagaggccaccgtgaggcataagctggatgtagagaggccagtgtgaggcaagacctgggcctgtctaggctgctgggagacaggcaggaatctggccagggaaggttgccatgagacaaaagttgggcctggaaaggcccttgtgaagcatgagcttggcctaaagaggccactgggtggcaggagctaggtgtgtagaagctgctgaaaggttgggagcttggcttggggggtccacagtgaggtagatgctgggcgtgaagaatctgctgtgaggcagactttgggactgtagaggctgacgggaggcagaggctgggcctggaggggccaccaagatgcaggagctgggcctggagaggctgcaaagaagcatgagctgggcctggtgaggtcgacttgagaaagttcagggcctggagagaaggctgggaggcaggagctgggtctaaagaggccattgtaacgatggagctgtgcctgtggaggctgttgtgaggcagtagcctcatctgcggaggctgccgtgacatagggtatgggcctaaataggccattgtgagtcatgagcttggtctgtagaggctgactggagaaagttctgggcctggagaggctgccgggaggtaggagctgggccaaaagatgtaagcacatttgcatttattaggcactttatttccattattacactgtaatatataataaaataattatagaactcaccataatgtagaattagtgggcgtgttaagcttgttttcctgcaactgaatggtcccacctgagcgtgatgggagaaagtgacagatcaataggtattagattctcataaggacagcgcaacctcgatccctcacatgcacggttcacaacagggtgcgttctcctatgagcatctaatgctgctgctcatctgagaaggtggagctcaggtgggaatgtgagcaaaggggagtggctctaaatacagacgaagcttccctcactccctcactcgacaccgctcacctcctgctgtgtggctccttgcggctccatggctcaggggttggggacccctgctcaagtgcatccaaagcgacccttcccacaccagtcttcacagtggtcaagggcagcaaccacttagctcccaaggcatgtgcctcagctggcatttcgtcacaatcaacagtaagtggtagcttgagtcactgtgaggtcacctactggaaatcaccagcaccccatttcccactggcaaagagctcagcactgccccctgggaaaccaaacctatgcccaaatcccatctgtgtgggtctacctcctgggacccttcctaacatattagtcagagtccaatcaggaagcataaaccactcaaaagtttaaagtggtaaaatttaatacagagaattattcattataacaggtgaacagcataatgagagattggctagcacagagtaaagagaactctagagaatatgggactagcccaggccaggcatggtggctcatgcctgaaattccagccattacagaagctaatgcaggaggattgcttaaggccaggagctagagaccggtctggacgacacagtgagaccctgtctctatccaaaagaagaaaaaagttagctgggggtggtggtgcacacttgtagtcccagctactcagaatgctgaagtttgagcctgggaggtcaaggctgcagtgaggcatgattatgccactacagtccagccggatgacagagcaagaccctgtctcaaagaacaaaaccacaacaaccatttacagacagaaaagaaatagagctaataagctgaggaaagatgttgaaatgtgacaagtaaagtaatatgaggtcttttgtctatttaaaataatcaaacaaaaaatggcttacgaaattataataccctgtgctggcaaaggtgcagtgaaatgggcactttcttatactatgaggggtggttaaattgtgtataagccttccagggtaaagcctgtcaattttttaaaataatggagacagggtctcaccatactgccatactgcctcctccaactcttggcctcaagcaatcctcctctcttagcctcccaaagtgctaagattatagctgggaggcacccaaaaccctgtcaatttacatcaagggtaaggagaatgtccattcaccatgactcacagtaatcttacttctggggagacaattcaatctaagcaaaaggtcatctgtacacacacagtaaaaatctgggagtaactgaagacagagttggtaagtgaaataagaaacagttataagaaattaaactatggtatcaataggcacctggtaaaaggtcagttgatgttagctgctacttttttgttgttttgagacagggtctcactctgtcacccaggctggagtgcagaggcctgatcatgactcactgcagtctcagcctccctgggctcaagtgatcctcccacctcagcctcccaagtagctgggactacaggaacatgccaccacactaggctaattcatgtatttttctgtagggatggtgactccccctttgtttccaaggcctatcgcaaactcttggcctcgagccatcctcctgcctcagcctcccaaagtgttgtgattaccagtgtgagccaccacacctggccagctgctacttttatcaatattattcttattccactcaattaaaaattattattttcaaggctatgcaacagtatgtatcctacagcgtaattgtaaaaacatacacagtcgtcatccctcagtatacagaattagttccagccccccatctctgcatataccaaaatccatgcttactcacgtttcgctgtcacccctctagaatccacgtatacgaaaattccaaatgttagttgggcatagtggcaagcacctgtagtctcagccacgtgggaggttgaggtgggaggatcgcttcagcctggaaggttgaggctgcagtcagctgcgatagcactactacactccagccttggacaacagagggagaccctgtctcagaaaaaaaaacaaaataaaacaggttagaaattgtaatgaggtctgctgggcaaaattccatataagcaatgtataaattaataaagcaaatcgtgataaattagtacgattgactttctggagtttctgacaataaaagtaaggaaaatgcagaacacaaagacagagagtaaaaagagaaattaggaaagcattctacatgttgaataggaagacactggccatgttcgtgcagcggcagtatgtcgtgacatgacataccttggagagaagttaacagatgaggaagttgataaaaatcatcagagaagcaaaatactggtagcgacactcaagtaaaccatgaaatttccataacttatgtcagcaaagtgggaatattgtacagtgtgtgttgaagttcctatacaacattgtttatctgccttttgtttgtttgtaaggaatgtacatactaaaagttcttcttgctgtcaaaagaatatgcgtgaataagtcattttaacttattcttctgtttttcttttatcttcctgccatcatcccacagccttactttagaaatttcttttttagaaaattgaacaagtgctccctgtggtggcacatacctcgaggatgggaggcaggggtggaagggtcacttgaggccattagtttgacaccagcctggccaacaaagtgagaccccgtgtctacaaaacaatttaaaaattagccaagtatcgtcatgtatacctacagtcccagctatctgaacttactgagaatgttcagggcctggagagaaggctgggaggcaggagctgggtctaaagaggccattgtaacgatggagctgtgcctgtggaggctgttgtgaggcagtaggctcatctgcggaggctgccgtgacgtagggtatgggcctaaataggccattgtgagtcatgagcttggtctgtagaggctgactggagaaagttctgggcctggagaggctgccgggaggtaggagctgggccaaaagatgtaagcacatttgcatttattaggcactttatttgcattattacactgtaatatataataaaataattatagaactcaccataatgtagaatcagtgggcgtgttaagcttgttttcctgcaactggatggtcccacctgagcgtgatgggagaaagtgacagatcaataggtattagattctcataaggacagcgcaacctagatccctcacatgcacggttcacaacagggtgcgttctcctatgagaatctaacgctgctgctcatctgagaaggtggagctcaggcgggaatgtgagcaaaggggagtggctgtaaatacagacgaagcttccctcactccctcactcgacaccgctcacctcctgctgtgtggctccttgcggctccatggctcaggggttggggacccctgctcaagtgcatccaaagcgacccttcccacaccagtcttcacagtggtcaagggcagcaaccacttagctcccaaggcatgtgcctcagctggcatttcgtcacaatcaacagtaagtggtagcttgagtcactgtgaggtcacctactggaaatcaccagcatcccatttcccactggcaaagagctcagcactgcccccgggaaaccaaacctatgcccaaatcccatctgtgtgggtgtatctcctgggacccttcctaacatattagtcagagtccaatcaggaagcataaaccactcaaaagtttaaagtggtaaaatttaatacagagaattattcattataacaggtgaacagcataatgagagattggctagcacaaagtaaacagaactctagagaatataggactagcccaggccaggcatggtggctcaggcctgaaattccagcaatttgagaagctaatgcaggaggattgcttaaggccaggagctagagaccggtctggacgacacagtgagaccctgtctctatccaaaagaagaaaaaagttagctgggggtggtagtgcacacttgtagtcccagctactcggaatgcggaagtttgagcctgggaggtcaaggctgcagtgaggcatgattatgccactacagtccagcctggtgacagagcaagaccctgtctcaaagaacaaaacaacaacaaccatttacagacagaaaagaaatagagctaataagctgaggaaagatgttgaaatgtgacaagtaaagtaatatgagttcttttgtctatgtaaaataatcaaacaaaaaatgacttactaaattataataccctgtgctggcaaaggtgcagtgaaatgggcaccttcttatactatgaggggtgtttaaattgtgtataagccttcccgggtaaagcctgtcaattttttaaaataatggagacagggtctcaccatactgccatactgcctcctccaactcttggcctcaagcaatcctcctctcttagcctcccaaagtgctaagattatagctgggaggcacccaaaaccctgtcaatttacatcaagggtaaggagaatgtccattcaccatgactcacagtaatcttacttctggggagacaattcaatctaagcaaaaggtcatctgtacacacacagtaaaaatctgggagtaactgaagacagagttggtaagtgaaataagaaacagttataagaaattaaactatggtatcaataggcacctggtaaaaggtcagttgatgttagctgctacttttttgttgttttgagacagggtctcactctgtcacccaggctggagtgcagaggcctgatcatgactcactgcagtctcagcctccctgggctcaagtgatcctcccacctcagcctcccaagtagctgggactacaggaacatgccaccacactaggctaattcatgtatttttctgtagggatggtgactccccctttgtttccaaggcctatcgcaaactcttggcctcaagccatcctcctgcctcagcctcccaaagtgttgcgattaccagtgtgagccaccacacctggccagctgctacttttatcaatattattcttattccactcaattaaaaattattattttcaaggctatgcaacagtatgtatcccacagcataattgtaaaaacatatagtcgtcgtccctcagtatacagaattagttccagccccccatctctgcatataccaaaatccatgcttactcacgtttcgctgtcacccctctggaatccacgtatacgaaaattccaaatgttagttgggcatagtggcaagcacctgtagtctcagccacgtgggaggttgaggtgggaggatcgcttcagcctggaaggttgaggctgcagtcagctgcgatagcactactacactccagccttggacaacagagggagaccctgtctcagaaaaaaaaacaaaataaaacaggttagaaattgtaatgaggtctgctgggcaaaattccatataagcaaagtataaattaataaagcaaatcgtgataaattagtacgattggctttctggagtttctgacaataaaagtaaggaaaatgcagaacacaaagacagagagtaaaaagagaaattaggaaagcattctacatgttgaataggaagacactggccatgttcgtgcagcggcagtatgtcgtgacatgacataccttggagagaagttaacagatgaggaagttgataaaaatcatcagagaagcaaaatactggtagcgacactcaagtaaaccatgaaatttccataacttatgtcagcaaagtgggaatattgtacagtgtgtgttgaagttcctatacaacattgtttatctgccttttgtttgtttgtaaggaatgtacatactaaaagttcttcttgctgtcaaaagaatatgtgtgaataagtcattttaacttattcttctgtttttcttttatcttcctgccatcatcccacagccttactttagaaattttttttttagaaaattgaacaagtgctccctgtggtggcacatgcctcgaggatgggaggcaggggtggaagggtcacttgaggccattagtttgacaccagcctggccaacaaagtgagaccccgtgtctacaaaacaatttaaaaattagccaagtatcatcatgtatacctacagtcccagctacctgaacttactgagaaagttcagagcctggagagaaggctgggaggcaggagctgggtctaaagaggccattgtaacgatggagctgtgcctgtggaggctgttgtgaggcagtaggctcatctgcggaggctgccgtgacgtagggtatgggcctaaataggccattgtgagtcatgagcttggtctgtagaggctgactggagaaagttctcggcctggagaggctgccgggaggtaggagctgggccaaaagatgtaagcacatttgcatttattaggcactttatttccattattacactgtaatatataataaaataatcatagaactcaccataatgtagaatcagtgggcgtgttaagcttgttttcctgcaactggatgttcccacctgagcgtgatgggagaaagtaacagatcaataggtattagattctcataaggacagcgcaaccttgatccctcacatgcacggttcacaacagggtgcgttctcctatgagaatctaacgctgctgctcatctgagaaggtggagctcaggcgggaatgtgagcaaaggggagtggctgtaaatacagacgaagcttccctcactccctcactcgacaccgctcacctcctgctgtgtggctccttgcggctccatggctcaggggttggggacccctgctcaagtgcatccaaagcgacccttcccacaccagtcttcacagtggtcaagggcagcaaccacttagctcccaaggcatgtgcctcagctggcatttcgtcacaatcaacagtaagtggtagcttgagtcactgtgaggtcacctactggaaatcaccagcatcccatttcccactggcaaagagctcagcactgccccctgggaaaccaaacctatgcccaaatcccatctgtgtgggtctacctcctgggacccttcctaacatattagtcagagtccaatcaggaagcataaaccactcaaaagtttaaagtggtaaaatttaatacagagaattattcattataacaggtgaacagcataatgagagattggctagcacaaagtaaacagaactctagagaatatgggactagcccaggccaggcatggtggctcatgcctgaaattccagtaatttcagaagctaatgcaggaggattgcttaaggccaggagctagagaccggtctggacgacacagtgagaccctgtctctatccaaaagaagaaaaaagttagctgggggtggtggtgcacacttgtagtcccagctactcggaatgctgaagtttgagcctgggaggtcaaggctgcagtgaggcatgattatgccactacagtccagcctggtgacagagcaagatcctgtctcaaagaccaaaacagcaacaaccatttacagacagaaaagaaatagagctaataagctgaggaaagatgttgaaatgtgacaagtaaagtaatatgagttcttttgtctatgtaaaataatcaaacaaaaaatgacttactaaattataataccctgtgctggcaaaggtgcagtgaaatgggcactttcttatactatgaggggtggttaaattgtgtataagccttccagggtaaagcctgtcaattttttaaaataatggagacagggtctcaccatactgccatactgcctcctccaactcttggcctcaagcaatcctcctctcttagcctcccaaagtgctaagattatagctgggaggcacccaaaaccctgtcaatttacatcaagggtaaggagaatgtccattcaccatgactcacagtaatcttacttctggggagacaattcagtctaaacaaaaggtcatctgtacacacacagtaaaaatctgggagtaactgaagacagagttggtaagtgaaataagaaacagttataagaaattaaactatggtatcaataggcacctggtacaaaaggtcagttgatgttggctgctacttttttgttgttttgagacagggtctcactctgtcacccaggctggagtgcagaggcctgatcatgactcactgcagtctcagcctccctgggctcaagtgatcctcccacctcagcctcccaagtagctgggactacaggaacatgccaccacactaggctaattcatgtatttttctgtagggatggtgactccccctttgtttccaaggcctatcgcaaactcttggcctcgagccatcctcctgcctcagcctcccaaagtgttgtgattaccagtgtgagccaccacacctggccagctgctacttttatcaatattattcttattccactcaattaaaaattattattttcaaggctatgcaacagtatgtatcctacagcgtaattgtaaaaacatatacagtcgtcgtccctcagtatacagaattagttccagccccccatctctgcatataccaaaatccatgcttactcacgttttgctgtcacccctctggaatccacgtatacgaaaattccaaatattagttgggcatagtggcaagcacctgtagtctcagccacgtgggaggttgaggtgggaggatcgcttcagcctggaaggttgaggctgcagtcagctgcgatagcactactacactccagccttggacaacagagggagaccctgtctcagaaaaaaaaaaataaataaataaaacaggttagaaactgtgatgaggtctgctgggcaaaattccatataagcaaagtataaattaataaagcaaatcgtgataaattagtacgattggctttctggagtttctgacaataaaagtaaggaaaatgcagaacacaaagacagagagtaaaaagagaaattaggaaagcattctacatgttgaataggaagacactggccatgttcgtgcagcggcagtatgtcgtgacatgacataccttggagagaagttaacagatgaggaagttgataaaaatcatcagagaagcaaaatactggtagcgacactcaagtaaaccatgaaatttccataacttatgtcagcaaagtgggaatattgtacagtgtgtgttgaagttcctatacaacattgtttatctgccttttgtttgtttgtaaggaatgtatatactaaaagttcttcttgctgtcaaaagaatatgcgtgaataagtcattttaacttattcttctgtttttcttttatcttcctgccatcatcccacagccttactttagaaattttttttttagaaaattgaacaagtgctccttgtggtggcacatgcctcgaggatgggaggcaggggtggaagggtcacttgaggccattagtttgacaccagcctggccaacaaagtgagaccccgtgtctacaaaacaatttaaaaattagccaagtatcgtcatgtatacctacagtcccagctacctgaacttactgagaatgttcagggcctggagagaaggctgggaggcaggagctgggtctaaagaggccattgtaacgatggagctgtgcctgtggaggctgttgtgaggcagtagcctcatctgcggaggctgccgtgacgtagggtatgggcctaaataggccattgtgagtcatgagcttggtctgtagaggctgactggagaaagttctgggcctggagaggctgccgggaggtaggagctgggccaaaagatgtaagcacatttgcatttattaggcactttatttccattattacactgtgatatataataaaataattatagaactcaccataatgtagaatcagtgggcgtgttaagcttgttttcctgcaactggatgttcccacctgagcgtgatgggagaaagtgacagatcaataggtattagactctcataaggacagcgcaacctagatccctcacatgcacggttcacaacagggtgcgttctcctatgagaatctaacgctgctgctcatctgagaaggtggagctcaggtgggaatgtgagcaaaggggagtggctgtaaatacagacgaagcttccctcactccctcactcgacaccgctcacctcctgctgtgtggctccttgcggctccatggctcaggggttggggacccctgctcaagtgcatccaaaacgacccttcccacaccagtcttcacagtggtcaagggcagcaaccacttagctcccaaggcatgtgcctcagctggcatttcgtcacaatcaacagtaagtggtagcttgagtcactgtgaggtcacctactggaaatcaccagcatcccatttcccactggcaaagagctcagcactgccccctgggaaaccaaacctatgcccaaatcccatctgtgtgggtctacctcctgggacccttcctaacatataaccttcataacaaacttgagaggctgaggtgagacaatcgatttagcccaggagtttgagatcagcctggacgacgtaactaaatctcatctctacaaggaagaggtgggaggatcacttgagcccaggaatttgtggccagcctgggcaacaaaagaagaccccatctggccaacatggccaacctggccaccacggtgaaactctgactctacaaaaatgatctgggcatgggtgacatgcatgtgtagtcctagctacttgggaggttgagatgggaggattgcttgatctcagaaggccaaagctatagtgagctatgatcacatcactgcactccagcctggatggcacagggagattctgtctcaaaaaaaagaaaagaaatatatatttaatctctgtccctggttcctggcacagagcttctaaagctcttacaaagacctcagtgatagatgtgacaggagcatcttttgttttaatatttgatcttggtcccaggtttctaacacaagagcctctaagaactttgggatctccagcatggtaagaatgcatttggggatgttgttgagatgactgggtgactgcaagctcctaaatttcttcaagaggagggctgattaccatgcaaccacatggtaagaggcttggaactttcagcctcatgcactgaactccagggggaagaggggctggagactgacttaatcaccaacagccaaaggttttatcaatcatgcttgcataataaagcctccataaacaccctgaaaggggtttgcagagctttcagggttgctggacacaggagatgctgggagggtcgcatgttcaacagagggcatgggagctctgtgcccctccgaacttaacttgccctgggtatctttcttttttttgagacaggatcaggctcttttgtccaagctggagtgcagtggcacaatctcagcttactgtaacctaagcctccccagtccccagctcaaggtatcctctcatctcagcttccctagtagttggaactctaggtgcacaacaccacaccagttattattattattttttaattttttatagagacaggttttcaccatgttgcccaggctggtctcaaactcctgagtttaagcgatcctcccaccttggcctcccaaagtgctgagattacaggcatgagccactgcatccagcatgcacgtctctttcattgactgtttctgagatgtatccttcacaatgaaccagtaataggaaatgaactggccagatgtggtggctcacatctgtaatcccagcactttcagaggctgaggtgggaggatcacttgagaccaggaatttgtggccagcctggccaacacaacaagaccccatctatacaaaaaataaaagaaactagccagatgtggtggtgcaggcatgtagtctcagctactagggaggctgaggtgggagaaccactggaacccagacaatcaaggctgcaatgagctatgactgcaccattgcacaccagcctgggcaacaaaataagaccctctctctcagaaaaaaagaaaataaactgtttttctgagttccgtaaactgttctagcaaattattaaacccaagaagacagttacgggaacccccgattggtaacaggttggtcaaaagtatggtgacaacttaggacttgccattgtcatctgaagtgaggatggcctcgtgggactgagcccctaacttgtggggtctgtgctaactccaggtagtgtcagaataaagtcatgggatacccagttaatatccagagcactgaagaatctggtgtagaaactccatacatacattcagtcggaagtgtgtgagtagagacaaacatgggcttttctgtcacctacctgcttaactgcataggagaggcaatatgtggtgctcatgaacaaagcaaacattaaagtcagaccagacccaacatttgactcagtcttaatatccaggtgagcctgcgcaaatcattcattattcctaaggttttcatcactccattcataaaatggggataactgtggcacctatatgtgattctgtgagaattaacgaaatattatgcttggggttattgtgatcattatacctgttccaaactatttgacaaggacagtgatggatgaagacatcaaaaaatcagaaactgcaatgaggtctctcaggcaaaattccatacaagcaaattactgtgtctacaaagcattcctgccacacttaattcaccattccctgaacaaaatatgccatcttcgttgttcaggtctgtacagtgctggtttcccttcccgggcagtttgcgctatcccatcccggcccattccccatccctccacctcccccttccctccccactctcatacaactcttcctcatctttcaggacttggcttcaatgtcaccttaactggaagcttctctcactctccagaagagcttcccattgcacctgatgcatgggaaacataatttgatcatttttaagttacagtccaaatctttttgtacctgaataacatgttgcccagtcagtctctcttcctggattcacaagtctttcatggtagatccagctggaagtgacaaaaagacatcttttgacataaagggatgacacagacagacataagttcttaaatgtcttaaatgtcatgtgaaaattaaacagaattcaaagacttgtggggagcacttaggaagttactgggaatgtcatgaagggttaatttgtattttattttattttttgagacagtctcattctgtcacctaggctggagtgcagtggtgcaatcaggctcactgcagccttgaccacctgggctcaagtaatctcacttaatttttatttggtttaagaaagtcttggttgagggtggtggcttatgcctgtaatctcagcactttgggaggctgagagaggtatattacttgaggccaggagtttgagatcagactgggcaatatattaagaccctgcctctaccaaaaaacagagtgaatgtgtggaagacaatttttccacagactgggaatgagggaataatttcaggatgattcaagtgcattacatatattgtgcactttatttctattattactacatagtaatatataatgaaatgattctacaactcactataacgtagactcagtgggatctctgagcttgttttcctgcaactagactgtccacctggggtgatgggagacagtaacagaatatcaggcattagattctcataaggagtacacaacctagatccctcgcatgcacacttcacaacagagtttgtgctcctatgacaacctaatgctgctgctgatctgacaggacatggagctcaggtggtcgtgcaagcgatgggaggggctagaaatacagatgaagtttcccttcactcgcctgctgctcacctccagctctgtggccctgtggttggagaccgctgctcaagtgcatttgaaaggaaccatcccacgccattcttcagagtcatctttactgctgcagtggtcaacttgtagcacccccaagctcgcaggacatatgcttcaactggcatttcacaatcaacagtatgtggcagcttgagtcattgtgagctcacttcctggaaatcaccagcatcccatatcccattgcaaggagctcagcactgctccttggataaccaaacctattcccaaatcccatctgtgtgcgtctatctcctggtacccttcctagcatcaattctgtatttgtaggagtccaatcaggagacacaaaccactcaaaagtttaaactagaatgagcaagatggctcacacctgtaatcccagaactctgggaggccaaggtgggtggactgctttgagctcaggagtttgagaacagtctgggaaacatggtgaaacctcgtctctacaaaaaacacaaaaatcagctgggtgtggtggcacttacctgtaatcccagctactcgggaggctgaggcaggagaattgcttgagcctggcaggtggaggctgcagtgagcagaggttgtgccactgtactccagcctgggtgacagtgtgagacccggtatcaaaaagaaaaaacgtatatatatatatatatgtaaatttaatataaaaagtattaattttggccaggcaaaatggctcatgcctgtaatcccagcactttgggaggccaaggcagacagatcacctgaggtcaggagttcgaaaccagcctgaccagcacagagaaaccccatctctactaaaaatacaaaattagctgggcatggtggcacatgcctgtaatcccaactactcgggaggctgaggcaggagaattgcttgaacccagaaggtggaggttgcgctgagccgagatagcaccattgcactccagcctgggcaacaagagtgaaactccatctcaaaaaaaaaaaaaaaggtattaatttttacagaggatcagcacaatgagggacacactagcacaaagtaaagacaactctagagaatacggaactagcagaggccaggcattgtggctcatgcctgtaatcccagcaatttgggaagcctaggcaggaggatcgcttgaggccaggagttggagaccaatcagtgctaaatagtgagactctgtgtctaccaaaaaaaagagacattagccaggtgtggtggtggtgcacacccgtagttccagctacttgggagtctggggtgggagaaatcccttgagcctgggaagtctacactacagtgagccaagattgtgccactgcactccagcctgggcgacagagtgagaccctgtcttagaaagaaaaaagaaaagaaagtgttaatccccctatgggaatctcctcttctcctgccctctctggaacctcacttgtcagttcttcctcccactttcctgtatctttaacctatcccccacttttagctccttcccatcatcatttaaattactcaaacttcttctgttttaaaaacctctccctaaactcagggagaggtcttctgcacacacattgagccatctgctcttcctggtgccttctctacagcagcctgagccatgtctctaatctatgaatctcatcatgttactcccccatttacatcacttctccttgcctcagggattaagtccaaactccttaacagcccctgctctgccctgccttgcaaggcagcctcactgcttgcccctctccatttcatctgctatggagtccaactgagcctcatctgccccttgaacgcacactctttctcctctgggagtctctgaagtgggtaatatcctctgcttataatatgcttccccttaaacctctactctcttcctagctagctttgactcctctgtcacttgtccgctttggcatcacctcctcatagaagacttctatgactcccgagattctcaggagcatggcaggtgaagtgctcctcccatgaatggatggagattagggagtgtgtgttattcatgcttaattcaccagtgcttagctgagtacctggcataaaatagttactgtggtggccaaagtaataacccccaccgccaccaattgctcatgtcctatgttacacagcacaattacataggaagggggaattaagagtgcagataaaattaatgttgctcatcagctgaccttaaaacaagattatcctggagtatctaggagagcccatgtaattacaagcattctttaaaactggaagagggaggcagaaggttaagaaccagagacggtgggcacaatggctcatgcctgtaataccaatactttgggaggccagggtaggaaaatcccttgagtgcaggagttcaaggtcagccatggcaacatactgaggtcccatctctacaacaaaataaaaacaaaattcactgagtgtcacgatgcttacctgtagtcccagctactgggaaggctgacatggtaggattgcttgagcctgggagtttgaggctataatgagccatgataggaccactgaactccatcctgagtgacagggcaaggtcctgtttctgaagaaaaaaaggacattggaatcaggaccctctccatcctgaggtgcctacaaggcatctctctctgcaaacgagtaaacatcaccctccaactccttacagagtggagcaacaggaaaactccttcacctcatttctgtgctgcttgggaggcctggacagcccaataaccagctcctcgctgatgaagcaatcaggaaatggctcgagttgagctaaggagaatttggatccttcctttggttctcagtaggcagggtagggggccaggcatggtggctcatacctgtaatccttgcactgtggggggccaaggtgagaggattgcttgaggccaggagctcaagaccagcctggacaacatagcaagacctgggtggcatacacctgtggtccctactacttggtaggatgaggtgggaggattgatcacttgatcccaggagtttcaggctgcagtgagccatgatcacaccactgcacttcagcctgggtgacagagccagaccatgtcacaaaaagttagaaaaaaaaaagagggagagagactatacacaggcaccaccacatttggctaatttttaaatattctgtagagacaaggtcttgctaggttgcccaggctagtctaaaactcctggcatcaggctgggcatggtggctcatgcttgtaatcgcagcactttgggaagctaaggcaggcaaatcacctgaagtctggagttcgagaccagcctggccaacacggtgaaactctgactctatcaaaaatacaaaaattagctgggcagtagtggcgtgtacctgtagtctcacctactcgggaggctgaggcaggagaatcacttgaacctgggaggtggaggttgcagtggaccccatcactgcactccaccctgggtgacagagcgagactgtcaaaaacaacaacaacaataacaaaaacaaaaacaacaacaacaaaaaaaactcctggcatcaagacatcttcctgtcttagcctcccaaagccctgggattatactgtttcctataattgaagacacttgttcttatactgctttaaggtataaaggaagaaaaaaaaaacagataatggcaaatgttggtgaaggccgggcatggtggcagcctgtaattccagaacttagggaggctgaggtgggcagatcacttgaggccaggagtatgagaccagcctgggcaacatggtaaaatcccaccactacagaaaaatctaaaaattagccaggcatggtggcgtacacctgtaattttcagctacccaggaggctgagatgagagaatcacttgtgcctgggaggtcacggctgcagtgaactgtgatggcatcattgcactgcggcctgagagacagagcaagcccctatctagaaaaaaaaaatgtcagtgaagatgtggaggaattggaacccacatacattactggtgggaacataaaattgtgtaaccattttgtttgggtatttcttttcttgtcattttaattggatttttaaaaaatcaagacggggtttcactatcttgcccaggctggtcttgaattcacgggctcaagccatcctcctagctgagcctcctgagtagctgggattacaggtgtgagccattgcacccaactggtatagccacgttagaaaacagtctggcagtttctcaaaaggctaaatgtacagtcatcctataatgcaacaatttcactcctaggcatatatcccagaaaaataaaaatatatgtccacacaaaaacttgtacaacaatcttcatagcagcattattcataatgaccaatacatggaatacatggaaacaacccaaatatccaccaactgatgaacagataaacaaaatgcagtgtgtctctaccatggaatactgccatagaaggaatgaaatattgatacacactatgacataaaggaactttgaaaacactgtgctaagagggaagaaaagccacaaaagatcacatattgtacaattctatttgtccagattaggcaaatctatagtgacaaaaaaattaatcaatggttgcctaaggctgggggcaaaggtaggtggggagagtaggaggtagtggctaaggggtatggatttctctatagggtaatgaaaggttctaaaagtgactgtggtgatcgatgcacagctctgtgaatattctaaaacctactgaattgcagatttcaataaataaagtgaatggtatgtgaatattttaataaagctattatttaaaataataataatagggggctgggcacaggtggtcatgcctgcctgtaatcccagcactttgggaggctgaggcaggaggatcacttgaggtcaggagttttgagcccagtcggagcaacatggcaagatctcgtctctatgataaaaaattacctggacatggtggcacatgtctgtagtcccagctacttgggagactgaagtgagagaaccacttgagcccaggagtttgaggctacagtgaaccatgatcatgtcactgtactgtagcctaagcaacagagcaagatgccatctctgaaaaggaaagaaaacaaatgcaagtttttatcactttgtgagtgtagccaagttggaggagaaatagacaataataaaagagcactgaataatgacggtgagtggctggttaggctcagttgctagctaaatggcttctaaaaaattcaataaagttacagctctggggacagtcatgtagtcaaagaatgaaggcgaaattcattacaattgcccatggtctttatttacatgccttctagtgaaaaattcctaagtgcctaaacagcaagtctgcaatgatagcagctgtttattaaagactacaaaaaagaaatggaggccgggcgtggttgttcacatctgtactccttgaattttgggaggctgaggcaggcagattgcctgaggtcaggagctccagaggagcctggccaacatggtgaaatcccatctctactaaaaatacaaaaattagctgggtatggtggcgggcacctgtaatcccagctactcgggaggctgaggcaggagaattgcttgaacccagaaggtgaaggttgcagtgagccaaaatcgcaccattgcactccagcctgggtgacaagagaaagactcttatcttaaaaaaaaaaagaaaaaaaagaaatggcatcttcttcaagaattacatcgtgtttcatgataaagaagctctaattttgcatttgttcaagtattgatgagatttacccaatatgacacccatcttggataaaatgcaaacaacacaatttcattttctcattaacaaaaccgattaagtagtctaatataaattgcgatcttattaaaaactgatcagattaaaaaaattatggaattatggagccaataagatgttacaacctgttccaaggggaattccaaaatccacacatatctgagaccatcaagtatgatgaaatatatttgattactatattgaaaaataaactgattacatagccaacaattggacaggggtctcctcatccacagccacacaaacccgatcatgcagctatgtggttacaaggcctacatagcctagaagggactggtctgacttgagatttcatttgtatttgtattttgagacagggtcccactctgtcacccaggatggagtgcagtggtataatcatagctcactgcaaccttgaccaactgggctcaagagatgctcctgcctcagctgcccccatacctgggaatacaggcaagtaccaccatgtcaggcatttttttcatttttgtagagagagaagacttgctatgttgcccaagctggcctcaaactcctagaatcaagagatctgcccatctcagccacatgagtaactggggccataggtacataccatcatgcctggctatatttattttattttattaaatttattttttttatttttgtagagaggaggtcttgctgtgttgcccaggctgctctcaaactcatggccttaaaacatactcccatctctgcctctcaaactgttggaactataggtgtgagccactgtacctggcctgacttgggatttcttttatctagcatcctttacttggtaggattgggaaaagcagtagtgttttttaaaattacttaataattcaatcagaatcaaactcaaccttgaccactgccttctctcacagctcacatccagtctgtcaggaaatcctactgactgacttcaacatgtatccaggctctaaccatctctcaccaccaccatgaaccccgtcaggatcactatcatctcccaccgggatgttgccacagcttggctcccatgcttctacccaaatcttcccatagtctttctcaactcggcagccaggtcgtgcttttaaatcaggagacggatcatgtcgcctctctgctcagaagccctcggtggttcccattttagtcagagtaaaagccaaagccccagcaatagcgtcccagggcttacacgatctgtaccgatcccagcccagcaactccctggccacctcgctgacttcgctccctctatctctttgctccactggcctccttccagagcctcagacacaccagagagtttcctcctaatgcctttatcctgttgactcagcctacaatgctcttccctcagcaccttggccagctccatcacctgcttcaaacttttgctcaatattcacttatgaggccaaccctgaccactctacttaacactgccatctgtccccattcccaccatgctcatttctttctttctttttgaaacaaggtcttgctttattgcccaggctggagtacactggtgcaatcacagctcacagcaacttcaacctcccaggcttaaacaatcctcccgcctcagccaccctaggaactgagactacagctgcatgccacaacacatggctttttttttttttttttgagatggagtctcggtcgcccaggctgaagtgtaagggtgcgatcttggctcactgcaatgtctgccttttgggttcaagtgattctctgcctcccaagtagctgggattacaggcacccaccaccacacctggctaatgtttgtatttttagtagagatggggtttcaccatcttggctaggctggtcttgaacttctgacctcgtgatccaccctcctcggcctcccaaagtgctgggattacaggcgtgagccactgcgcctggcctttaaaaaaatttttttttagacatgaggtctcattatgttgtccaggctggtcttaagctcctgggcttaagcgatcctcccacctcagcctcctaaagttctgggattacaggcgtgagcaaccgtaacatgaggtcccagcttcatgttcattttttgttgttgctacaacaaagtaccctacatttagtggcatcaaacaccacaaatctaccatcttacagttctgggggccagaagcccaactaggtctattaaggttaaagtcaaggtgtcagagaggctgcattccttctgggggaggctctagaaagaatgtgctcctttgccttttccagcttctagaagccacccccattccttgacttacctcgtgactccatattcaaggccagaagtgcagcatcttcaaatctccctctctgacctcttcttccattaccacatcactttctctaattctgactctcctacctcattctcttataaagatccttgtgattggtgggtatgggggctcccatctgtaatcccaacattttgggaggccaaagaggaaggattgcttgaggccaagagttagagatcagcctggggaaaaaaaggaagatcctgcctttacaaaattaaaatcagctggacatggtgatgcatgcctgtagttccagctactggagaggctaaggtgggaggattgctttagcctaggaggtcaaggctgcagtgagctatgatcacatcactgcactccagcctcagtggcagagtgagactctgtctccgatataagaaaagaaatatacatttggtctctgcccctggttcctggcataaagcttccaaagctcttataaagcccttcgtgacagaggtaataggagcattttctgttttgatatttagtcttagtcccaggttcctgacacaagggcctctaaggtctttcagatctgcagcatggtaagaatgcatgtgggatgctgttgagctaacagggtggctgcaagctccgagactgcttcaggaggagggctagctgccagagaaagcaaccacattttttttttaaaacggagtttggctcttgtagcccaggctggagtgcaatggcacaatctcagctcactacaacctccacctcccgggttcaagcaattctcctgcctcggcctcccgagtagctggaattatagggatgtgccacaacgcctagctaactgttgttatttttagtagaaatggggtttcaccatgttggtcaggctggtctcaaactcttgacctcaagtggtccatgtgcctcagccttccaaactgctaggattacaggagtgagccaccgcacctggccccaaccacattttttgaggcttggaactttcagcctcacctgctgaactccaggaggcaaaaggaactggagattgacttaactaccaatggccaatgattttatcaatcatgcctccataaacacccaaacagcagggtttggagagcttctgtgttgctaaacacaaggaggtcctgggagggtagtgtgcccaacagagggcatggaagctctgtgcccctccccacttaccttgtcctgtgcatctctttcattggctgttcctgagatggagccattacattgagccagtaatagaaaataaggtggccagatgcgctggctcatgcccgtaatcccagcactttgggaggcagaggtgggcggaatcacttgagcctaggaatttgagaccaacctgggcaacataagaagaccccatctatacaaaaaataaaagaaattagccaaatgtggtggtgggaaccctgtaattccagctacttgagaggctgaagcaggagaatcacttgagctctggacgttgaggcttcaatgagctatgattgcaccactgcacaccagcttggacaacagagcgaggccctgtctcttaaaaagaaaagaaaaaaaaacttgtttttctaagttctgtgagttgttctagtaaataattaaactcaacaagagggtcatgggaaaccctgatttctaactggttggtcaaaatacaggtgacaacctaggacttgcaactggcatctgaagtgagggtggtcttgtgggactgagcccctaacctgtgggttctgtgctaactctaggtagtgtcagaatggaattgtgggatacgcggttggtatccagagagttggagaactggtgtagaaactctgcacacacatttggtcagaagtctgtgagtagagagaaacgtgttgcaggaagtcagggaccccaaacggagggactggctgaagccacagcagaagaacataaattgtgaagatttcatggacatttattagttccccaaattaatacttctataatttcttaggcctgtcattactgcaatctctgaacataaattgtgaagatttcatggacacttatcacttccccaatcaatacccttgtgattttctatgcctgtctttaatctcttaatccggtcatcttcgtaagctgaggatgaatgtccccgcaggaccctgtgataattgcgttaactgcacaagttgtttaaacaatatgaaacctgggcaccttgaaaaaagaacaggataacagcaatttcagggaacaagggagataaccttaaactctggctgccagtgggccgggttgaacagagccatatttctcttctttcaaaagcaaataggagaagtattgctgaattctttttctcagcaaagaacatccctgagaaagagaatgcatccctaaggggaggcctctgaaatggccgctttggggacggctgtcttttacagtcatagataagggatgaaataagccctgggttcgcgtggcgctcccagccttatcaggacaaggaaattcccgcctaataaatgttggtcagatgggttgtctgctctcaaaccctttctcctgataagatgttatcaatgacaatgcgcgcccgaaacttcattagcaattttaatttcgccccggtcctgtggtcctgtgatcttgccctgcctccatttgccttgtgatattttattaccttgtgaagcatgtgatctctgtgatccacaccctattcgtacactccctcaccttttgaaaatcactaataaaaacttgttggttttgcggcttggggggcatcacggaacctgccgacgtgtgatgtctcccctggacatccagctttaaaatttctctcttttgtactctttccctttatttctcagactggctgacactcagggaaaatagaaaagaacctacatgaaatatcaggggtgaatttcccccgatatcacactggctcttctctcacctgtctacctgcttaacttaataggagaggcaatgcatggtgctcatgaacaaggcaagcattaaagtcagaccagactaacatttgactcagtcctaatattcaggtgagcttgggcaaatcgctcattaaccccaagtcttcatcattttgtgcatataatggggataactgtggcacccacctgtttttgtgagaatcaatgaaatattatgcttgatgttattgtgatcatgatactatctgacaagggcagtgatgcatgataacatcaaaaaattagaaactgtaatgaggtctcttgggcaaaattccatacaagcaaattactgtctctacaaagcatttctgccacacttaattcaccattccctgaacaaaatgtgccatcttcattgttcaggtctgtatagtgctggtttccctgcctgggcagctcactccatcccatcccagcccaatccccatccctccacctcccccttccctccccactctcatacaactcttccttatcttacaggacttggcttcaatgtcaccttaactggaagcttctctccctctccagaagagcttccgattgcacttgatgcatgcactattatttgatcatttttgagttacagtccaagtctttttgtacctgaataacatgttgcccagtcagtttctcttcctggattcagaagtctttcatggtaggtccagctagaagtgacaaaaagacatttaaaaaaaaaaaaagagggatgacacagacagacatcagcacttaaaagttttaaacgatatgtgaaaaacaaaatttaagggcttctaggagaaatgtaggagggaaggtgttactgggaaatatgatagaaggttaatttttattttattttatttttagagaaagggtcttgctctatcacctaggctggactgcagtggtgcaatcacagttaactgcagcctcaacctccagggcttgagcaatattcccatctaatttttattttgtttaagaaatgcagtcttgctcttagcaaagctaaagtgcaatggtgtgatcatagcttactgcagcctcaaccttctagactcaagtgatcctccagtcttagcctccccagtagctcggactacaggtgtgcactgcaacgtgtagctcatttttttttttaatttttagtagagacaaagtgtcactatgttgaccaggttggtggtgatctcctacactcaggcagttctctcacctcagccttccaaaatgctgggattacaggtgtgagctgccacacctggctgagggggttaatttttaattatataaagagctcaaagcaaatattagaaggagcctaaatgcctccagcagttgactggtactggtaaattgtgatacatccatataataaaatattatgcaaccataaaaaggattaagatagatcaataggtattggcacaaatgtccacgaaatatgaaaatatgaagtgatgttcaatcaccatgtacgtatcttgaaggatatggcccattttctcaactgcaattatttcctgagataagattatgggtctaaagagtgaaggacatttttcacttatttaaaagtatttatcatttttataatttaataaaagattaaacagatcattgaattagtaaaagacaaagtaactctataaataaatggaaaagacacagataccccaggcatggtggctcatgcttataataccagtactttgggagggggtggtggggggattgcttgaggccaggagttccagaccagcctaagaaacaaagcaagacctcctctctagtaaaaataaaaaaataaaaataattggccaggcatagtggcatgtgcctatagtcccaactactgaggtggaaggatcacctgagcctaggaggtcaaggctgcagtgagttgagactgtgccactacactgaagcctaggagacagagcgagacttcatctcaaaaaaaaaaaaaggacaataaagaaataaagctaataagctaacataaggaaagataaaatatgtgacaaataggctgggcacatggctcacagctgtaatcaagcactttgggaggccaaggcgggtagatcacgagatcaggagttcgagaccagcctgatcaacatggtgaaaccacgtttctactaaaaatacaaaaattaaccaggcatggtggcatatgcctgtaatcccagctactcaggaggctgaggcaggagaatcgcttgaacctgggaggcacaggttgcagtgagctgagatcacaccactgcactccagcctggtcgacagagcgagactgtgtctcaaaaatgaaaaaagaatgggtgacaaagtaataataggaggtctttcatttatcacacagaaaataacttgttaaattataatacctgtgtgggcgaaggtgcagtgaaatggccattttcttgtagtattagtggtgtttaaaatgtatataagccttccagcataaagcttggaaattttttttaaatcatacagacagtgactcattatactgcctcctccaactcctggcctcaagcaatcctcccacctcagcctcccaaagtgctggaattacaggctgacagccaccatgcctgaaagctttgcaatttacatcgagggtaataagaatgctcatgccctgtgactcacagtaatctcacttctggaaatttcacctttggatataattcaacctaaacaaaaggtcatatgcacaaacacagtgaaaatctgcgagtaatttttttctctttttttaaaaaaatatggaatgcttcacaaatttgcatgtcattctttcacagaggccgtgccaatctctctattgttccaactaaagtatgtgtgctactgaggcaagcatgagtaatttaagatagagtggttaagtgacataaggaagaattatggagaatttaaaaatctatgctatttataggcacctagtaacagctcagtaaatattagctgctactattattatttttatggtaatttcactcaattaaaaactgtcattaaaaattaccattgtcatggaacataatgtctcctactgtgtaattgtagaaacagatacaatttgtcccttggtatatggggggattagttccagctctcccatttctgtgtataccaaaatccacgcatactcaagttttcgaagtcagtcctgtggaatccacatataacacaaatgggaaaattagtgaggtgtggtgacaagcacctgtagtcccagctacttgtgaggctgaggcaggaggattgcttgagcccaggaggttgaggctgcagtgagccataattgcaccactgcactccagtctgggcaacacagtgagacagaaggttgactttttaatagaatttttctgttcacttgaagatatggtcaggattgtggcatatgaaaattcttcataaaataactatctaatccaattaatgctggaattgggaacagcagaagtgtcatctcagagctactcacaatgaaaggtgatgtctggggctcaggtgtgttgaggtccccatgcctggactatgggtgctgagtgggatttacttgtccatccattttctatattccagcactgggaaactagggacagtacttgttctcaagggaatcttcagcttaggtggctctgtaaaagagaaattacatcattgaaaaatcgtcgcaggtcaggtgaggtggctcatacctataatcccagcccactgggagactaaggcaggaggattccgtgaggccaggagttcaagaccagcctgagcaacacagtgaaacctcatctctacaaaaaattagaaaatgaactgggtgcggtaaaacattcgtatagtcccagctactctggaggctgaaataggaggatcgcttgagcccaggaagtggaagctgcagtgagctctgatctcaccactgcactctagccttggtgacagagtgagaccctgtctcaagacacacacaaacacacacacacacacacacacacacacacacacacacacacccaatctcactctgtccagccttgactaatcaaaagggccttctggttacagaagaggtatgctcttttgtaggacagggagagaccagcaagcttgttcacagacttttcctcatcctctgcttagttttccaagaaccctcacagtggaaatggagtctctgggaaaatgacctaaatctttgggttaccaggggagaaatatgcctcctttgtcaattaataaatggaacatcagccttaaaatccagggagttctgctagaatgaatcactccctaagaccctgaccaatgcatggaacatgaaaaactgaagtttaactgggcgcggtggatcacgcctgtaatcccagcactttgggaggctgaggcgggcggatcacctgaggtcaaaagttctagatcagcctggccaacatggtgaaaccccgtctctactaaaaatacaaaaattagttgggcatggtggtggacacctgtaatcccagctacttgggaggctgaggcaggaaaatcgcttgaacccggaaggcggaggttgcagttacttctagaagaatttccattagccctttgaaatccttcaacattcatgaaggccaaagagttttcacctaatttaatctgatgggtatgtgaccagagtctttctagggaatagagactcccaaacagttcgactgggaagtgaggagagaatttattactcaaaaccaaagggaaatgaaaagaggccaacatagaatgtcattattctttcttggcggggaatggattccagagtcattctgtgacctttacatgacctccttattagcatctaaaagcttccagtgtaggatgcagccagctaggttctcttctaatgtaataaaatttgcttcggcaaatcttatgcagagccaactccaggctccagaaacaataggctataaattactggatctcccatttgatacaatgaagtatgagcacggtcctgaatgactcctctacatactactctgggtggcttgaagtgaatttgatacaagaactggagcgagggcaaagcagagctagatctaggattaatgtgcttgggcccagctcctcactactcacctatgagtctagttccagaacccaagtagaggatggggaaacaaggctcctgactttttttccctaatatctgcatctctttcacatttcttatctccttgcaaagaaactaaacagtctcaactgaaataactaaatgattaaaccctatacagagaatctccaaagactgacaaaatatcattcaagactgttacacagacaaccttgaggatgacttgatgtaccagtgatctacaatatttgggatcattccaaattcccatcaaggatctgcctatatcaacaaaggagccaaggaccaaccattcaaatgggccctgctgccaagcctttttttttttttttaacaatgccatctcttcatattgttccatttaacaaaactgcagcccttcatctatccttaagtcccttggccaatggtacagagccagagtatgctactccctagcaggaaatcaacaggatgacctactaaacaccattcagaagatgctaagacccatgaattgcaacaggaaagaaaagacagagaattagtcagacaggtacatgctgtgccaaaaatgcactacagcccccacccaattctgcctaatcctagctgggctgacaccaacctgatgagacaggcctataagatctcaaactaaaacagaaactcctgaactgggttcttttgagcccaggaagcagcagtaaatcattaaagaacagataagttcttaaggtgagggagagtttcagataaatggaatgctggtagaacacagggcccaaaggagcaaaagttaacctaagcccaggtagaaccttgtttactagagtattaggcatgggtttgggcaactattctaaccagagaaactggcttcagtgagggcaagttggcaatccaaggtatagcatgcatagggctggcaaaattcagggtgactgaagcaaaagcttcagaaccagaaagaccacatctgggggtagagcacaaaactctcaagagatgaatctttgtaagagtgaggcagaactatatagcagttttaggagatctgttggtgcccagcaagagctccaaacgggctatatgcagggatgcaggctgtagtctcaggagaggaggttcacaaaagtcattcagtccaagacctcaaactgtgttctctactaaaaggaatcaaggttccctagagaaacggctgactccatgtatggtgcagtatattgatcctggaacatcttttttgccagaaagcaaggaagccatcaaagtccaacaggatcacgtcaaaaagacatgaaagtcaacttgaagagataattattaacctagatgagacaatgtaagcatccaaaacaataaagactgcaatggcctgaaatacatcaaatgcaaacaataaactatgagttcataatggtattcagaaaaaaaaactactggtcattagagggaaggttactaggtcactaacttactactctgaaaagtgacttaagatgagaggtagggtggagaattagctatttattcagtctttcctgtacaaacataaatttttagggagattgaagcagatgaaacaaatctggaaaaatggaggtaactgcttaatctgcgggttgggtgcatggaggttcaacatatttcttttgtgtatatttgaaccccctacaaaaaaagcacaagacagaatgtgagccaagcagcttagggtttaggcaaggcttctgcctacaagagacaccaggatatgaggggtagttttagccctattgggctgagccaactggaggtatatagggaagtgctaaattgcagaggtatcatgttgcccagcacttgatcaaatcctagatcctaggtctgcttggtggcatgcttcctaggtagtggatctgaggctacctatagaacttcctttgcagtcatagttcactcagaaactacaaaagtgcttgctcttgaaaatggagtctttgtccatttcatgcttctataaaagaataccacagactgcataatttataaaaaggaaaaaaggaaggaaagaaaaaaggaaggaaggagggaaggagggaaaaagggaaggagggaaggaaaggaaggaagggaaagaaggaaaggaaggaagggaaagagagaaagagggaaggaggaagggagggaaggagggagggagggagagagggagggaggggaagggaagaaaagggaagagaagggaaaggaggaagaaaaggaaaggaaaggaataaattttatttcttaacagttctggatgttaggaagtccaaggttgaggggcctgcatctggtaagggtcttcttgctgcatcatcccactacagaaggcagaaggaaaagagagtgcaagaaagcaagagggcaaaaggggctgaactctgttttataataagcccactctgtgattactaatctattagcacaataacaacattaactcattcatgaaggctattttattaggccccacatcccaactgttgcattgaggattgagtttccagcacataaactttgggggacacatttaaaccatagcagagcacttaggttaattcaactaagaggagctgggaaaatcaaaggcatgagaaagacagcaaaagctagcagagagaaatgcataggttaaggaaaaaagtcacagtgaatcctgtagtgcaggctactttatcaaaagcacctaaaaaagatctcattaactcccccagctcacctccacccacatctaaagagccacacacagcaccaccaaaggcagcacaatgagaacagcattctcctcaacagacaagctgggagtatctagacacctgacctcaatagctccagaacagccctaaaacatttcctccctaaccaccactcaagtcaccagcttggaaagtattaagaaaacccaaatcctgacacaccactatgaaacaacttaaaacagcaaagaacaacccatttaaacagcaatgccagctgttggggaaaaaaggaacaatgagtagaggagaaacagaccactcggggtccaccaagacccagtctctcagcttcagcacttttaaatgcagaatccatacccctctggggcctgtggagctccacaaggcatgtcgtcctcaaagataaatgagcaggcaagctggctagaaaaccactaagggtatttattctttaaagaatctttacagggtcaaagaagaatgggtcttaactggctatgtgaactccccacagattctgaggatgatgtcagtatccctttccagatgtgtttaacactttgcagtcacttgtattcctgccactgagtgccagtgctttgctaatttgaactgattccagctcacgctgaccccagctccctggatgttaccattagccaagactgtcacccatactgtaccctttcaaagagtcctaaaaacagctcttcacctactcttccaagacaagtaaaaatgtctgccaaagaaatggggaaaaaagattcagagagtgaaaacaattaatatactaacaagagagcaaaaagcaaagggggaggagaaactaggaaaatcatatatgggctctcacctatttccaaagctgggctaatgtccttttgcttgtgtctgaataaggcaccaattttaagctgctaatgaaaaaaaaagaaaaagagaaagaagcaggcccaggctgggcgcagtggctcatgcctgtaatcccagcactttgggaggccgaggcgggtggatcacccaaggtcaggagttctagaccagcctggtcaacatggtgaaacaccatctctactaaaaatacaaaaaattagccaggcatggtggcgcatgcctgtaaatccagctactaaggaggctgaggcaggagaattgcttgaacctggaaggcagagaatgtggtgacctgagatcacgtcattgccctcaagccacggcaatgagaacaaaattcggtaaaaacaaaacaaaacaaaacaaaatcaccataaaataactcagacttaattaaatacaaccctagtggtgaatgactaaagatggattactcataacagagataacggtccaataagaatccaggaatcttaccttttaataacaaaaaaatcctttccttctaaagtaacatcctctcaaggccaggaattccattagtagaaagccttcctaaaaaacaaaattcctggccaggcatgggttcacgtctgtaatctcagcactctgggaggccgaggcgggaagatcacttgatatcaggagtcgaggcgggaagatcacttgacgtcaggagttcgagactggcccggccaacatggtgaaaccgcatctccactaaaaatacaaaaattagcctggtgtggtggtgggcacctgtaatcccagtgacttgggaggctaaggcaggagaatttcttgaacccaggaggcagaggttgcagtgaccagcaaggttgcgccattgcaccccagcctgggcgataagagtgaaaactccatctcaaaaaaaaaaaaaaaaaattcctttgggaaggccttctacataaaaatcttcaacatgagactggaaaaaagggtatgggatcatcaccggacctttggcttttacagctcgagctataagaacaaaaagaaaaagggatatcatttaaacacagtatgtagaaaagaataattattgaatctgtactggtctttaacttttacactttgatctttaattctgttattgtgattgagtccaaagaaaaacagtatgagtaaaataaaaagaacaccaaaaatgctaatattctgtttaccgaagtctgtagtgatatatcccattaaatccaagtgcagtgacacacccataatcccaagcactttgggaggctgaggcgggtgaatctcctgaagtcaggagttcaaggccagcctggccaacatggtgaaaccccaactctactacaaatacaaaaattaggcaggcgtggtggcagaggcctgtaatcccagctacttaggaggctgaggcagggagaattgcttgaacccaggaggtgagcttgccatgagctgagatcataccactgcactccagcgtgggtgacagaacaaaacttcaacctccaaaaaaaaaaaaacagctagcaggtgacatttgctatagggagactagggatatgatcttgctgcaatccttccattttagtaaatctaaacagtgtgaatccattctgtttcgtccccactccactccagagccaaaacaagaaaatcaattatatttctagttctttaaaaacatatctaactaaatcatctaattaaaagataatatgcatggttccatactctaaaagaaaacttatgtcctgcatatcatggacatttgatgaatgcttattcagttgactggtgtagacttcaataataacctgttcaatgcattatgccagatgaatcttgcatctcaaaagtagaacaaatattgttctttcagttttgtctacccataaatgcaatatttactaataaaaagaaaatgagtttattgttctagagagtatgagaattttgacaacatgaattctcctgtcctaggacataattaatacttagaggcatactatttcatgtggaagctaccattaaatcaatgttaagtgttaattacctcacataatcttctaatctgacttgactgaagacgtacctgacaaagttgatttatcaagttgtaaatcttcacctgttgaattcataagttcatgtctgaaaggtgagaataaatacttaatattcactaggcaatttcagcaaagtaatatccactagtacatatttaacatttcatcatgaactgcgggtgtgaagagaaaagacaggctgggcacagtggctcacacctgtaatcccagcagtttgggaggccgaggcaggcagatcatgaagtcaggagttcgagaccagcctggccaacatggtaaaaccccgtctgtactaaaagtacaataattagctgggcatggtggcaggcacctgtaatcccagcgactcaggaggctgaggcaggagaattgcctgaacccaggaggtggaggttgcagaaaccattatcacgccactgcattccagcctgggcaagagagcaagattctgtctccatcaatcaatcaataaaaatataaggaggaagcatttactgtgtatttatatgtctggtattatgtgaagcactttactatcttatcaaatcttcgggacaggtcttcagttctcatgaccacaaaagaggatactaaagctcagacaggagaagagacgtggccagcctgtgtccccagggcctatggtcttaccactaggttacagtgtttccagatatcacatgttgtgagatttttgctttaaaatgaaccaaaaaaaaaccaaaggtgaaaaaggcataagctattaaaaagtgggagaaacactaagagaaccttaagcatgtaactaaaaatattatggaaatgttattgaattcattagcaaatttagtgctaggttttcattgaggagtaggttatattactcatgatgaagaaaaatgttccttttaagtatattaacataaataccatcaatattgtttatcatgtttaaatgttcacttaaagcaattcagttaaaattctgcatatcatacaattttatagtttgctagtaggttacaagtaaatagtcacccaaataaaaacatcatgttttccactggttgttgctcttttttaggtgagtatttgatgtataccaacagagagaggataataacaaatcgctaatttctttcatcactatataaaggtggcttcaggatagaatagtatcagggcaatgatgaatttgaaatctaacatcaattcagtgatgcatcaagataaaagcagagacaacaggggcaccttggtgagtactgaacattttatttatttacttatttattttgagatggagttttgctctttttgcccaggctagagtgcaatggtgccaacctcgcctcactgcaacctctgcctcctgggttcaagcgattctcctgccttggcctcccgaatagctgggattacagacatgcgccaccacacccgtctaattttgtatttttagtagagacggggtttctccatgttggtcaggctggtctcgaactcccgacctagatatctgcctgccttggcctcccaaagtgctgggattacaggtgtgagccaccgcgcccagatgaattccaaatttaacaaagcagactaagagaaacaattcatttaaaaaaataatatttggccaggcatggtggctcacacctataatcccagcactttgggaggctgaggtgagtggatcaggaggtcagcagttcaagaccagcctagccaagatcatgaaaccccgtctctactaaaaatacaaaaatcagccaggcgtggtggctggtgcctgtaatcctagctgctcgggaggctgaggcagagaactgcttgaacccgggaggcggaggttgcagtgagccgagatcgtgccactgcactccagcctgggcgacagagtgaggctccgtctcaaaaaaaataaataaataattcaatgaaattcctaagatccagggctttgcaataaatatgtaaataaatttccaatctccatactgaaagtttaaaagaaatgctaactaataactaaagaaatacaacttttcctcagctttgcagcaatctagaaacaaagtgtgtagacactacaaagcaccttacaaggagaaacatgtaaggatggcatgactcgccggcagccctgggcttgtccacggtacccccatgatgaacagtaactccactgtgtaaacgcccatgaacataagattacaagacttttccagtttagacataccatattttctttcagacaattcttcagtttgtttacgtagatcagcgatacgatgattccatttctctgaaaaccaagcaaaagttgcttctcaataacacatccctatgtcagagcagcactaacgtataatgactgatgtcatatattttacattctaacagtccatatcattttactgctttcaagaaaaaatttccccttcttggtggttcttagaattggtttaatgggagactattagagaagctgaaaagcaggagggcagaaaagttcaatcaaattaaacacaataacagggaggtcacaatgaggcggtctccaggggtcttttagcaaacttcctaaaacatgtctcagctgtgtgaaaatagactttacagcagccgggtgcagtggtgcaggcctgtaatcccagcactttggcagcagaggcaggtggatcactttgagctcagggcaacatagccaaaacccccctccccagccccacccccaccccgtccctaccaaaaatacaaaacagcagggcatggtggcgggcgcctgtagtcccagctactcaggaggctgaggcaggagaatcacctgaacccaggaggcagacattgcagtgagccaagatcacaccactgccagcctggatgacagagcaagactccacctcaaaaaaaacaaaaacaaaaacacaaggttaagagggacccccgaccttacagatgcaagtttaagagggacccctaagcaaaaaatgccaaccctttttctcccaatcattgaaacaccaggagggtgtaacagttttgcagcctagctgtagcaggctgatgcccccaagatgcccatatcctaatcccgggaactggtgaacatgaccttatatggcaaaaggagctttgcagatataatgaagttaagggtctttggcttttggggttgatgtactcactcggatccttgtaagagcagagcaggtgatggagagggtgggaggtgtagtgacagaagcaggaaactccagtcattcgagacgggcagcacaggctgaggagtgcaggccacctctacggccaggaaacagattctcccgcagagcctcggaagctaccgaccctgctcccaccttgactcagtaggacttactgtagaattctggccttcagacctgtaagggaatacattttggttgttttaagtcactaagtgtgtggtaatttgttgcagcagccacaggaaactagtattgtagtgaagcctcaaaacccccctgaaggggctgggctcagtggctcatgcctgtaatcccagcactttgggaggccgagatgggtggatcacttgaggtcaggagttcgagaccagcccagccaacatggtgaaatgccatctatacaaaaaatacaaaaactagccgggcatggtggcacatgcctgtaatctcagctactcaggaggctgagacaggagaattgtttgaacccaggggggcggaggttgcagtgaactgagattccaccactgcactccagcctgggtgacagagcgacgctccacctcgaaaacaaaacaaaacaaaaaaaccccacctgaaggtttccagttctgccagcactctcccacccaacccccagaaacagacattccattgctgtgggccatggacaggcagaaggaagcacctcctcatggcagaggcctacccaggagaaacccaagggaaggcactgctgggctggcccctctctgccaaggccatattcttttttttttttttgaggccagtttcactctgtctcccagactggagtgcaggggcacagtctcggctcacttcgacctctgcctccccagttcaagtgattctcctgcctcagtctcctgagtagctgggatgacaggagtggagcatgcctagctaatctttgtatttctagtagagatgcggttttgccacgttgccagtccacctgtctcagccccgcaaagtgctggtattacaggagtgagccactgcacccagcatttgccaagacctttgatggcaggctttttccaggtgatcagtccttgtctggtctggctctgccccactctccttctcacctagttggaatccctagctacttttcagtagaggagagtgtgtaccccaatcccagcttggttcagatctgcatttaactcatggaacctggctgctccccaggtcctgaagaaaaaaacggtctctctgtgggtatgataaaggatgggcctgtccccaggaccctgtgagagggaagcccaatgtcccaccaggttggcagggctggggaagggaaagtgttatggcagccccaagaaaaaaaagaggcagcagagggagcaggacagcgctcacatggaactcatgccactgcctgaggggggggaggagtgcacgccagtgacgtcagggggcagagaggcgcagttccagggtggctttccccctcacttcctgccatgttactctgatcgcctccaggtgagcctgcccactttgtgcccaggggcctgtagaaaaccacagctccccatggttatggccccaggagtggggcagagcagggaggagtcctggacagaggagaggcaggggcaggagggagtgggcctcaaactccaggagggggcccttctcatgggtcctgctttctggcttctccttccttacccctgggctgatcacttggggaagaactgagacaaagtttctcgccctcaggcccaaagggtttaattactgggcccttagggaggtgtgagccccctgaaaggatgcaaggttttgttttgttttgttttttgagacagagtttcgctcctgtcgcccaggctggagtgcagtggcgtgatctcaccacactacaacctgcgcctcccaggttcaagtgattctcctgcctcagcctctggagtagctgggattacaggtggctgccaccacgcctggctaattttttgtatttttagtagagacagggtttcgccatgttgggcaggctggtcttgaactcctgacctcaggtgatccgactggctccgcctcccaaagttctgggatcacatgagccactgtgcttggccacgatgaaaggttttgtgtggagagcatgtacatgcctttctgggaaaacagtccacagcgcttattctcagcagacttcacggtgaaaaaaggttagaactcttgctacagagctgtggaagcagccaggtgaggggcctgccaagggcactctgggcactacctgggcactctcgagcccatcatcccctaggcaggctgcactgcttggtatttgcagagctgagggggtggggcatgtggggactgtgaaatcgccctgagatgacccacagtcctcagctgggaagtgagcgctgcatctcctgcagcgtcctccatccctagagccatggggccaggagaaccggcccttgcagcaagtgaaaagcctattattgattccctccctagccatgtagacagtgaaccaagacactcatatcaggtaaatgccttgttctctgttaccaaggtaaccagtaggcattcccagatacagcgaaggtcctcacaccaagatatgcacctggccacctgaggaaagagaaaggactatctgaggggatggggctgagctgggtgtggagtggtccttgtgggtcttggagagtgggagggggagcagcatgagccaggcctcgaggcagaaggacaaccaggagacagcctggaaaaagtgctggacccacaagggctctaggctggccagaggggaggtgggataggctgtaaagtcctgaggtctgaagattggccctggcaggaagaaaccaggtaaggtggggtgttacctacaccctcggggccagatgcaggccagagccagccaattaccaggcccttagggaggtgtgagccccttgaaacgatgcaaggttttttgtttttgttttggagacggagtttcgctcttgtcacacaggctggcacctttgcccagagcaggcaccaagacttctggctctgggtgtgacctcagtctgggtaaaagccccagcccccaccagcaccacctatcccctagactacttcaggtgctgagcccaagccaggggcaggaagctaaactgatacctagggtaatcccaacaaagtccctggttccccgcagctatggggctgacggggaattacagcccaaaccccagatgctggctctcaaactaacactgagccctcagtgcccacagggagatacaatcagcgcactttccagatggggaaatgggatcagagaagtgcaacagccttgcccaatgccccagaccagggctccaggcccagagtgttcttttgtcactgtgttcagagggcagcagctgctgtgatgtacccacctgagcctggcagctttctccaactttggaagcccaggagcatggcccctgtccacagatgcacctggcatgaggcgtgcccagagggacagaggcagatgagttgcgtctcctccactggattgtgagggcctagaaggagacaagggtctgcttgagaaggcagtgaacagcgagcagcctgaggcagtgcccctctggatggatgcgcagtgcctggatggaacctggctcagacagagctcagttctgcaggtccctgaggcatggagagttcacagctaccaagtgtaggagtctggattcaaagccaacggcgtgactccaaagtccctgccctagcccctggaccacccttgcaggcccatcagatgcccaggccagcagcacagccggccaagaccagggaaacttggggagcctcagagcacccccaggtattccaacctaaccctggtgccccgcctctcaccacccttcttcctgcttttacctcaacccctacacaaagcctgggccacttaatgtggcatcaaacagacgcctcaataaatcagtctaatctcgaaaaaaaaaaggcttaacagatatacaattgcacgttagaatgctaaagaccataaacatataacaacttaaagtacatataaattcaatatatatccaatcattgtaactatgacacagtagaatattaaaatactattttcaaaatgtatacaagcttaatgttctatgtattcaaactgtttattcaaaatacaaatcatcaacataaattgccactaatattcagtcccttcacaggacatgattcactgggagttaataaattagcagccggcaggcagtgacacaccgcaaaaatgaaaaccaagaggtgaaatagttctgaaataaaggttttaaagctaacagaaatcactgaattactaagtcattagcactaattttgagccaactaactaattaatatgagatgatacaatgtcctatactttggtaaatacagactatgtttaaacaatgtctgtaacgtgacttgtaaaatgctcctggctttacaaagatgtgattaagatgtagtaacacatgctaaaccatttccccctgcagagcatgtggtaactttcatcagtcacattgagagtccagaagataaaggaaaaggtcatggatttcgctgagaacttaccagagttgaactccctcattttccgttccccagcattggcgggttctgggactggtggctgtggtggctcgttggtctttgtctcttagaaggtggggaataatcatcatcttgaaaaagaaaaaatggtcattactgaaggaaccatcttaggttacagccacctctgggtcaattcccaacattcaaaagctgagcagggctttaaagctatcttattaataattatttctgtattgcgaacttcagcatacttttttctagttacatttgaaatgttattcttttgggatgtgctcaagtgagtactgctttttcctctgccttgcttcattactttttagtttccttcatttgaatcatcattgtaagtctccccttctcctcaaataactttcaaattgctgccaagaactatgttctatcttaaggcttttgagaaaaaactttcaatgaagatagccgcctaaagttatacaaatatagaagaaacgggataaaataaagcttagattggaaaaaatatttaagattctacaaaattcacgcgtaaacaagggaagctgagtaattgtatgttcaaatacttgcaaaacatgtaggcttaaagaaatagagctggccaggcatggtggttcacgcctataattccaacagtttgggaggccgaggcaggcagataacttgaggtcaggaattcaagaccagcctggccaacagagtgaaaccctctctctactaaaaatacaaaaattaggccaggagtgatggctcatgcctgtgatcccagcactttgagaggccgaggtgggtagatcacctgaggtcaggagtttgagaccagcctaaccaacatagggaaaccccgtctctactaaaactacaacattagccaggtgtggtggcacatgcctgtaatcccagctactcgggaggctgaggcaggagaatcccttgaacccaaaaggcaaagattgtggtgagccgagattgtgccattgcactccagcctgggcaaaaacagcgaaactccgtctcaaaaaaaaaaaaaaagaaaaaattagccaggcgtgaagttgcggtgagctgagactgcaccattgcactccagcctgggtagcagagcaagaccctgtctcaaaaaaaaaaaaaaaagagagagagagagaaagaaagaaagagggctacattatttatgaaacaggtactgttaactcagtcaccagaaagcctgtgtataaatgagcagtgagatattcaagcacagcacacacacacttctcaggacagctgtcgtgagtgttccatgctcatttccttctggatacatcagcaactcactctgctatgatcctgcaatacatctcatgttagaattagagacatctgggccaggcacagtggctgacgcctgtaatcctaacactttgggaagccgaggcaggcagatcacctaaggtcaggagttcgagaccagcctggccaacatggtgaaatgctgtctctaccaaaaatacaaaaaattagctgggcatggtggcgcgcgcctgtaatcccagctactcgggagcctgaggcaggagaatcgcttgaacccgggaggtggaggttgcagtgagccgagatcttgccactgcactccagcatgggggacggagcaaggctctgtcaaaaaaaaaaaaaaaaaaaacagaaaaagaaaaagaaaaaagaattagagacatctggatcaaatcagctgccagtctcgcaaagtgtcgggtaacatcctattaagcttgctgcttacacatcatctataaaatactgaaaatatcattttaagaaatcttttttttattttgagacagagttttgctcattgcccaggctggagtgcaatggtgcgatctcagctcactgcaatctctgccccctgggttcaagcaattctccttcctcagcctcctgagtagctgggattacaggcatgcaccaccacgcctggctaattttgtattttcagttgagacagggtttctccatattggtcaggctggtctcgaactcctgacctcaggtgatccactgaccttggcctcccaaagtgctgggattacaggtgtgagccaccatgcctagccaagaaacccttattttaaaacaagccaggcgcggtggctcatgcctataatcccagcactttgggaagccaaagcgggtggatcacttgacgtcagtagtttgagaccagcctgggcaacatgttgtaaccccatctctactaaaaatatattttaaaaattagctgggcatggtggtgggcacctgtaatcccagcttctcaggaggctgaggcaggagaaccacttgaacctgggaggtggaggttgcagtgagcggagatcacgccactgcactctagcctgggtgacaatagaaagactccatctcaaaaacaaaacaaaacaaaacaaaacaaaaaaccactaaaaaaaagactccatttcaaaaacaaaactaaaaccaaaaacacaacacaaatgtagtacacaaatgaaaataattactgtgttaaacacagtttcatagaaaataaaagaccaatcaaatacaataagctgcctttttagatgggtatgttattcttctttcacagctaaagaaacaggctcagagaatgttatttgattggaccgtgttgcatttctggacagtgcagctgagatcagactttgtgtgtaactccactagcctaccagggtgcctctcataaagctaagaaatgtaaatttggcctaatatacaaagttgccagggcagcactgggtcaattctacatacagtacttctatgttcatcaagggaaaccttaagggaaagtgaaaatgcttctagaaggcgactggacaccagcgcctttgcttgttgcctttgggctcttcttctaaggccaacagtgacctgaaattattgactggcttttcaatcaagtggacaaaatggtaccaaggtcggcaacatcagacaaatttacttgagggccttatctatgcgctttgaaagacaaaactgcttttgtaaaggacactgtatttcagaaaaacataatcatattaacaaataataacactgtaaaatgctgatgtgttgaatgctactttagaaaaacatgctcaaatctagggaaaaaatttgatacaaaactacgtatcaattatctagctagctatctatctagagacatgctttcattctattgctcaggatgggaagcagtgggattatcatagctcactgcagccttgagctcctggcctcaagtgatcctcctgcctcagtctcctaactagctagggccacaggtggacacagttatgcctgggtttttgtttgtttgttttgtagagacagggtgtcactacattgcccaggctggtgtcaaactttggagtctcgctgtgtcgcccaggctggggtgcagtggtgtgatcttggcccagtgcaacctctgcctcccgggttcaagtaattctcctttatcagcctcccaggtagctgggactacaggcatgcgccaccacggccagctaatttttgtattttttgtagagactgggtttcaccatggccaggctggtctccaactcctgacctcaggtgatccacccgcctcggcctcccaaagtgttgggattacaggtgtcagccactgagcctggcggagcactttatgttattaagtagcctaacccaggtgggtcgctgtccctcacgcctgtaatcccgacaactctgatggccaaggtgagaagattgcttcaactcaggagttcgaaactggcccgggcaacatagcgaggcaccccccgaccccatctctagaaaaaaatacaaaaattaggccaggtgtccaccgcgcccggctaatttttgtatcttttgtagagacggggtttcgtcatgttgcccaggctggtctcgaactcctgagcccaagccatccatcctcccgcctcggcctcccaaagtgctgggattacagtagggcccagccagcctcatgttttatttagcagtccctccctgttgcacacctggatagttttttaaatttttttagacagggtttacctcaatctcgcaggctggaatgctgtggtgggatcatagctcactggagccttgaacctttgggttcaagtagctggggggctgaggtaggactacagagatggggttgcgccatgttgctaggctgctcttggcctgaagggtcctcccgcctcggccgcgccagacatagttttctatttttgaccaacataaacactgtgctgggtctgaatttttcagctacccttcttcagccggcaacacacagaacctggcggggaggtcactcttaccagtccccactctgatgagaaaactgcccagctccaggcaccatggcgccccagtgatgtagccgaacacccgcgcctctaacgtcgccaacggcccacctctatggtgtcggcgaagacccgcccttgtgacgtcacggaaggcgcacccttgtgacgtcacaggggactaccactcacgcagagccaatcagaactcgcggtgggggctgctggttcttccaggagcgcgcatgagcggacgctgcctactggtggccgggcgggatgtaaccggctgctgagctggcagttctgtgtcgctaggcttctgcccggccgccgccgcacataagccacgaggaggagctttacgacttcccggtcttcggcgccgggcgcagcaagggccagactctgcgctagcaggcgctgcgcgccaaccggccggcacctgtcgcagaaggtgcaaccgatcgcactgtcgcgcagaagctcctcaatggccagcgccagctgcagccccggccgcccactcgcctcatctgagcctgggtacgtgcgctccacaacgcctcccccagccagggcccggggatccccgggagcgtccccggctacctggcgccgctcatcctgggtagggtcggccccctgaggctgcccggcatgagggagttgcacccctgagcttgacctctgacggtcctttgtaatagcattaagtctttgaaacttgtagcggggtagaaggggctaggaaatgaagaaaacatctttttaaaaatataagcagtcggctgggcgaggtggcccacacctgtaatcccagcactttgggaggtcgaggcgggtggatcacgaggacaggagttcaagaccagcctggccagcatggtttcactgaaaccccgtctctactaaaaacacaaaaattagtcgggcgtggtggcaggtgcctgtaatcccagctactcgggaggctgaggcagagaattgtttgaacccgggatgcggaggttgcagtgagcggagatcgcgccactgcactccagcctgggcaacagaccaagactccgtctaaacaaacaaatatatgtgtgtatatatatgcgatcgagcccgggaggttgagattacagtgagctgagattatataagcgatcgagcactggaggttgatgttacaatgcgctgagattgcgccattgcactccagcctgtgtaacagagggagactctgtctctaaaaaattatatgcaagtgagagcttttcttccagcactcatgctcagactgaagaaagtaattgggccaggcccggtggctcacgcctttaatcccagcattttgggaggcggaggcggaagtgggtggatcacttgagctcaggaattccagactagtttgggcaacatggtggaaccctttctctacaaaaatacaaaaaattagctggacatggtggcacgcgcttgtagtctccgcaacttgccgggcttaggcgggagaatcgctcagctgcagcctcgacctccaggggcaatccatttcagcctcccaaagtgctgagattacaggaatgagccatcgtgcctggctttacactatattttaacactttttttgaaaatggaaacttttacaggcaattcacttccttcaaactaatgataaggaagtgatgctgttctgttctgttttgttttttgtttttgtgggttttttttcttttttgagatggggtcttgcccaggttggagtgaggtggtgcaaacaaggctcactgcagccttgaccttcgggctcaaggaatccttccccgtcagcctccccggtagctaggactacaggtgcatgctaccacgcttggctaattctttttttgaaatggagtctcactctgtctcccaggctggagtgcagtggtgcaatctcggctcactgcaggctggtctcaacctctgacttcggatggtccacccacttctgcatcccaaagtgctgggattacaagtgtgacccaccgcgcctggcgattttgctcattttagatactagaactttttaatttaaaatttttttttcctgagatggagtcttactttgtctccaggctggagtgtagtcgcgtaatctcggctcactgcaacctccacctcctgagttcaagcgattctcctgcctcagcctgccagagttgctgggactacaggtgtgcaccaccacacccaggagttcaaggctgcagtgagccatgatcgtaccactgcactccagcctgggcaacacagcgagaccctgactccacaaataaataaatcaacgtcatatgatctgtaccagggtataggcaggtgctatgatccccacttttcatcctcaactctaagttgagtcatacatcaacctctagtaaaaagtggcatgctctcagtcaaaggggtaagcccaaaccacgtggagagaatcttatctcttttgagagctaatataaaaagaattcctcctaggcataaaaatattatgacaccagttacttaggctaaacatgcctattatgctaagtgagttattaacaataaatactttaactctgtgccatgttaattatcataatctgatttataatttgttttaaccttaggttatatataccttgaagccatttatattttggtatacttgtaataattactatacactggactatgtatattggactaaacacggagagtcaaaaaagagtatgtggtcagagtagaaatcatgccctagcttccttcgtgtctacctcctaccttgagtagaagtggtagaaaaagtaattacctaagattttttggattctggtttgtggagaagcacccttatatttaggctgatgggcggcaaaattagaaagtattttttgtgatttagaattttatacagagatgttcattgtgattaattattctttgtattagcagatttttgctttttatagctgcatgatttcttgtttattattcattcattattgtctattaataaagaaaaactttatttcactgaagcagtgatatataatccaacttggatttttaaataatgactgactttttttctttgggaatacattactgttaaaaatgtaattattagatacattacttttaatgaatataagtggtataattagaaggctgaaaagaatccttggaaacgtgagtttaatttgatagctaagaaactgaggacaagatacttattctttgtagcatattttctaatgtcatttcattgtctcaccaagaaatacttgcataaagcaagttcaattacagtatctgttgaatatttaaggttgagtaaagtgggtgagtttaacagatattttcccttatttcttttaggcaaatctggattgggaaagttgacattaatcaactcattattcctcacagatttgtattctccagagtatccaggtccttctcagagaattaaaaagcctgtacaggtctagatattggtatttttaattgatgataagctggaataatattaatacacacaaagcacgtgttgtaactttcattatgcttccttagaggtaagatgcaaatttgcccttagccagtgtaagatggtaaatatgacttcataaaatcaaaaaaacagaagaagtacagttaatcgaaagattatcttgactagaactttccaaatttgtcctaaggattctcctagagatgacactgtgacatagtaaccaattcccctggagttgtgctatgtagtatgatagtcatttgccacatgtttaaatcaattaaaattaattaaattaaaatgcaatttctcatttgctccagatacatttcaagtgctcaacagccacatgtggcaagtggctgccattttgtgcagcacatatatgaagattttcatcattgtagaaaattgcattggacagtgtagagaaaacatgattcatagaaaaactattgttatttaaatacagtgttctatattagtcagtgggataataccatatcatagttgaatggcaatagcaattctgtaagactcccaagctatatgtgatctaatttactgcttctcagtctttgctatgcattccaatcctgggtatcctgttaaatttatttcttctagtagttctgagatgggctgcctttctacatttctaacaagatcccaggtgatgctgatgctgctggatggtagatcacactttataaagcaaggggctagactctagatatgcactttttattaaatagtacagcagcctgtagccacatgtggctattaatctttgaaatgtgggtagtctgaattgtgatgttctgcaaacataaaatatgccacagatttctaagactgagcatggaaaagaaaatctccataattttttatattgattgtatactgcagtgataatattttggatgtatcaggttaaataaaattgactgatttcacctttttcctattttaaaagtggctactaagaaaattttaaattacttacatgaccgacatggtatttttatttggcagcgctgctctaagctgttgatgaaaaatattgttggtgagctctgcttaggtaatatataggacatgagcagagaggaggcacgtgaacagttctggcctggagtaggcttcattgaggctgtgatgcttttagctggatttgaagaagtggtagtgatcatcccagtgcacaggataggtggacagtctatgtattctgagcagtaactcatatatctcatactgcaagaccccaaaggagtaattttgtgaagtaaatatcttatttctcctttttaatgtttctattttaggaattttttttttttttagtaaccttcatagggcttgagatttaaaattacctgcaaaattctactctaaaaacttgatcctacatgcttattttgtgataaatattggaaattttaaacctaagcaagaaaatgaactttgaactttcttaatttgggtatctattatgaataccttcacttaagtatttatgaatttagatatgaaaggtaaaactaaccactatccaaattaatatacagttcatttccagaaccctagtttcttccatgtgctcacttgcattcagtattacaacccccaaagataaacaccttactgactgccttctccataaatttgcctgttcttgaatgttatatacgtatacttttttgtatctgttttctttcagtgaagattatgtctgtattatttactcatgttgggtgtagttgtttttttcatcgtcgtataatactccattgtgtgaatgtatcagtatatcctttattatttatttaaactgacttaaatgttttttgacactttggttatatttaagaagttgacttctctaatttccttgtcatgtttatttttaaatatctttctctttaaaagttgggatactataataaatattcagcaagtattttgtgtttaaatataaaatcttgttatttggattttaatactttatatatagtatttatatatataaacataaacaaaactaaagactctatgaaagaatcaaatggattttctataactgaaaatttcaatgactaaaattaagatattaccagataggtttaacagcaaattccataaagttggtaagaaaacaagaatactcaaaaaatggaaagaagtagaaaataaaaacactgagaagcatagaatgcaaatttagaaaagagcttaagagacatatcagacatggtaaaaggtttaacacacatataatcaaactttcctagctctgttcacggaaagggcctgggagctgcaacacctcaacagcaacaagcacacctgctacctagaacttggtttctaaaaaccatcctcctctaaaaggaaacagagctctttgaagaaacggtaatttcaaagctagagcacagaaagtataagatgagcccagaatatctttttgtacaagaaagtaaggcaatgctcaaagaatgatggagacatgcccaaaaaaagcagagaagccaacttgaaaagattccaacaggccaaatatggggcgatttgaacatcagaataaaatggtgacagtcacagaattataacccagtgaagaaaggaattcatgacatcatattaatataaataataattgaatattgaaattcgttaaaggaaatgagatatttatgtagtcttaaggtatcttctcacaaattatgtattacttacaaaggggaaaagtgcaccttgacgtgagaatcttggcagaactactttaatcaagaggtttagttgagcattatcagtaacagagtaaatcaaaatcataagccacttgatagatacaatgagaaaataaagcatcacttctgtgacaccctataaaaaatgaatctaataatgaggaaacatgagaaaaaaccaaactgagggatattctacaaataaattgtcctgtaatcttcaaaaatttcaaggttataaaagtcaagaaaaacagacaatcttttccaaactcaagggaactaaagaggcatgaaatctaaatgcttaattctggatttcatctttttgatataaagaacagtattgagactattgataaaatttgagtggggtctgaagattcattggtagtagtaagctcaatttaatttcctcactttgatcattgtactctggtttttagaatgttctagtcaacaggtaatatgaattaaactaatcgagggtgacagggcattatatcagccacttatcaacaaacatttcagagaaaaatagttccttgtattgttattgcaattttctttgagattgccccctccgaaacagtaagaactttcaaaaacaaacaaagatatcaagccacagattcaaagtgctataaactccacgcatgattagttctcactcataggtgggaattgaacaatgagaacacatggacacaggaaggggaacatcacacaccagggcctgttgtggggtagggggaggggggagggataacattaggagatatacctaatgttaaataacgagttaatgggtgcagcacaccaacatggcacatgtatacatatgtaactaaactgcacattgtgcacatgtaccctaaaacttaaagtataataaaaaaaaatcatacctagatatatcacaataaaacttgacctcagagtttctagctctcaagaccaattcctcccatcctgccactaacagatttctccaaacatctctgcacctcagagtgcaaatacaatcaaacatttcactccattgataggaagcatccttcactatcttctaccaagggcttcctcctttggtgcttcaaaattttttatgaaaggaacatccattttattcaaagcacctccaaacctgcaatcctaagttccaggcaactcaatcccaaaaatccactgtagatgcccaaaggctggggtgttcggtcttcaacatttttgcctttgtggctcccagtcaagatagagctgcaccaagtccaattccattcctcatcacagatgattttttctactttaagatcagaactatacaagcttcttgctttgtgtcagcatgctgttgtacccatgggcaaattcttaggtaagacaaaaacacagtcccaagggcaggtagtaattttttcagaaaaaggtaaggcaatcatttatctcagtctgcccaggacagtcccaatttacacatgtatattctcccaatctgtaggctgtcttttcattttgttgattatttcacttaattttttattatttatttattttatagagacagatctcattatgttgcccagggtgatccttgatctcctggcctcaagtgatcctccaaccttggtctcccaaagtgctgggattacagatgtgaactaccacacccagtcaacgtgcagaaggttttcagtttgatgtagtctgatgtagtctcatgtatttatccttcttgttgttgcctgagcttttggtgtgatatccaaaaatatcattgccaagatcaatatcaagaaactttccccctatgtttcttacagaaattttatggtttcagatttttcatccattttgagtatatttgtgtgtatgatgtaagataagggtccagtctccccagtgttggatatccaattttcataacaccatttattgaagagattattctttctccactgtgttttcttgatgtccttgtcaaaaattagttgacttttatatgcttgggtttatttctgggctctattctgtttcattgctttacatctctgttttcatgccagtgccacagtgttttgattactatagctttgtaatataatttgaaatcagaatgtgtaatacctataactttgttttttgctctaaagatttatttatttatttatttttgccatttcaggtcttttgtggtttcatatgaatttcagaattgtttttcctatttctgtgaaaaatgccattgacattttgatagggattgtgttgaatctatatattgctttggatagtatggatgttttaacactattaattgtcccaatccatgaacatgaaatatctttccattcacttgtgtcttcttcaatttctttcatcaatgttttatagttttcattgtgcagatctttcacttacctggttaaatttattcctacaatttcattctttttgatactagggtaaattgaattattttcttgatttctataaattatttcttataatactcatacttgtcaggcctctgggcccaagcctgcatgtatacatccagatggcctgaaataactgaagaatcacaaaagaagtgaaaatggccagttcctgccttaactggtgacattaccttgtgaaattccttctcctggctcagaagctcccccgctgagcaccttgtgacccccgtccctgcccaccagagaacaaccccctttgactgtaattgtccactacccacccaaatcctataaaacagccccacccgtctcccttcactgactcctttttcagactcagcctgcctgcacccaggtgaaataaacagccttgttgctcacacaaagcctgttggtggactctcttcacacagatgcgcgagacaatactaacactaatattattttgattcgtcagatggaaaagtaaggcttgaagaggttagaaataacttttccaaggtcacagagctaattgccacaactataactcagctctagtatgtgaacaaagatttttttataccaaaccaaaattatttatttctactccactattctatcatggtgcattttaggtgctaatgggaaaatctgctctatgatggtgtccaatagacaattaaaattcaaatctggaaatgagatctggactgaagatttttttaaaaattagccctcatcacatgtagtcagctgtagaaatccttagcatggctgaaatttttcatattaagacaagactagaacttggccaggtgtggtggctcacacctgtaatcccagcactttgggaggctgaggtgggtgaatcacctgaggtctggagtttgagaccagctgaccaacatggtgaaacaccatctctactaaaaatacaaaaaattagccaggcgtggttgcacatgcctgtaatcctagctacttgggaagctgaggtaggagaattgcttgaacccaggaggtggaggttgcagcaagctgagatcgtgccattgcactgcagtctgggcaaaaaaagcaaaactctgaagaaagagagagagagggagagagggagagagaaaggaagagacgatgagagacagagagaaggagagagaaagtacaaaagaacgaatgaacgaacaaactagaaatcgagcaggaaccttggaggacctattgcttaaggtgtgggccaaagaaagtaagttagggcaagagactaaggtatgccagagacccaggacaaaacacagtgcagagtgatgtcacagagccaaatgggagtgcaagctatggcaagccctcccaagtatgtgtgggttaaatgtaattaaattcaaaatctctcaacccaaaaattttctccacaaaggaagtagagaaacaaaacagttcattattgaataagcattaaaccagaatgtgatgtgtgaatataatggaatggaatggaatggaatggaatggaatggaatggaatggaatggagtggagtggaatggacccgaatggaatggaacggaacggaatggaatggaacgcactcgaatggaatggaacggacatgaatggaatggaatggaacggacacgaatggaacggaacggaacggaatggacttgagtgggatggaatggaattgaatggactctaatggaatggacatgaatggaatggaatggactcaattggaatgcagttgaattgaaaggatccaaaaggaatgcaatggaatgcattggaatggaatgcaatggacttgaatgggatggaatggaatggaatggactctaatggaacggaatggaatggaaccgaatggaatggaatggacttgaatggaatagaatggaatggaatggactcgaaagaaatgaaatggaatggattcaaatggaatggaatggacacaaatggaaccaaatggaatggaatggactcgaatggaatacaatggaatttaatggaatggactctaatggaatggaatggactagaatggaatagaacggaataggctcgaatggtatggaatgcaatggaatggactcgaatggaatagaacagaatagactagaatggtatggaatgcaatgtaatggactcgaatggaacggaatggaatggacaagaattgaattgaatggactggaatggaatggaatggactccaatggaatgtggtgggatggattcaaatggaatggaatggaattgagtggatttgaattgaatggaatggaatggtatggaatggaatggaatggaatgaaatggactagaatggaatggaatggactcgaatggaatggaatggaatgtacttgaattgtatggaacggaattgaatggactcgaaaggaatggaatggaatggaatggaatggaatggaatggaatggactcgaatggaatggaatggaatgaactccaatggaatggaatggactcgaatagaatggaatggaatggaaaggactcgagtgggatggaatggagtggaatggactcgaatgggatggaatggaatggaatggactcgaatggaatggaaccgaaaggaatggaacggaacggaacggaacgcaatggaatcgacccgaatggaatggaatggaatggaatggaatggaatgcaatggaatcgaatgggatggaatgtattggaatggactcgaatggcatggacaggagtggacccgaatgaaatggaatggaatggaatggtctcgagtggaatgggatgggatgggatgggatgcgatgggatgggatgggatgggatgggatgggatgggatggatttgaatggaatagaatggaatggaatggaatggaatggaatggaatggaatagactcgaaaggattggaatggaatggactcgaatggaatggaatggacatgaatggaacggaatggaatggaatgaactcgaatggaatacaatggaatttaatggaatggactctaatggaatggacttgaatggaatagaatggaagagactcgaatggaatggaatacaatggaatttaatggaatggactctaatggaatggacttgaatggaatagaatggaagagactcgaatggaatggaatgcaatggaatggactcgaatggaatggaatggaattgactcagatggaatggaatggaatggactcgaaaggattggaatggaatacaatggaatggtctcgaatggaatggaatggaatggactcgaatggaatggactgcaatggaatggactcaaatggaatggaatggaactgactcgaatggaattgaatggaatggacccgaatggaatggaatggactgggctcaaatggaatggaatggaaaagaatggaatggaatagaatggactggaatgtaatgagtttggaatggacttgaatgcaatggaatggaatggaatggaatggaatggactcaaatggaatagcatggaatggaatggactcaaatgcattggaatggaatggactcgaatggaatggaatggactcgaatggaatggagttgaatggactcatatggaatggaatggcattgaatggactcgaatggaatagaattataacagaatggaatgaacccgaatggaatggaatggaatggaatggaatggaatggaatggaatggaatggaatgaaaggtgctcgaatagaatggaatggaatggaatagaatggactcaaatggaatggaatataatggaatgggaatgggaatgggaatggaagggatgggatgggatgggatgtaatggaatggaatgcaatggaatggacacctatggaatgcagttgaattgaatggacccgaaagcaatggaatggaatgcaatgtactcgaatggaatggactcgaatggaatggaatgaactcgaatggaatggaatggaatggactcgaatggaatggaatggaatgcacccaaatggaattaaatgtaatggaatggacttgaatgaaatggcaagaatggactcgaatggaatggaatggaatggaatcgaatggaatcgaatggaatgacatggaatggattcgaatggaaagacatggaatggactcgattggaatgggttgggatggaatgatctagaatgtaatggaatggaatggactcaaatggaatagaatggaatagaatggactcgaatataatggaatgaaattggctcgaatggaatggaatggacttgaatggaatggaatggaatcgaatggaatggaatggaatggaatggaatggaatggaatggaatggaatggaatggactcgaatggaatggaaaggaatggactcaaatggaatagaatttaatggaattacaaaccacagtgatataacacacatgcatgaagatttctaacatgccatcctaaattaagtcactgtatcagtcagagtccaagtataggaaacagtcactacccatgcaaacctgaagagaccttcatacaagggagctgaggcagccgcagcctgcagctctgtcttctagtcttgcaggcattcatttagttagtggaagcatatctcctcccagagcccaggctgcaagagtctgaaatggagcttttagctttccagcctctgtatcaaaagggcacaccagaaagaggctagaatgaatggttgggcactaacaaatattttcacaacctaagcccatactcgcagttgtttgctgaacagacaatcaataaatcaaacagcccttccatgtagaaattaagaaggaaacacaacaccaaaactcattattaaatagcattttgtatttgaaaactcattattaaatagcaaataaattgcactaaaatacaaaattgtagaatttgtattctgggaagccacagtaacaaatccctgtgacagaacccacgaagtagaggtctcctgtgggaatgatgaccgaggccctcgccgctgctccacctgcccctccagggatgccctgcttttccagttgcccctactctgatgtgcatcatggcaggaaaaagtgggctgctgctttcctttaatgctttttgtcccactttattttttacttttgcctagtatatcttttcattcttttattttcaacttttgtaaatctctgttttaggtgggcttcttacgtacaacttggagttgggtttcactttttgattcaatctgaaatcttttacttttaccaaccttcaggttatgtgtataaagttatgtgtttacatgtatagatacaatgtttggtcttacttttatgacatgtttttgtagctttttgaaaaagtttgtgttctctctgtagttcttctgaaatttagaaatgtttgcactattttgtactaggggttacttttggaattttaactctatgtaattccctctccttcggaatcctcatacaacacatcttagcctgttagtttcctgttccacactgtgataaaactgtcattcatcttgctccttcttccttccatccctctcctctacaacttgattttagtgaataacatcttactgcctccctgtgattataggtgagacagtcaacaaacctctaaccaccgaccttttctcctctgccctccactcacactctgctccatcaccctcagccacacagctgacgctgtagagattcactgacatccagtctgatggacactgtttctccagccgaaactgctcatgagaacagtgtgtattccctgagttctcacatgatcaatagtgtttgtttgcagactggatacaaaagatggtttgactggacataaaattcatgggccatcctttcttcctggaggatcccataagtaaggattactccactatctgaagaatttggagaaatttgaagccaccctgatcttttccctccgtaagagatgacatgtttgtttacccattgggaggttcttgcttcatcttcagagtttaataattcctgtaggatatggcacactcataacctgttctcagtcaaccttccccagcataaaatttgccctctcacaatgtacacttccatctatttttacctgagcagaattttcctgaacattatctttaaatatttgttctgtccttttgttttgttttcctgtttgaagattccaatgataaatatgctggaacccctctccctgttctcttcagctgtaattttctttctagttccttttaaactcatgattacggtttcattcttattaattctctcattcgtatttttccatcaccttttttgtgtttcccaaaacatctgtcttctcctgggcccttccaatcgcaccttcacctctgtggtggttctcctggctgctgccatcctttcttctgccaacttgactttgtctcctgctgtctcacttggttgtacaggttgagcatccctaattccaaaatccagaatcctccaaactccggaactttttgagcatggacatgatgccacaagtggaaaattccatacttgacctcatgtgatgggttgaacaaaattattaaaaatactgtataaaattaccttcaggttatatgtataaggtgtatgtgaaacatacatgaatttcgtgtttaagcttgtatcccaagttatctcattatgtatacgtaaatattccaaaatctgaaaaaatccaaaatctaaaacacttccagttctaagcatttgggataagggatactcaacctcattaaaatctcttttctgttttgtggcattcctgcactgggatcttctgccacagaactgcttcatgagtttcctgtttttttcatttatgatgaactgtctggtcatgattccatcctgcttcacagacacatttcccacaatttccttagagaatatccatgcagtgatggtcaccttctctaacaggcatttcagagtgaggtgggacgttctagggcacctgttttgcagatgccctcagggtgggggaagggcagcttccagccttcccagttccagcactctctcccccagccgctacctgcatgtgaatccctgggagaccccacagcccatgtctctgagtaaaactggatccaggaagccctttgctttcagtggtcctccctggaacttctgcactctgcaagctggagttgaacatctgcgactcagcctctcagtgcacagggtatgtggggctcgacttctagacctggccctgacgagtgcttttgttagcctgagcccttctgctcagttccgcctatactatcgctgcccaggcttagctgcttttggtaagcctcatgcacattttagagtctgtgaattgcatctgcctcttatttctctgaaaatggagtttttcatcccttccttccaattctccttccagcctttcttgatttccagaatgagaaatcattaagtcatatactgagccacaaataacattataaatgtgacaattacatgataatctttggggggaaaacattctgtgatttctaacatatttacataaaaatatcttacactaaaacacaccagttgagggcactggccagagataagattaggttaaggccaagcaaagctgagaagaccattgttaaaatttcaatcctgttcctttatcttttcaaattaactgaatattgttattaaatttcttgttttagtgtcgaatagcaccttttccctgcctcactttagaatcaatttagagacaaaggattcaggccaactgaggtcatcagcattatcgctaataatagctggactggcggatgcgattcagattcacacaacaatggatttcctaatctgaatcctagactgagatgaagccagccagccgtaagcattgcttaataaccaaagcctccccagataggcttcttgccctacagcactgaagacatgaaagaaacagaccaaaatgtacaaatatcttttattcctcaaaggaaaaagaagagttacacatgcctgtttctcaccaataagaggggtcagggcagagtgagtctgggagagagagttctaccaccacggttcccaaagcatcgtctaggggcctgttaggggagcccgaggtctaaactatttccacagtttcactaagataagattttccttttccatcctcacattcgttagtgtgcagtgaagtgctccagaggccccagcatgctacattacagaagactgaactcaggagagatgaggaataatcccctccatcacaccagacaccaggagggtgtgccaaggtgtgagacatacagtccttactctttttttgttttgttttgttttgtgagacggagtttcacttttgtcccccaggctggagtgcaatggcccgatctcggctcactgcaacctctgcttcctgggttcaagcgattctccagcctcagcttcccgagcagctggcattacaggtgcatgccaccatgcccggctaattttctgtatgcctggctaagttctgtatttttagtagagacaggtttcaccatgttggccgggctggtctcaaactcctgatctcaggtgatccacccacctcggcctcccaaagtgctgggattataggcgtgagccactgcacccagcccagtccttacttttaaataaatggagaaatattttaaaaattgttttaatttctaatgtggcaaacattaatagatataactcacatgaccaaaatctctttggggtcctcagtaattttaaaaagtgaaaaggacccctgagacaacatttgggtttggaactgctgctccactaggggaagagataccagaacagagaatatgtgttccctgggagataaggccttcccgactacctcccctcctatcatcgaaataagttttctacatttctttaatatcatgttttaaaattccttttaaaagactgaaatcatcagcagaaggcacgggattagcttagcacagtcagtttagactagttacccacaggggactacagaatggacatcacgaggcatacataagcatagaggtgagaagggccgtgttcacagttgacaagattacatttcaggttaaactggtaactaagataacagggaaaaagacaattaacaaagaaactgtaatcgtccataagcctaattagccataaagcaaagtctgttgggaatttaatgaacatttgttaaaaacacaaatattataggaagttttttatacagtcatgggtcgcttaacaagggggatacaatctgatccgagaaatgcattgctaggtaatttcctcattgtgtgaacatcacagagtgtattacacaacacctacacagctaggctacagacctatacaacatattaatgcactgaacagcaactgtaacataatggcaactatctgtgtatctaaatatatctaaacataggaaacgtacagtaaaaaaaggaaacaatcttatgtggccactacactacacgcggtcggtcattgaccaaaacatcgttatgtagtgcatgactgcatatctcctcaaatctgacaattctaaacaagtaaagatgtggaagaattagataaacagaaagaaagtacatccttcaaatagagaatctgtatttttttcacacatcaatagaatatttacaaaaatcaattataaagaaggccacaaaggaaaacttaatcatttcaaagaattagagatcttaaaggccaaactctctggtggtaatataataaaactagaattcaataaagttaaataaaatcacagctatttgaaattcgaagtccacttctgaacacccttggatctgggagcaaattggcactgcatgtgtgcctgggctcctgaagggcctcacatacatggggaagggcagagaaagagaaacaacaacatccactacctctatttttaaagtcagccttactacaaaatacagaaagtattcttcactgggcagaccaaatcaactttgctcaatcttcgcctttgggttcctttaggtttataatgaactgtaagcatttactgagtgattattataaaggcaccatttgaagtacctgatgcccttttaatgctgtaatgcccctgtgaagtaggtcttactattatccctgctctagagatgagaaaactgaggcagggagagatgaagaagctggccccaaggccacaccactgaggagggaggggccagacctggagagcagggggatcccacaatctgtgcttgtgccttcctgctctgctgcttcccagctagcgtgtgtgctggacacagccctcagtgatctcaactttgattatctaattttaaaaagacttctcaagtttattgtcttttacaaaaaagggatgtaatctagcaagccaaagcagaaccaagcagactttgtagttttcatcaattttctggacgctccagccactttcctcaggtcctttagcaatgtgtggactgcccgcccaccgctgccccgaggtagggaagcaccacactacaacctcatgcaggctggattaaaacatgccctccacttcaggcttaggaaccagcgcccctcctacagctcacaagttgctcaagcagtggtctgtgagaagtgattctatttttggggttgtcccttttctctgcttttcttgggaaccattttgactctgtcaaatgttcactgacttctagcactggcagaaagaacgtctgcttttttatctgaaactgaactgttacacaacttataattttattttggtaaaagcattcttagttgctgtgtttagtcatactctacaaattatcttgttggtaggataaatatggtgagaattaaagaaaaatgaagatggtagtggacatttgcagactattatcaataccggcatttcaaacttccaatataattcggatacttgcctggaggacaaactttttttggcatgccgtataatgaggagccttatattcccagtgtgctcaaactgccctgacaccacctatccaccgtcgtcagcaatctatgttcaatgtttcttaaaaacatcagttacaaggtcaaatttaattcaactgaggtcagactctcaggggagctgaggagcacttccttcaatggaaatggccatttctgagtggtgacaacactgtcatttcttggaccttctttaacaaatctgttctcaggagcattaacatactttgctaatacattttaatctggcatttttatgggggtaattataggaaatgcctggaattaaatagcctacaaccaattcttggatcaacaactaggaaaactgaaaaatatatatgtaaatatatctttttctgtgtaagaaaagtcctgctaacttaggaaattagaggatatctttgtgtagaatctttttataaagtggaaataggccaggcatggtggctaacgcctgcaatcccagcactttgggaggccgaggcagccagatcacctgaggtcaggagttcaagaccagcctgacccatatggcaaaaccccctctctactaaaaatacaaaaattagccaggtgtggtggcaggtgcctgaaatcccagctactcgggaagctgaggcaggagaatcacttgaacccggggggcggagattgcagtgggccaagattacaccactgcactccagcctgggcgacaaagcgactctgtctcagaaaaatacaaaataaaaaaataaagtggaaataacttcctctgcttctaactatgcagtttgcttggaaaaaaaaaaaaaagtaacctgtaggtgtagtacaactatcagcacaaatgtaattatcttagagtatcttaatagttcctacttcaagtagaacttatgaaggagtttaactgtggtaaaaaaaaaaataattggagtaacttagaaaacatttatatatacaatagttggtttgtatgctcagtcactcattcattttaggaataacaagtgcctactacttgccaggtgcttgggatatagcagggcctactgaataaattattatacaacagtaaattagcattggattgtgttgcttaaaacaacactcaccagagcaaacaaaagcctgattagcaatatgatctgaaattttaaaaacagcccttttcaacagttccatctaatttgccaggtcattattttataatgtcatatgggattgctgggtcaaatagtatttctggttctagatccttgaggaatcaccacactgtcttccacaatggttgaacttatactcccaccaacagtgtaaaagcattcctatttctccatgtcctctccagcatctgttgtttcctgactttttaatgatagccattctaactggtgtgagatgatatctcattgtggtttttatttgcatttctctaatgaccagagatgagctttttttcatgtttgttggctgcataaatttcttcttttgagaagtgtctgttcatatcctttacccactttttgatggggttgtttttttcttgtaaatttgtttaagttctttgtagattctggatgttagccctttgtcagatggatagattgcaaaaattttctcccattctgtaggttgcctcttcgctctgatgatagtttcttttgctatgcagaagctctttagtttaattagatcccatttgtcaattttggcttttgttgccattgctttcggtgttttagacatcaagtctttgcccgtgcctatgtcctgaatggtattgcctagcttttcttgtagggtttttatggttttaggtcttatgtttaagtctttaatccatcttgagttaatttttgtataaaggtgtaaggaagtggtccagtttcagttttttgcatatggctagccagttttcccaacaccatttattaaatagggaaccctttccccattgcttgtttttctcaggtttgtgaaagatcagatggttgtagatgtgtggcgttatttctgaggcctctgttctgttccattggtctatatatctgttttggtgccagtatcatgctgttttggttactgtagccttgtaatatagtctgaagtcaggtagtatgatgaaaagattataaatcattctactataaagacacacgcacacgtatgtttattgcagcactgttcacaatagcaaagacttggaaccaacccaaatgcccatcagtgatagactggataaagaaaatgtggcacatatacaccatggaatactatgcagtcataaaaaaggatgagttcatgtcctttgcaaggacgtggatgaagctggaaaccattattctcagcaaactaacacgagaacagaaaaccaaacaccacatgttcttattcataagtgggagccgaacaatgagaacacatgggcacagggaggggaacatcacacaccagggcctgtcggggggtggggggctaggggacggatagcattaggagaaatacctaatgtagatgacgggttgatgggtgcagcaaaccaccatggcatgtgtatacctatgtaacaaacctgcacattgagcatatgtataccagaacttaaaagtataatttaaaaaattttttaaaaagtcatatgatgcatttaagaaagtcacttaatttacatcagaggaaaatcaaagtttatagacttaggaaataaagtcgtaatgaagaagctcttcacggctgtcaggacagctacgtttttggtctctgtccttgattccattgtgaccttcagcccatctctctgggccccattttcttgtctttacctcttgggtcataaatggatctccatgcagctgatatccctctgcctaaatcctcctcaaaagaaaatcaaaatagtggctaacacagagtacagactgttccaagagcttcctatgatggaactaatctaatctttataacagtgctctgaggtagatgctaaaatctaccagatactatggatgagatgatgaagtcatatgcttgagatccctgagtaaataaataagaaagagacagaattccaacagcggccgtgtggctgcagagcctctctccctccctgcctcaccctcgagtccccgcctgggagggctcagggtcactcactaagcatctttcccatgcgctgctgtgaggctgctgctattaacttgctactatggagtagtcattagtagaaattatgaaaaaatttgaaaaaaaatcttcatatagccagagattctagcctgagatgtctttccttatttgcttattattatttgtaaaaacagggtctccctatgttgcccaggctggcctcaaactcctgggctcaagttatcctcctgcctcggcctcccaaaatgctgggattgcaggcatgagtgaccgcacctggccacctttccacatttaagagatccctgggatactgcgaagcaggagtccatctccagacatgaggagcaggtgggctaaaggaaacaggactggggagtcttggaggggcagagcaatgcccagggacacagaaacttttgaataaagacaagagagaccgactcttcgcctacatctaaagcaaatgaaaacataaaaataaatgatggcaagaaactaaactaaaaatacactacccctgaaagtatgtgacactggatgtactatctaattggtctgccacaggtagagaatgaagtacttcagataagttaatttatcaaataactaaaattagatatataaactttacgattctgaaaacttttttcctacagatgtgtgtactttaggaaacacagcatatttaacatttttataaatttcagttgcacaccgtgcagctttcaggaagctttcacaccgtgcactgccctgcatgcacctcccaagcctcgggctgttcatgcctggctgtcagaagtcacctcctggctgccagaggggcgagggggcaggctgttcttctcagtgctataagcaagcccaggactccaagggaatgataacaaatgtgtaaaaaccacagtcacattaacctataggctcaggacccagttctacttcctccagacagcttttgggtactggtctccctctctgtgtttacagccgtcctgggtttgctgggcacctccgagttcatggaagtgcagctcctcactgcagttgggacacactccactttgacaaagggggtgttattttcagcagtgggtgaacagcagtgaacaaaccaagcccctgctcctggggctcaactgggatggggacgcagacaacttaaacacgtgaccactggcgtacctaagggccagggaatgctgctgacatgatgggggtggcgaggccaaggtcccagccaggtaggcttgagttggtattgctacaaccttgtgatcactggcaaacaagatttcatggtgggagtgtgactagaactggatttcaaagtttcttgaaagcactagttagaaaagacaaggtacattgatctgcacacaggaggtgctcagcgacgccagcactgatgggctcctcctgccttgagtgaagagcatctgcccctggacagtgaacaaaaggtggggccattttatgcctccaacaagacatctggctcaaactcaacttcaaagattagagtaaaaacgaaacttccattccaaactacttatctttattttggcaactggaacaatctgtaattgaacactaaattctattactaacttttatcctaagactgtgtagtaattattgattagtctccgtttaaagttgctgtttagatggaaaaaatgattttacataaaacattagttgaaagatacaggctgggcatggtggctcacacctgtaatcccaacactttgggaggccgaggcaggtggatcacttgaggtcaggagttcaagaccagcctggccaaaatggcgaaaccccatctctactaaaaatacaaaaaagaattagccaggcatcgtggtgcatgcctgcaatcccagctactcaggaggctgaggtaggagaatcactggaacccaggaagcagagggtgcagtgagcagagatcgtgccactgcactccaccctgggcaacagagtgagactccatctaaaaaaaaaaaagatacacattaagtttttcacacaaattcttaagggcagatattactaaatgccattagaaaaaaaggaaaccttttatcaagcattttttaaaaatgcttctacatttcttatttataggtattctaataatactgcgtgacattacggacaacttagcctaaattatggaaaatcaaattatttagtagaactgcaagacaatcctctcagttgttgtagtaagtgttgctataaacatttaaaacagcaaaaaaataccaaatacctgcacagtatgtatgataaatgcatatgataaagtaaaaaaaaaaatagcacacactgaaagaaagccaacagaagagggcactgggcatgggccagggagggcaagaattgggatggggacatggaggagcccaatccaaggcaagacacaggttcaggctttaccacagtcacaaaggctgcttcttgtttttgtttttagcagaaggtaagcatgagcaaattactttttagaggtaactttgctgaacttgtgaagaatggtgtgcaaggtccagagcgactgcaggagagggaaggtgggattcccacagagcaggagcacagataagccaagcaaggccctgcttggaaggcagcaatcaacagagatgcacagacctgtgagggtgccgggacagccatgcaacaatgcagcccttttgcttcctgagctcaccagttccctcgctccacctctgagaggtggtttggagaaacacagcccttctcaagagggctgcaaggtaagtttagttggtacatgagtgcacagcacattttaatttttatagttatgcatttattttatatgtactagacaaacgaccgacagaaaatttaccatttcacaggtattagtgtttaggatgaggctaaagtaggtatttctgtttaaaaaagtaaatttgaagaaaagctacccagcaaattatagtagtatgtggtacacagacaaaaaaaaaattatgcagtcgtccaaatgactgaaactgataaaatgctggtcctggtctatggattccccctctgacaaagcacagaatactcgcaccttctccagagtcagtgaccaaagatgagagagcagggcacccagcacagaaaccaccaggagccaatgacttcctcctgtgctccatcctactctctcactcacaccaggaattaaatccttttatgtagacagatggtcaagaattgctactataaagcaactcagtatggtctgaactatcagagagctacatggagaaatagctactgctaaacagacctctctgctgatgtttttcccagctacttaagtcctgaaaatttccacaaggctgagtcaaatctgcgtttcatcatctataagaaaggtacctatcgagaacaccctgctggccagtgtgtaaatatctaaaggaggactcagaaaacaccggggaagtccagcctgcacgtggtggctgggcttcagtgaagcatgcagcacaacaggagttgtaagtagtagttacatcagcagccctggaaattctgctcagaaccaaactgaacaaataacattatctaaggcttacaattatttaactccctaaattttctgtcctcccagtagcactttcaaatgcctaaaagcaattaaaagaaacatttttccaatgtctcacagaaccattagaaacacaaaattaatagcttcataaactatagcttctattttatccataatagaatgaaggtgcataaaccacatagtaattaatctttggacaaaagcaaacaataaatggaatatatggctaagatcctttctttttgagtgtggcccaagataaaaatttcttccaaaagggtaacattaatgcaataaggcttttgtggaattctattttgtacgaaattcctgttttctattagctacttcttcctctgtgacacaagcctcattccttgtgaaaaacacgaagcagaaaacattcgtgaaatcatcaggtaaagatcccatgaccgttctatcactgacacagtatgtaggtacatggtacaacccccaagggaccaccttgtggcatcctcagcaaccacagagccacagggcagatgagtgtttgctcccactgaggctctgcaacctctgccaccaatactggagaaatcctccaacctcactgttttctcctgaacttgttcccttctgtttttcgattaatacacagcaaacaggcacaccttcaagctgccaaaagcatcttaaacgttgtacacttacaatcttcaaaatatagttgttcaaaagagtcatcaaagtagtttttgaaatagaacacttactttgaccacataattgaaccttcggatatcttgaattgcacttgagaagtctaaccgattaaaggcttctcccaaggtgcaatagccatgcctctggaagagcaacacagaatttaaaattagtcaattagccaaaaagaattggcagttaatgtcaattaattgtgcgattaaaaaaatttttggcaaaggacaatttgtttttattttgaagactgattttagatttagatgagagtatagtaaaattgtagcaatgctaataatttaagctgtttatgtatacctgagacaccattaactgacattttttacaacctgctgaagtaatgacaaagacaaatatttattaaatatcttgctggtttgttttgttggggacaaactggggtgtggacgatgttaaagctaagatcataaaaaaactggattcattctaggctacgcaactaaaaatacataaatcatctgattaactgcattgtaaggatgtaggtgttacaaatatctagttgaaacacaggatttctctgcaggggaggcatgcactgcccgagtttgaagtgtaacatgggatttctctccagagcagccatgcactgcccaggctggaagtatgctcaaccacaagggtcagggctgggagaggcgcttcggtagcaagaaggtgcctctgaaaaccagcattgggatggagagggctgaaggcaagtgctggatgtgaccacgggcagctttcaggctgggagcacggatgccaagaacccaaaacaccaaaaaaactggtgcttagacccacaggtccaagaaccgaaggaagaaaatgaaacaatttattttcagtactgtaaacactgctgctattctcttagatgtttttcttccatgatatacccttatcctgtattggtttgtatagattagcacattaggtttcagaagtcattttaaactccatcttcatcctccatatttgaaatatttaaaatctacagattttcaggtcaaagttgtagagataagtaagctagaaaacaataatagaaaacatgagacgattggtctcaaattccaaacaggtgacttgagatgtcctagagaaagcagctggagccatagcacctttgtctctaacagccgatacactcagaggctcatgtgcttctgtgcgccaaccccaatcgccctgacgggtgcacaactcaactaaatatactcatttaaaacatccaaatatgttgactgagtgcctgctatgtggaaaacattttcctgggaactctggggaaaggaaacactcattttgatatagattataatctgaaatccatcacagctgatattccacacgatggtgtagcagacactttccaaggtcaccacccatctcacaaaaggaaattaaatctgattcacagagcagaccacaaagagcatgtctggacctagaaccacagcatgtaacctcggaagcagtgagacaccagccagcatggacaagcagcaggcacttgctctataccaggtgagggtgtggagacatgacgtggtgcagggacaccagcacccagtcctagttctggtccctctcagccttgttaggtcctggttcctaagattccagggaacatccccacagcctcacaataagatcctcctttcctgcatatgctagcttggatgggatcctctgttctgtaatcagtatggcaacagagcagatgaaatatttaatggtctttcatgagcactaaattttgttttttacaaactaggttagattctgtcaaataatcgtctaatggtgtattcgagtgtatattaaggatctgattcattctatacccactaaccataaccaaacagattaagttttctttctcagaatctaatccttcagtttcttggaagctggactagtttcagagcatctacaaacatttctggaatatttaacttaccctgaaataacagacgatagacagtaattccctaaattattttccccagttgttgcaaaataaagcaaatgcagagtttctaggactataaaaggaactcaacttcccggatcctagtaaagaaacaggaaacagcttgaagctctctggtttgttttatggctcatgaaaaagctttagcccaacttggcaaaagaaaggcagggaaagagttcatatggctctgcacaaacccaacccaattactaatttcatgttagccactctttatgtggaatgagagggctcacagatgccctgccctccaaaacacgccacagggaggacacattcccatcagcatcaggggttcatgctaacacagagaaaatgcgtatgactgcaggagtccatgcttggtttaaatagccctgctgttgactcagatatgtacaggtaggcaggaaccacacactgtacacatataccacatgccaccacacaccatacatcccacagaccaatgtgtgcataaatacatgcacaaccatacatacacaccatacatacaacacacatacaccatacacacaacacacaccaatgtgtgcacaaatacacagccacataccacatgcacatgcaagcacacacaatggagaatcactgcctcaaaagctcctcatatgctattatctgtcagaatgtgaaccatagatctgatattgcaaaagaaatgtgttttatgcaactttattaatacatttatttaatgtgactccatattcaacagaaacaatccaagatactctcttatttataatagaatacttacttcttttgtgctttctttatggacatagatccatttttcatgataaaaacctagaataaaaattacctttgtttttaaaatctggcaaatcatttcaaaatgaagattttaaaggaatttaaataattggacatattaacaaaattatctgacttactatattgacaagaaatgcttttacttggttgaatgcaaacagaattgctttgtttcttaaatcagtttaagatatgaacaatgatttcagacagtaccaagtcctagtaacttagaagaaaattagtattattaatgactgaagccatatgaagacataaatgattataaaatgcaattacattactacattcctatgtaccctaataaaaagttctattcttctgttgctgtgtatagtactccatagaaacaaatttttcagataaatcttaaaagtttcaagaatcacactaactgtattctccatgtgaccctatcttcttcataaagtagtccccccgtattcacagtttcatcttctacagtttcaattacccacagtcagctttggtttgaaaacattaagtggaaaattccagaaataaaccattcataagttttaaattgtgtgccattctgggtggtgtcatgaaatctcacaccgtcctgctctgtcctgcctgggatgcaaatcctccctttgtcaagcgagtcctacactacccgccccttggtcactcagtagccgtcttggttatcggatcacctgttgagatatcacagtgcttgtgtttaaagaacccttattgcacttcataatagccccaaagtgcaagagcagtgatggtggccatcttgctataactgtttcattttattattattctcgttaatctcttactgcacctaatttataaattaaactttattataagtgtgtatatacagaaaaaaaaacatagtatccataaggtttggtagtatccacagtttcaggcatccactggaggtctatcccctgaggtaaggaagcctactatacattaacatgtgtcttggtaactcacagatatgctgcatgatagaacgctatgccctctcacagataggtcccacctccagccttcccctgctgccatctaacatcctaaactccagctctgaatgtctgtctcctgctctgaatcttcagtgacttcgaaactcaagtcaggacacctctcagtttggcctcactgctcaagattgagctgaattcatgaccataattcaagcattcagattcatgggctgttttgtgggttttgctatctcttattttgtttttgcacatcttacccactgaaacgttgggctgcaaaaagtttgatcactaaatatgtaggcaatgctggatactgggctgttatttacatatttgtatcaccttttatttcataagatagcattgtcagagtaatttagtatttcaacataatcaacaagtaaaataaaattaatgagaatgatcttactttgagtatttgtgtcatttctaaaatggtcctttttcctttttttggatgcatattcatgctcttcattattgactatttctccatcttcactatttaagatactgaaataaagacatattctattaaaatattttttcagggagatcttcatttggcttttcttttgtaaaaggatacaaatacttcaaagtgacagactgtgggcttgaaatcacaggggtaatgtctaatacatttttgtttcattttgagaaataagatgtatcctggttctttgagaatattgtaccagaaagtgctgaacatgttttagaatctctgaagggtcttgatatgcttatccaaggtagtttcaaacatcaaaatggcttattaaaacagagatttttttaaaaaacaactattaaaactccagaaaaaagatggtaagaacatgatgatacccaatactgaccaatgacttgatgtgtcccttaccccatgctgagtaaccactcaacatttctgtttactccctatatgtttaagggtttaactgaagttaattattactgcactgaacatgtttttattaagcaccaaccacatacactgttaacacatttaactggaaccaggtgaagtgacatgtatatttttactatttaaatacgtttaattaaaagctgttctttgtgaaacaagaaaatcaaatcataaggcaataactaaacaatgggaacaccttttactttttaaaaaaatgtcttccttacagaaaaaaaaaacctgtaaatagtaatccacatcctcaaaactaaagatgtgtaaaatttttattttccacacactgataacagattttcagtgtaaagtgaggaaggaagctctgtggagacaagctggttggtggaggcatgcaagagtggtgctcaaatccaaggaactaaaattgcttatttgccggtcatcgttctttgacaagaaaattgtatacaagcccctttccactcaccactattcacttttagtaaaaaacagctgactttgccaaatgagtcactttctcactgtcagaacagacttaaacagcagtgccaacagttgtaaatcatcaagacaagcaaagcacatttgaaaaacatacaaacaactgaactttttgtggcagacattataacagcaatttatggaaatgtgttgatttatggaaatgtgtttgtattttatatttagtcttacaccagtttgttatcattgattgaaatactgaatgtagaagctttagaatctaaaagggttttctaacgaaaattacaaacatatcaaaggaaaagcacaaatacaatgttctccagaaatagtgtcgcagaaataaagacagaatatggaaggagacaggattgctgactaatctcatatgtacagggagaacgacactccatgcagcttagctccaacatgtgagcgtgggacagaaaagcaaggtgaacctaaagacatcccatggacacactgagctggaaccaactctgcccataggtggtggggccaggttcagatgcttgcagtaaccgcatcctcctgtgaatctgggtctacatggctgtggctccctgggggctacccacactgtggattccacaggtggaggtgaccttcttgggcactgctgggacacttcctgggcctgcctgggcagtggtagggctcagagaacttcagcgttagggccttggggagtctatgtcagacttgaggaccaagcctgggctcacaaatgacaactaggctactatttttacaaagtattttaaatggggaaaaagccattattttttggttgtgggttttacactgtcaggtaaacaaaaatgtacaagtagagaagaaagatgaatgcttctgaaatttaaatttgacacattaaaatgttaataaaggagtatttaatttataaatctttctattctgcatgtgtcaactacatttcatagcaatcaactacatgtcatagcaaacatgttctctttttataaccttcaagacaaacatcacctactctgacttaaaaacaagggaacctgtccaacaacttgattaaaaaatgtcaaacaacttcaacagacacttctccaaagaagagacacagcagccaacaagcccatgaaaagatgctccacatcacgaattgttaggtaaatgcaaattaacactacaatgagatactacctcacgctcattatgaggctactggcaaattaaaaaaaaaaaaagaaagtttaacaagtattgacatggatgtggggaaactggatccttcgtgcaatgttggtggaaatggaggatggtatagctactataggaaacagtatggaggttcttcaaaaaattaaacacagaattaccatatgatccagcaattccacttctgggtatatattcaaaagaactgaaagcagagaatgaaagatacttgtatacccacattcatagcagtattacttgcaacagataaacatggaagcaacccacatgtccatcagtggatgaatagataagcaaaatgtggtgtacactatacacaatatggaatattattcagtctgaaaaaggaaatgctgacacatgctacaatagggctgaaacttgaggacgttacgctgagataagacagtcacaaaaggacacatactgtctgatttgacttatgtgaggtactcagaaaagtcaaatcatacagacagaaaacagaaagccagttaccaggtctgggggtgctggagaatgaaaagttagcgtttaatggggacagagtttcagtgtgggaagatgtaaaagttctagagaaggatggtggtaatggttgcacaataatgtgaatgtacttaacaccactgaactgtacatttaaaaatggttaggaaggcaattttatgttatgtgtattttgctgcaattaaagataaacagtgtgcaagagaggagaggaagtagcagcttgtcttgttcatgctgtctgaggtgcatgtcggagggatggggtgggggcgggaagtgttaaaaacaaagaatagaacgttatacaacacaagcggaaaacacagggcacaaacgcacttgtataaaacacagagtttccataaacttaaaacatgtctgaatgatggagctaacagcccttaactccccacacccaggctgcaccacagcatatgtcacccccttgcttgcaaatgtgcccaaaaggcaatgacattccaagtttcctctgacaagcccaaggacagggcatgagttttccaagttcctttccattcaagaaaaggaagagaagagaatagagaagaatcaacaaaacaactccaaatagaagtaaacgagagccaagaacggaactatttctcataattaaaccccaatttctataaattacaatcctcattctagtgatgacctataataagatttgcattttcctctgatggtatttcccttaagagatggataacaaggtcttaatcttcatctcccagaccactctagggttctaagcacaggctttacagaaatgtgctgttatgggccatcatcttcaaatcatttccacacaagtctaggaaaataagacaggctaggataagcctccagtttttaaaattgctaatcaagggcatcagttcttaactatattgctgtaagatatgtcacaaaacttttgttaccagtaagaaaaatgaccaacatttgtgaatgatttaatttttaataattattaaagtactacactacacataataaaaaataatacatactcataaactcaacttccctgagttgccagtaggaagcaaccctgccgagcccttgattttggatttctggcctccagaattgtgaggacatacatttctgtggttttaagccaccgagtttgtggttatggaatcccagaaaatgaataaaattatctatcttttcaagctacttcagtttgatattgattatgaaaggtacatatatgctatcaaacagaagagactttagggagaaaaaatctcgcataaatgcaacaagttgccatgactctaagtgccaaggtcatataacatgcagactgtgataatttcaccaaaaccaaaacaaagtggaacaaatcctcagacacagttgctgataattcccaccctggcctcctctgacatttcctttcgatcaatttggctgcacctcttctgtcaagcaggagctggacgacattttggtcagctcctccccagaagggagctacaatctctgctctaacaatccccagttgttgtcttaagtcacactgtgttcatcaatggctacctactaaacttagctttttatctgtacattttccaatcaggtcgtattattttctcctggtaggcaaatgtttacgtttatccattttcctgatataaagctacttcgtatcagtgtgttattagtctctaattataagaagataatccagaagagaaagtccagtcaattttatataagttaaaaaaaagatgtgaaacctattttcagaattaacatttccttcctaaacatctaacacgacacacttacggactcttaacacacccttattacatgaaggagcagcagagcagagggcggcaagagcaccaaggccaggtggagccacagccaatgtgggcccatctcactccgcagggagaagcaactgcactgtgcacagagtgcaatctggcagaagggaaacgccgtcttaaagagcttcagatgcagcaaccttgaggaagggctgtgccagaaagtccaccagatgaggccgcaaacctatcaaagggcatcagacactctgtgcacagggtacacaaaacaatgcctcccacattctgtgacttcctgcgcgtgccacttggaccaccacactccctacctgcaccatcttacctggacagactaaatctcagccacctcatgactaggatattaacatggcttccagttctataaattcctcccccttaagaatgcatgtctgtaaaatcagaaatgatgaaaactggactcgtgagtggctttgtagtagggattacaggtccagaatagaataggttcagtaacatatttaagatatttaagggaaaaaatataagccaaagatttaacatctaaatagtgactatcaagggtaaaagtcacacatattttttatgagtacacacaaacacaggaagtacggtgaccaggagctgagggatgacccactaaagaataagctccggaaaccaaaatgactagaggcagatgcaaaggtgagctgcaggtggtctgtatttatctgtggagctgctggcacatgacggtgataaaagtgcagcatgccatggttaccagcttggacaatgcagacaaagaacaaccaccagagaagtggtaggggcgggcagaagatgtgcaggggccaactgggactggggtgtccatcagctaactgcagtatcaggtactatggggagccaaccaaagaaactaagtgtttgctataaaggcattaggataaaagtggaaaaaaaagaggaagaaagccctcttaaataccaaaagggtaaaagcaaataaaatagaacaaggtggttccctgttatctgtgatgtaaaaaatggacttggctcacctattaaatggaaaacagtcttggattggctcacaaagcaaaatcaaacaccatactgcatataagatatacagctataaaaggctgggaaaatatatagagaatttataggactcagaaaaaaagtaactgtcacaggaaactttatagcattaaatacctatatcaatacaaatttaaataataaaaataaattatttaaacatataactgaaaaagccagaaaaagaataagtgaaccaaaagaaaggggtgaattattacaaataaaagcagatattattaagtagaaaaagaatagaactaagaagtaaatccaaaagctggctctcaagagaaaataatcaaccaaaacaaaccactaggtatctgattagaaaaaaaaaaaaataagaaagttacaagtgctaacagaagaaaatttaaacattgtaaaagataaggaaaagaaagagatagagagaaaaacgtgtagattaaaagagactttaaaaacatatcaaattttaagaataaaacaacactaaactatagtgtctagggatatacacttggtgataaaactataaagattagggaaatgattaccataagagtttgggaagtggttatttttggggagaggaagtaggttataatagaaatgggacatgtggtgggcgcttctgggatgattgataaagttctattccttgacctgggtgtggttacaaggatgtttcctttataaaaatgaagaaaaacattaaaaaatcattacaggcaactttataaaactctttgcagtaagttagaagtagatgaaacattttttaaaaatattaaatttaatgctattccaatacaaaatcaagtttttttcttagagctaaacaagttaattataaaatgcatttaagaacaagaagaaactatcctaaaattcatatggaatgaaaagagagcccaaatagccaaagcaatcctaagcaaaaagaacaaagccagaggcatcacactactcaacttcaaactatactatacagccccagtaaccaaaacagcttctgtactggtacaaaaacagactcatagaccaatgaacagaacagaaaactcagaaataaagccacacacctacaaccatccaatctttgacaaggccagcaaaagcagcagtggaaaaagaccatactattcaatatatggtgttggaataactggctagccacatacagaagactgaagccagacccctacctttcaccatatacaaaaattaactcaaaatatattaaagatttcaatgtaagacctcaaactgtaagatcctggaagataacctaggaaatactcttcttgacgttggccttggcaaagaatttttggctaagttcccaaaaacgattgcaacaaaacaaaattggcaagtagaatttaactaaatgaaagagcttctgcacagcaagagaaacgtttgacagagaatacagacaacctactgaatgagagaaactatttgcaaactatgcatctgacaaaggcctaatatccagaatctacagggaacttatgcaaaaaacgttcactttctgtctgtgttcacgtcaccaagagaatagaaaggaaaagggaagaatgcaaaagtcaaagacacgtcaccctccttgagacagccctccagtccaggccaaatctcagcctgcccttggtccgctgtggttgggcctgcacccaagccatgagcacacgcagcaattgtggcagcagaagcttcctctgggctcagactcaggctgatgctgcgtcaggacctgccgcggtctcggctgggcttcctgggactcggtggttgtgggctgattgtaaagcacggaatgactcttagaaactgggcgtcattctttgtggttttccaagcttggtctctgatgatactccaggtcttaggagacatgctgaatatttattatgcttacattcaagcaacattaacccttaaggttgatgtagctccccgtctttttttcccagaaggaggagcactgaaggaacacttttccagtatggattctttccagctccgagaagctggaggcacacggatccctcggccagctctcatctatggacgtgctgtagtcacaaggactgtgactaaggctcagtccctgaggactgccttggcatgggctgctttaggctgtaaacacccagttttatccactttatgtgaagaaagccaacaaggggcatggagtgagttccgcaggttttagcggctgcggcggctggtgctcagtggggatgatggcgggaaggcgcctccctctgtgggccccgaggtctgtgcgggaatcagctctgcagctgtgtccaggggcagccgtagaccacacacggcaggctcacagctctgttccatgagaactttatacacaaaagcagacgggctgggcttggcctctggatcataatctgctgacccctgggtaagaaattttaaatatttacttatttctgttcaacagaaggggtgatatactgaggagtgaataatgggaaagatctgattcggctgtatcaggaaggactggtgtaaattcaacttattaactgaattcacagtattcgtgttttatgcctttaggggttaaaaatgggtcacacacgagcagcatgcacttcactggcgtggcagggcacctcagtgtttacatgtgtggttcccatgcttaccagggctggaggcccctgtgagtagtgaagtgcatgtggagttctggatacttttcctggctttctctatttgtgtgagcttgtgcagttagaggtttgggctgaatttgggtagaaatgggtggctcacaggctgcaaaagttctgtggacactttttcccccagctgattaatgttgtaaatattagaatattgttacataaaagtctggatttttagtttctttcacattggaatagctgccaacattgggcctgcattcatctctctagggcaacgtcggctgcagctgagatggctgctccccggtggggtgtgtgctcggcctgcagtccccgccctccggactccattcgcctccactctcaggtttgcacctcgtcattgtcttctaattttgcatccctggactgcgtgacctacaaggctctcagcacaacaagactctatgattctgtctattggaacaaaaagccagtgaggcaagtgtatcatcctgttgatgaattcacagcattaactctgggagttggggacagtgtgtattcttcctccagacactctctgtttctcctggatggaaaggttctgctacttgtcccgtggtcaggcccagccaatggaacggaatggaagtgactctgccccttattggcagaaactttaaaagccgcacaacgttcctgcaccctcccctctgccatgagcctggcagtgctcaggatgggaaaattatctcacctgggcctgaggatacaggagctacccccagcctgcagtggaagagaagcatggacaagtgattaaactttgtgttttcaagccacagaggttttttgaagttgtttgctaccatgctttgtccctacaaacacagtcatggagaaggccagtggcagagcctgagccgttcgcgcatctgttcaccagtatccagaataacaatagatttttgaaacattcctgagaaaattctgggagttgcataccggccagtcttattctctaaagttgttccttctaaagggtgtgatgaccgaaaatttcagaaaagcaaaccaccgctgaaaggcaacgttatttctgttggcagaaggcggcctgagcaatctagattttccacggttcaccaactagtttttaaggaaatatggctgtgagaggaataaaacatgattcctacctttaaggaactcagagaagtgaattaaaggaagtcacagatcagacaaccaaccacacaaagtttctaagagcaaactgttcaggtcggcaagtcactcttatccactgttttgccttctaaggtttcagttactctcagtcagtcatggtccaaaaacattaaatgaaaaattccagaaataaacaatacacacgtgttaaatcatgtttcattctgagtagcttgatgaagtctcatgccgtcccactcagccccacctggggtgtgacacctccctctgtcgagcagatccaccctgtctatactacctgcttttccaggagatccaccctgtctagactacctgcgtggccagcagatccaccctatctacactacctgcttttccagcagatccaccctgtctacactacctgcctgtccagcagatcaacactgtctacactacctgcttttccagcagatccacactgtctacactacctgcttttccagcagatccaccccgtctacactacctgcctggccagcatatccaccctgtctacactacctgcttttccagtagatctgccctatctacaatacctgcttgtccagcagaaccaccctgtctatactacctgcctgtccagcagaaccaccctgtctatactacctgcctgtccagcagatccaccctgtctacactacctgcctggccagcagatccgccctgtctatactacctgccgctccagcagatccaccctgtctacactacctgcctgtccagcagacccgccctgtctacactacctgcctggtcagtatatccaccctatctacactacctgcctggccagcatatccgccctgtctacactacctcccagcccagcagatccgccctgtctacactacctgcctggccagtagatccacgctatctacactacctgcctggccagcagatccaccctgtcaacactacctgcttgtccagcaggtccacactgtctacactacctgcctgtccagcaggtgcaccctatctacactacctgactgtccagcagatccaccctgtctacactacctgcctgtccaaaagatccaccctgtctatattacctgcctatacagcagaactaccctgtctacactaccagcctccccagcagatccaccctgtctatactacctgcctggccagtagatgcatcctgtcttcactacctgcttgtccagcaggtccaccatgtctacactgcctgcctggccagcagatccaccctgtctacactacctgcttgtccagcaggtccaccctgtctacactacctgcctgcaaagcagatccaccctgtctacactacctggctggccagtagatccacgctatctacactaccttcctgtccagcagatccaacctgtctatactacctgcctgtcgagcagatccaccctgtctatactacctgcctgtccagcaggtccaccctgtctacactacctgcgtgcccagctgatccgccctgtctacactacctgcttgtcgagcagatctgccctgtctacactacctgcctgtccagcagatccaccctgtctatactccgtacctggccagcagatccacgctatctacactacctgcctgtccagcagatccacactgtctacactacttgcctgtccagcagatccactctgtctacactaactgcctgcccagcagatccaccctgtctatactacttgcctggccagtagatccacgctatctacattcccttcctgtccagcagagccaccctgtctatactacctgcctttcgagccaatccaccctgtctatactacctgcctatccagcaggtccacgctgtctacactacctgcttgcccagaagatccacactgtctacactacctgcctggccagtagatccacggtatctacactacctccctggccagcagattcacccagtctacactaactgcttgtccagcaggtccaccctgtctacactacgtgcctgccagcagatccaagctgtctacactacctgcctggccagtagatccatgctatctccactacctgcctatccaactgatccaccctctctttactaccttcctgtccggcagattgaccctctctactctacctgcctggccagcagatccacgctatctacactacctgacttaccagatccaccctgtctacactacatgcttgtccagcaggtccaccctgtctacactacctgcctctccagaagatccaccctgtctatactacctgcctatccagcatatctaccctgtctacactacctacctgcccagcagatccaccctgtcttcactacctacctagcgagcagatccaccctgtctactctacctgcttgtccagcaggtccaccctgtctacactacctgcctgtccagcaaatccactctgtctacactacctggctgtccagcagatccaccctgtctacactacctgcctatccagcagatccaccctgtctatactacctgcctgtctagcagatccaccctgtctatactacctgcccatccagcaggtccaccctgtctacactacctccctgccgagtagatccaccctgtctacactacctgcctggccagaagatccaccctgtctacactaccttccttgccagtaatgcacgctatctacactacctgcctggctagcagatccacgctgtctatactacctccctgtccagtagacccaccctgtctatactacctccctggccagcagatccaccctgtctatactacctgcctggccagcagatccaccctgtctatactacctgactggccagcagatccaccctgtctacactacctgcctgcccagaagatgcgccatgtctacactacctgcttgtccagcagatccaccctgtctacactagctgcctgtccagcatgtccaccctatctacactacctgcctgtccagcagatccaccctgtctatactacctgcctatccagcagatctaccctgtctacactacctgcctgctcagcagatccaccctgtctatactaactgcctggccagcagatccacgctatctacactacctgcctggcgagcagatccaccctgtctacactacctgcttgcccagcaggtccaccctatctacactacctgcctgcccagcagatccgccctgtctgtactacctgcctggccagcagatccaccctgtctacactacctgcctgcccagcagatccaccctgtccatactacctgcctggccagtagattcacgctatctactctacctgtatggccagcagatccactctgtctatactacctgcctgtcaagcaggtccaccctgtctacactacctacctggccagtagatccacactatctacactacctgcctgtccagcagatccaccctgtctatactacctaactgtcgagcagatgcaccctgtctatactacctgcctatcctgcaggtccaccttgtctacactacctgcctgcccagcagatccaccctgtctacactacctgcctgtccagcagacccgccctttctatactacctgcctggccagcacatccgccctgtctatactaccggcctgtccagcagatccactctgtctatactacctgcctgtccagcagatccatcctgtctacactacctgcctacccaacagatccaccctgtctacactacctgcctggccagtagatccatgctatctacactacctgcctggccggcagatccactctgtctacactgcctgcttgtccagcaggtccaccctgtctacactacctgcctgcccagcagatccaccctgtctacactacctgcctggccagtagatccacgctatctatactacctggctggccagcagatccaccctgtctatactacctgcctgtccagcagatccaccctgtctctaatacctgcctgtccagcaacattagtccttaaaaaaagcaaacacacaaaatcagtgtctatttacaacagccaaatattatgactacgatttgaaataaatttgtagacccatgtaaataaattttaaaactcaatgaggatataaaaatgacatgaataaagcctgaaaatcatattattagaatggaggacatagtgacataaaacctcagtgactgtagactcagggcaacctagacttaaaagtcccatgtggtcttttacatgtaaaaaatgagaattagtctaaaagtcaattttgtctaaattttgatttttggtgagtatacagtcaaaatagttgtgaaaagaaaaaaataaagttgtcaaatttcatgtaacctatgttatttggaaatttaaaataagttatataaatatttataacaatgttaaacaatttcataagtggactgaataaaacataatattttatcatatacaatagctcctgccttcctgaggaaaacataaaatcaaagggcgtgaaggaaggattttggtttcactgcagaaacataataagacaccgaagtgtgtgtttgtgtgtgcgtacatatatttaaactacagaatataaaatagcatctaatatacatcaaaaatgagtttcatagaaaaattcattttacatatatgtctataaaataataaaatttattcagcctcacaattactttgtgaactggaaataacaatgagttgtcattttatccaaatctaaaaaaaaacatacatacagtatcaagttctggttaaagtagtagatgtactttacgtggtacataagagtatctatacagtttgtgggctgcatcttgctagaatatattacattataaaatgcaccatttatttactctgcgatcaaacccccaacttgccccaagtggaggaaccctcagacatttgcagaggagtcagtgtgctagtaagcagcattctttacaaatctatgaacatcaaggtctccttggaacagatgctctgtgaacaatttataaaactccctcctgttagacacttaggttgattccatttttaaatcaattactgaataaaacacactccatcgtgtggatgaaatgctaccttaatttgtcaaagctatcattttctaaacttttctttttaattcaaatcattaataatttgtgaccagatcaatactgattcattgttttaagcttcaaatgcattatacagttgggcagaacacatttcctctcatcaatcttcttttccaggatttgtcaggtattcctgacattaattcactactaatatgcacagtttctctaatcatggtcaacaaagatctgacagtgcattgtccctaaacgatccatacttgcctcactgacaccatgtggcccacttcccatctataatctatgtctgggtgtgaagcccttcccatatgatcccccgaatggaacttcacaagttcgaattcactgggtcacagtgtgatagtgtgaagatgggaggacgttaagggaaggctatgggtgagttgggaaatgtgttaggcagggtcagagattaccacatcctaaaaacaacacttaaggagggagatgacaaaacaatcaatgaataacatgactttttccagtgaaagtgccatatctaatccttttccatttttgttctctgagcttctttcttagggaagatccttcttgagaagcccctgctgagtattaggaaaatgcatttcaggacctctcatcaacacatcctctttctttaccacaaccacatatatgggggcataactcaacatgtgtaaaagacaatcttctgcttttcactgaacctccaggaattcaggacaataaacgtctacatggagaccaacaggtgagtttttctgccccttctttcataacaccgttcttccctagtgaagtccacacacatccttacatggcagctgtgggtatatcaactggtctgaccccttttagtcacagagcctgaagtctctgctagtacctgctgagcacagggtcatgggtgagaatgggcaagtctttttctttctctggttcctgaacttcccaggctctctcacttctggatcctgaatacccaaaaaccaagcttccttcccagaaccaacacctcctcctcattagaaagatacctttgttctgtgcttactttataaagtcttgctctttccctatccactgccttgtgtcagtatgtgtgtgtcttggggccggtggaaaggtgaacagaagccagtagagagtaaccagcaccagcttcacaggaatggcatgaccttgatacgatagcggcagttttcccttaacatccctgccccctaaagacttcagatcatatgtcacactcttaagtaacagcgatttgtctttcacggttttaatcatattgattaaaagcatttgtcttctccagaacatcacattaagtcatcaaaaaatataaaccttaaaaagatgtaattattggaactgaaaaacataaaaggtgagctttggaaatatctttgagcaatttattcgttatgaacacatgtaatctgttggaacaaagttctaggacaatccaggtcatccttcaatatttgcagaaaacatcacaaagaaaacttgatacttatacttagttggaaactttatgccacagccattaaatacagagatcatacaaaggaatagaggaagctgttgaatactaaactaactcaaatcatcaatatccttacggagtgcacactgaattaatgtaaaaagcatttagtaaacaaaaagtattttcaatatacaattaagactgaaaagtattgaggcctcataagctgaacctgacacaataaatttaaaagggaaactaatttggaaatcagaaaaccactaaggaatttgggaattaggcttctgctgccctctctgctactgacggtcaaggcctcctcattgtattctgtcctccatatctctgctgattcccattttgtctatttccatttaccccactactgcttgctcaggtcactctccttcactgtcggtgtttgttcaaattcctcagacccatccacttcccatctaaacttccctccccttttctcgctcgttggctctacctccctcctctctgttttctcctcactctcctgccccacctcgacatccacagcgaggcaatgaagaagcccctgccaaggaggagcccgcttctcagtgggacaccgggaaggtagacacccaacagtcaccgctagtgggaggcgattgtgcagaagcacgagggttgttacaggatcgggcaggtcccctaccccagtctcggactcagggtcctgtctgaggcggccaccccgaagcgtggggtttgcggagacgtagggcctggcggagggaaggacggggaagcatctcagggaggactggcgtctgccgaatcccagggctgccctgaggggccaagaggggcgagggtggggacgatggaagacaagccacatgccgaatggggacctgaggccgcgcgcgataggatgggcggacggtgaagagaactagggtggaagggccggacaggggcgacctcagtgacggaaccggacacagacgcagatctggcagctgagcgacaggcttcggagcatttccgggcgtcgcgggactccccgccgacaggagggcggttgccgagcctgtgacatccgcggagaccagcagaccccgggtgtggaggacgccgcagggaggggactgcgtggctgggtttggccacaaaaagcggagggcactcacccgagcggaccttggctccggataatccgtttccgggtcaacaaaaaacgtcgcgcgaggggcggggcgcgtacgtgcagggaggggaggcagagaaaaaggcggggccgggccgggccggggcggggtctcgggcaggggcggggagcttaccgacctcccgcccccgctgcgcgcgtttctggccctgccagtgtctccgccggttgaaagcgcgtgtctgcgtcgggttctgttggagtgcgttcggtgcgccgtgggtccgcgctgcttccacccaacttcctgttaggtaagaggcgcgtgaggctcctgtgccgggggcggtgctgctcccgagtcggcgcgcggcggggacgcgagtccgtaggtgctggcgggagcgagagtcgggtggggaccctcgcgagcccgcactccgcctctgggtagcagcctcttcggccccacacggcgtgacgcgcgctcgggctccgcgttcgcgtcgaggcagaggcgtagtaggggtcgggcccagggctggaggggccgggaccgggcggggtgccgccctggacaccgcgccggcagctgttccgcgcgggttcatgtcattcctattttcaacctgtcctgctccgcacctgagatgatttataaattcggtacctttgggacaggcgtggatgacatcccataatttacttcgttattaatttctaaatgtaatacataccactctctaaaagtattttttaatttgaaatatatttgtatatatgtacatatatatttatttatttctgaattttgtctccagtacatataatgaggcttgtaaagtggatagtgttcaggacataggtggattttgcttttaagtagtaaagacttaattggtgacttactggggctatttgataaggatttttttttttaaatgaacattaaaaacagtgaaattgtatttccggatttcattagcttcatttatatcttaattggtgaaaactgtaagttaataactcatttttatttcctttggagattcttaagtttgtgctaccaatgattatttccaaaaaaaggcacacttctggttttcccagaactaatgctagcttctcaatcttttgagtttacttgatattaatgtttgacctcaaatcatgtcacatttttgaagaaaactttctcttagccagtggaacataaaccaccctggagttcatatagaggaggggttcaaatgcctctgatagtgtcgtgttaaaactcatggccaaacccaaggtcacatagctttctttccatgttttcctctagaatttgtatagttttgtcattataaaatgggtcttgtcctagaccccaagaacaggtttttggatttcacatgggaaagaccttttggcaagtcacagagtatagtgaagttaagatagtttattagcaactactcagctacatagcagggcgtcctcagaaagcaagaggaggaatgcacctgttgtaaacatataatttttttttgaaacagtttctctcctgtcacaatggcatgatctcggctcactgcgacctctgcttcctgggttcaaggattctcctgcctcagcctcccaagtagctgggattacaggtgcgtgccaatatacccggctaattttttgtatttttggtagagactgggcttcaccatgttggtcaggctggtctggaactcctggcctcaagtgatctgcctgcctcggcttcccaaagtgctgggataacaggcatgagccacccggcgcccgggcttaatgtttgtttatataggttattaagaatcagtttgtgacaggctattagtattgttacttctctttgttactgtcgattttaacatcaatttatgtgtgtactattacctttaaagtaaaacttatttttaaactaagaatgctgagtggtgtgctgtgtgggtgtactgtgctggtgttctatgcaggtgtattatgcatgtgtgctgtgaaagtgtattgtgggggtatattatgtaggtgtgccatgcaggtgtattgtacaggtgtgctgtataggggtggtatgcaggtatattgtgcaggtgtgctgtgtaggtgtattatatgggcatgcagtacaggtgtgcagcatctgagctccgtcttcaccttaatcccgaacactcttttcacctctcacctgcactgcagtgctgtttcctggatcacacttttttgtttgtttgtttaattcctccaggagaatgagtgtataggaaataaggatttctcttcacattttacttgactaacagtttctctggttatagaatatattttggatttaaagctctctctgaattttgaaaacactgtttcattttccgcttgcctcctatgttgttctagagaagctcaatcgcaatctcgtcccccatcctcaagcgatacacttcttttttctttattatcttgaagcattcagggtcttttcttcatttttggctttctgaaattgcaggacaatatgatgtaggttcgtttttatctctgtgctagctcttttcatttggaaacctgtgttgcgttctgaatgctgtggtctgaaagtgtaccttcaaattcatatgttcacacttaatggccaaggtgatagtattgagaggtggggcctgaaggacgtggctaagtcacaagggcagagccttcacagtgggatcagtgcccttaaggaagggctgagggcctgggtttgcctttttaccttttcacctcctgccgcgtgagggcccagccacaaggtaccatctgggaagcagagtcccaacccttgccagacactgagcccactggtgctttatcttggactcccagcctccagaactgtgagagataaatttctgttttttataaagtactcagtctcctgtattttgttggagcagtacaaatggagtaaaacactaagacattttctggaattctttgattgataattttttcttctcagtcttttatcttgtctcttccttgaacacattatttctggtgttgaacattccagaccacttctccaattttcttatacttttttctcctatttttcaccttttagatctctttttgttgttgatttactttctgtgaggtttaccaactttatctagtacaagttttatggaatttaaaaattgtttcagagtttaagttcccagatcctctttttttaactgttcatttttcatgacttccagttctttagtggtgacgtatcttttctctctgaagacagtatttacagttactggaattccttcctgctctccacctgtctttggtctgttttccttttcccgttttgatctctgtccttcatggtgcatcctcctgttgactcctgaccatctgttcacatggggctgctgtggggtgaccgggccacgcagtctcccttggcagctctcagctgtctgtatccgtcagcattttctcttggtctggtcaggttttcccagaggggacagtccgttctccagcctgggacagaggtcagggacacatgtgctccctccctgggttggctctttatatggtgagtggcaactggttttggacctctctcttgcaggctgggtctgtgggatgtaattagaaagcaactttatttctattcacttacatttattcattggaggaggagtttctctttcctagggtacacgtggacatgcctatgacttttctgctttgtcttatgtttaaaaatgtccttcagtcattgcaggtcacaagcaggctatcagctcagtaattaaaataattcggttcttcatagtgaatgtaattctaaattagattttaagttgtaactccctgcttcagcaatggtgatggggcctagaaaccagagcacctgagctccatcctacagggggccataccgggatctttccattttcagaggcttctctctgacagtgaagtgtgatgacagacttgggggcagggcaatggctagcttctgaaagccgctggcactttagtgataaatttaaattaagtgacgggtagtgaggtgtttgtcaaggaaagtgccgtccaaatgctaaatactgattatttctgcagcagtgactgcaatacctcactcaatctctgtctttcttgaagaagtcataaataaacacgatgaatctatgtagaagcggtaagtcagaaaaatctgtgtgtttcattacataaacaacggtttatcattaattgacaggcttggattgggagttgttaatgaaactgatgagatgttggacagatgagctccctcttatttcgaagagcttatctagggctgagtcatgggacctgatagcgtcttgtggtgctgtcttcttgtagatatatccgtgttttagaggatttagttttttaaaatttctcttagaatgtgaattttacaaaaaagcacttcccaaatggatgattatttgaaaaatgaattgtcagacaaaactgacacatcagttatggagaaaacccttcaagaactggctttaaatgtgttttagtgggagccacagtgtggagagaaacagaagagggaggagagggcgccccttgtttcttctctccacagccaggccttcgccacctttctcagtgtcttcaagaataaaatgcctccgttgttggttttagctgcttttctccctcggggtaggtaaagtggttccaaaacgacaagcatcctgtaaagtcggaagagctgtgtcaacattaagctgcgtgactttggctatgagggaaaaaaggctggtgagtgcagagaagacagagctgtggcagggctcctcccgccaagtcgccatggagaggggctgtgaggtgtccttaaacggcctggtctccagggtgactcaggaagggctgagagtggtcagctccctcacctgctaaacccgcagcgccccgctcagcacacaccctccactctccaaccttgcccaagtgctggtccgtcacggcaccaggacagggcatggagacttgggctgattcttttctctcccttcctccctcttttttttcttctctcactcctccttttcctttcctgctgtttcctgctctcctgtttctgtcctgcagtgtctggagctccagagaggctggccctggggtggggtccacatggacatgggcgtaagcaggtttgatggtcatgggcataggcaggttcgatggccagagttctttcagctcacagtaagttttgttttgttttgttttgttttgttttgttttgttttgttttagatggagtcttgctttgtcgcccaggctgtagtgcagtggcgtgatcttggctcactgcagcctccaccttagagcaatcctcttgcctcatcctcccgggtagttgggactacatgtgcatgccacatgcctggctaatttttgtatttttagtagagacacggtttcaccatgttggccaggctggtgtccaactcctgacctcaggtgatccatccgcctcagcctcccaaagtgccgggattacaggtatgagccactgcacctggcctcagctgacagtaggttttagagccagatatttacacactaacttgccagaaacatatatgactttattattctaattgattttaagagatattatgaactcaaatccaaagttacgtcccacctatcatgacaatttcattaaggaaaaagtcaaaccattttggaaatgatttaagtgagcaacttggaaaaattttctacattcctaacttactttccaggggatcgttcctgacttaacatctatcaggtgtcttagcttagctctctttttacttcaggtttttcttgcctcctcagtgtgctgggagtcccactccactcaaatgccctcaggtctaataattaacttcattgcaggctcctggcaggcctgggtgggcggcagctgcattgtgctcctgaagaagatttaagttgggtttggtgaactggtagaatttgcattttgctgtttctttccctctcccagaatttgtacctttaaataggttttttagtgtcattaagtatatcaaaaggaaacccagtggggcaaattggccgggctccatagaggtggccttgtctaagcctttcatcttatcgataaggaaagacaggaccagagaagtcgccgactgtccctggtcccactgcttggtttggggcaatttcctgaaaataatatccaagatgcaaagcatatggctctggtgagacatgtgtgaggagctgagaatgagacggctgagtgtcgggggcagatcacgaagggctgcgctcaccatcaggaggtctggacttcgctgtgaaagacacaggccctcatgtacgtccaggatgcggtgacagcgaggcttgcaggagacaggtccctgctgtgtgggggtgaagctggaggcaagatgatgcctggagctaagagatggtcacaggaaatccggcaagaattaacgaggactggacagtgacaggcaggccaaagagtgagaggaacttcactggcaagagccaacagggcttgttgatttaggagaggagacaaaggactgaggggtttgggggctggggcctgggagggtggagaagccactgtctgcattatgggatgcaggaggagaagcattcagttctccacacaatgagttccctgagaggtgtctcagtgggatcgtggtgcagttggaaatgttcatgagaaagatgagaagcggcaccagcagcaaacatccaggaacccagaaaccatcagcacaggtgcctgctgagtcccatagacccactaatggcccaccaggaccaaccaggaagcaagtgtggagctgggagtgagggagctgggtgtggagatcagggggaagactgtcatctaaagggcgagagtgggaaggatggagtcatctgtagctacagggaaccaccattagtcagtccttgtgatgaaggtgcaagatgttcctgcttccgcgcacgtcgctcctgggctgtgggcaagtttggaactgctgttgttccccagcatagtctcaagcgagtggaatgacggtttcctatagaagcacagttcctacaggaaagaaggcgtggttaagagcatgagggccaaggaaaaggaggggattagagatagccagcagtgagggagacggttccagacacgagccgagtgggcaaagcagggaattcaagagagagaggagcatatattacgcaaattttaaattttttggtagcaagcaacctagcaaaactagctgaatccaaaggggatttattggctcacatcataaaaatctagtgaaagattctagctgaagtcataactagatatacgagtttaaataattttgtcagaaactgtttctttgctgctcatccacctatccatccacccatctatccaaccctccctccctccatccacccatccacccacctacccactcacccgtgtctttatccattgatccacgtgcacatccatcctttcatctctactttcctccatccctctcccttgcctccctccccatccatctgcccatccctccatccacctcttcatctctcctttcctccctcccccatccctccaccccctgttcacccacccattcatccatccctgcatctttccgtccacttctctatcttcttgtctctgcttctctttgtattttgttctcactattctctatttcataaggcttcctgaaagcggcatccatttattccttgtagcaagatccctagagaaagactcataatttatctctcagtgttcataaactctcagggcaagttttatttggcctgacttggatcacctgccaatatctgaacggattgcacacccaggtaatggagtattttaatcactgcagaccccccaccctcacctgaccagtgccccacagcaggaccacgagcagggccaaggtgtctccaaggtgctgaggagctgagcgctcagccagcccacggccacgatggtgtgcctccgaagccacgcggcttacttcacagccaggatccgggatcaggctatgtcccatgcagcctgatgaagggtaaaaaagagcccaatgcagagtgctggggaagcatagagagagccggggcacctgacccagcctgggacggtcaagggtgactgccgtgcaggagttggcatctgagctgttccttaattagaaagcctggcacagaatgaagaatgcattcctcaaactgagtcagggtgcagggatccacatgaccgtgctcctcttatccttaggaagggacaagagacttctatcctttggcctgcagctgctgaaatgacccttgcaagtactgaatcatctttaatgaaaaaatacactaatatgctgcaaatttggagcttatcctttcagtccaatccatggggaaggtgtgaattaaagaccctgtgcgtgtgctggaggcatcgtggacttttgttcacgatttcctttccttttgatgcttcagttatggtggttgcagctctataagctgtgtgatatgggcaattcctctcaccttttgaccactatttttcttactaatgaaatgaatacatacaagaatacttgaagtttaaataatgaaacatctgatactcacaggcactacagtattggctgaattcttaagtgactataggacacctttaagcatgttctagggcaggataaccaaggacaccatctcacgtgccaggaaatgaggggcctgtgtccaataagtccctggctccatgtggctctgctgttgcccacttctcttggaccctggttgtggtcttcccttgccacggggcctttgctggtgatactccctctgcctggagtacctccataatgtccactgctggggccttgcccatattctctacatgtggcactgcagtgcccccccagccagctcccaggggccagtgcccccagttccttgtccaaggtctttgtcccgcagctaaaacccaatctgctgccaccggctccatccacaggcaaaagttcccgggaataaatgcgtcagggcacagccctcaggagaccttggttacggacatctatccatctcctcgccctctggggtgaatacatctcaggtgcactcttttgggtgtttctttttgcttttgttgtttgcattggctcccagagtctgacagtggcagaaggctccagctgcccacagtggtgactggttttaagcgtaccctttgttggccatcttcctctctcttggaaataaacagcctgcactccaatccttgtcacagggtcagctcctgagggatcttcttggccttgctaatgctggcttatccttcagaatttagcttccattttcacttcttcatgggagtcttcttgagtatagtctcctcgtcatgtctgccgcttcttcctgagtcagggaatatctcttaggccatatctattatagtcgtggtctgacttatatttgtggtcaatttttttttcttaatttttcgtagagacggggtctcactatgttgcccaggctggtctcaaactctaagtgatcctcctgcctcagcctcccaaactgctgggattacaggcttgagccaccaagcctggcctatgtttgtggtctctttgactaaaaatgatcttttcttctaacctgaaatctcctgagggatggaactttgtgtctctttggtttatcccagcatataaatagttacgcatttttgaattaacaaatgagcacaaatttgtatcaaattattatctaggacaagcagtggaaaaaaattctgtaaagggccgggtaactgttttaagctttaagggccatgcagtttctgttgcagttaccaactctgctgttgaagggtgaagacgtgggtaggtaatatataaaggaatgagcatgtctggatgttccaataaaattttattttcaaaaataagcagcagaggagagcttctggaatggtggtgtgaggagcttggcaggccctctatccagggaaataaccatttaacctccgaacattcatttttttaaaactagaaattatcctaaaggcatacagcaggtggataaatatttactcaaataaataatcaaatctcagtaagaacggtaaggatcagtggtatcagagccacaatccaccgctccccaccctcaaagcgcattgtgatgaaagctctgctccaggaaggtccagctaacaagatgctgtggtctgtcttcccggctcctggtctagggctgtggtttcaccccaggaaggcaggccaccagcatctctcatccctctcagtttgcactgcagaagcaccgttccaggaagttgcaactgagaggactagggctcccctgcttcagcctgtgcttgtcctcagagggtgggagccccatcccaggtgtggcagactgagcacatctgcctggattgccccacaccaagtcactcacagtgtggaggttccatgtctggaggggcaagctaggaagacaagaggctaccatgcccacccagctactggctcatgcagcaagggtgtcgctctggtggaactggatcacggtccccaggagcagaggagacctaagagcagagcatgtccctgaggtgacagactttacttggagaacagcatgcggaagttcaagcccaaggaagttggcaaaaatagtggagattttgttgatgaacaattaagagtgggtgaaatggtagactagatagaacttaaacagagggaacaaggaagagagattgttgagaagagctccggggtctgagcagacttgaaaagctggcaacactctgcccctgcaaaagagcctgatgttcactggatgagtctatggagcaatttgtgccccaggcatcataaaaaatgatagagcacttgcatttagtggatgttaacagctgtgtgtgacaccaaagagagacagaccagcagaagcttaacagagagcccagagaaaaccacagataccacaggtggtcggagagactgtgtgctagtccaaggctgtgccctctgaggagcaatatcagagctacgtccctaatcaaataaacaagcaatcaaacagaaatagcagcccctgcgggtcggggtcagaatccagatttgctatgatatattacctaaaatgccagtttccacaaaaatgcaagaaaacaggaaagtgagacccatgctcaggaaaacagaaggcaacagaaactatgacaaattccagacatcggattaacagacaaagacagccagtgtcaaaacagccacagaaacatattcaagttactaaaggagaccatgttaaaagaattaaaagaaattatgatgacagtgtcccatctaataaggaatatcaataaagaaataaaaattattttaaaaaacaaaaaattgtggagttgaaaagaacaataactgaaatgaaaagttcactcaggggcccagcagtaaattggaacagtcagaagaaagaaccagcagacttgaagttatgtcaatagagattatacaacctgaaaaacagagagggaaaaataattaagaaaaatgaatagaagcttgggacatccttaatgagagtaccagaggagatgtgagagagaaagaagcagaaaaaaagttccaagcagaaaaaatgtccaagaaataatagctgaaaagctcccaaatttgctgaaaaatgttaacctacacattcaagaagcccaaaaagctctacacaaagagacacacctagacacacacacctggacacacacacctggacacaaacacctagacacaaacacctggacacacacacctagacgcacacacctggacgcacacacctggacaaacacacctggacacacacacctagacacacacacctagacacacactcctggacacacacacctagacacacacacctggacaaacacacctggacacacacacctagacacacacacctggacacacacacgtagacacacacacctagagacacacacctggacacacacacctagacacacacacctggacacacacacctggacgcacacacctggacacacatacctagacacaccagaatcaaaatgttcaagacaaagacaaggagaaaccttgaaaggaacagaataaaatggctcaccacaaagaagggaacccagtaggattaacacttgatctgtctgtaaaaggatggaggccagaaggcagtgggataacatattcaaagtgctcagaggaagaaactattaatccacaatcctatatccagcaaggccatctgtcagacatgaaggtgaaataaatttcaagataagcaaaaacggagagaatttcttgctagctgaactgctttatgagatattaaaggaattcttcaggctgaaaacaagtgaactcatacgattttcaaatccacacaaaaaagcaaagggcagtagtaaaggtaattatgtactttttaaaaaaggtgtaaatgcatatattttctcctgttttcaaaagcaactgcataggacaataagtatggaattgtattattggacgcataacatacagaaatgtaatatacttgacaataacagtacaaaggaggcaaatgggaaaaactgcactggagtaaggaaatggccacatattgtataatcccatttatatgaaatgtccagaataggcaaatccacagaagtagaaagtagattcatagttgcctgggcttgcgatgtgggtgcaagaaagaaggaaatgagtactaatgagcatgtttcccttagggaatgacaaaaatgtgatgatttcacagctctatgaacgtactaaaaaccattgtagtattaaaaaaaaaaaaaaagaacaaaagaaaagaagagtagaattttgggtacataattgtaaaatcaatctttagtggaaagctctgttatccagaaactcaaaattagctacataacttccccagaaatattcatccgcagcaaatattcatcagagacagaatccaaacccaggtctgtgtgaatctaaagtttattttcctccacctgccttaacaacaaattattgaataactcaaggacacaatacctcgaaagagtctgaaacatttctgtgatgaatttacttatgaatcccaatactcttgattctagatgatgtgttttgttcagcatctgtttcagtcatatcaagtaaaaccacttcccccaggtaatatagttttcctttttactttttcccttggcctcagcatttacagccccgtgcagactgttttaacaaacgcgttggtgaggtgtggtagaatcacaggcaaaggcgtgctttgctgtgctgtgtaggtacatatcaaacgctcaccaagaaattataaaatattattcatagcagtttttttcttcagtattttatgggctaagtgcaatctggcttttgataacaacggctgaataatatttgagtttgccagctgaaatgtcctaaatatcttattgattcatttattgcctcttcaaataacaaggcaacaagacagtgtcagaatgctcagtgtttttacttttttgtctatcatgggatggtgtcagtttcagtaaaaacgatgtctcttattttggtccacattgtaggaatctcaccagtgacacgcgtttgtgaaaagctgtgaatattcagtgccacagggttaaacctcggtacagaagcgagaccctgctgggcagagaaagggtgacctggaaggtgtgtgagggccccgcccatgggcccctgtgatggtcatggcctcaagaatcacagtccaggtgaggccctgaatatccacagccaggaccagttccctctgctcttgggtgccaaggccaccgtcagccaggagaggcctgcagaatcagcctgtgcacctctctgacgataagcagagatgctggtttagagacttgctactcacggggaagtccttgggcctcctgtactcacattacctggaacttcttggaaattcagaatctcaggccccaacccagacggactgaatcaaaatcttcattgtggtaagaccctcggtgacacacaggcctgggaagcacaggttagcgtgtcaccttgggcaaagctctcagcattgtgagcctctgttttctactctgtaaaggaggcatgaatatctacaacatcagtttgccatgagtattgaaaaataatgtcttagaagcacagggcagagcctggcatgtagtttgtgctcagtgcacagcagacaagaaaccacatgcaccagacctgggcggccgtcggcagcccaccctgagcaaccatgggtggccctcttgtctctcgggacaagaaatgcttctttagaaatgcttctttcctttctaaaatgaaagttttggacagtatttcctttcatttaaaaatttcatctgtgtatttgatggcctctgttgtttctttcctgaaactcctgctaacatactgggagctgaagaagggctccgtgaaggcgagtaggggtgcctgtccctcccagggaggagcttccctcctctcacctgctgcacgagccctagtgcttcaccaactccagcctcagtgccctgacactgggggagggaaaggaagcgcacgcaccagccgttccacccaccgaagttgtttggtcccaatctgcaaaatcagttaaacgtcttcctgcctggcagcagatcaaagggtgaggggtctgggacagacagagacggctagagaatggatggtgaagtgctcagaggccctgtgggctatcccacactcggcggaagacagcaacaccatcaaatctccaccctttgttatccatgacttaaagaaaagtgaacagggaggtggacaactgtgcaaagactggctggagtcaaatcctgggcataggtgaagcatcgagaatgcttgtcacacgtttgaatgtgcagggggactctgactggaagctcctagcagaggctgaagacactggttaggtcctggtgcgtgccttgggatgcatcccaggcaacgggcccaggagcttgaggtcatgtccacctggctcaccagggagtcctgcaccattcttcaaacctaactggaagagacactgatccttcctcccacctaagggctcccagagccacaggtctccgactctcctgcaacacctcctgctgcctgttcccaccgcccatgattcactcagtcaccatcctcagcagcacccgacagcctctgtgtgtctgtgtcactcaccattaccagccccctgggtgcccaatgcatgtatgttagacagaacaaatgcacggcggccttcagcagcaccgaccgcgtcaacccctctgtgctcacaccaggagtgatcagcgcacacgccctcccacaggatgggagaaggtgataacagctgagctgggtgtccagaagccagccccaccccacagccactactgagaggttatgagatcatggccttatcccgagtaatgctgctgcagtgaactgggacttttttcctctgaattcaaaggtggggcagtctaggcacctggatgcaccatctgctctgtcccggcctggtggctgctcactgtgggatgctgtgcaattagacagttactatctttccctggttgacggattagagtttcccttttctgagcatcttgttttgaagtgatccgaagtgtttagggttaaagagcgtgattttcccaaactgtccaaagaaatagaagcaggtctgcaagaggggggtgcccagagccttgagatggaagcgagatggggtgagacctggggagctctccaggccgccgggaagctgcacgtcatcctctggacctctttgctgactgtgtgctgtcaccacagcagccgccttctctcatctgtaaacaggattttacgtaaatttccatacacttggttgttgacaattaagtagattgtttttaaagatacttgaaatgatatcagaatttcctaaatatatcattaaaacaggaaacttagttacctactcactcgaatcactagagaataccaaataggaataggaagataacacactggtaagaaaaatgtccaaggccaatcacaggagtcaaagctcgtgatcaaatcagctctgcctggggaggccgtgctcatggcaccatttagtgacaagtgggtgactctggggcaagttccaggggtgtcacccccaaggcagcagctcaggtgcagccaccatggaggcagtttcactgaggggccctctgaggcccctactctgagattctaagacagggtttgaagaatgttccagcatttgaacacatgaaccctatgatgtcctgctgtgagagagaacaatgtcccaattttgcccaggtgatttgaacatctcggtatggatctgttatgggttgaattttctcctgcccaaattcttatgttgaagtccttacccctgatgggactagatttgtagacagggcctttaaggaggtgattagcgtagtgaggtcaccaggtgggccctgatgcaatctggcatcctcctaagaggacatgaggacacagacacatacagagggacgatcgtgtgaggacacagaggatggcatctgcacgccaaggagagaggcctcaggaggaaccagccctgcccacaccttgatctgggacttccagcctccagggttgtgagagagaaatgtctgttgtttaagccatgcagtctatggtgctttgttatggcagctccagcaagctaacctgggatctaaaatgatacttaaactggttcagtctgattcttaaactggttcagtggagctaggccaggctccctctgagcagatgttggtccctttgcaggcctgctgtgtgtgatgattgctaaccaggttatgacagtgatctttaagtaagtgggaatcttgtgagttttgaggttttgtttttttttttaatgaaatctacatgggatgtttcaaaaatagcagcctctgtatacatttgtcaagcaggaagctgggtctgcggggagtagggtggggctggttctcccacacgcttgccactttcaggcccttgccttgcatgggctgcggtggttctgccagtgtggattcgaaccgataggtttcgctgtaccttgatcagcatcctgctgccgagaaagccaaaaagggctggagcaaccctcccgtgtgccatgtgagcctgtttcctttctacagtcaccagttcacgcagcaagtgtcagagcattcctgtaaggcccggctctccacaggggccaggggagctttctctggcagggtcttcttcactgtgtgtaggatacggcagcctttgaggctggggaaccgaagttttccttttattctattttaattaatttaaattacaataagtattatcactaagtttatgcaaacacgtgagggaatgctgatttagagctggtggcgtaaggtcacagagctcccacgaatctcacatggaagccttgtttctccaggttttttgtagtttgtactgaatcacacaccatgctgcttccatgttttttcagggatttccaacacagattttcctgagtaccctggattaatctccttttggataggtccatgggggccctgctgctttttccccttagccctgggcgaggtcatcatagagggggagtggcaatggctcacaaggtactagtggaaccccagtaagttatctcagagcccgcttagaacacaagtgctacgtcccccaaaagctttgcaatgagtatctgatgggaacaaactcagtcaaggacaggcccaggttggggcttgcaggctgcagattcagaattgtttatgagatgggagccatactttctaacaacaagacctgaatttctcaatttaatccaagtcgtgacttaagttagcgcccttccgttcctctattacatttctgttcggcatggatcaaattgcctacaaggtggaacagatttcaactgcaatctctgaaccagaaaattcacttattctcatgaaagtttgtaatctttggagagttgcttaaacacttaaaaccatctttcctctttctatactccaaacttacctgctgcaatttcttgctaagaagcaaagtgctatttgcctattcctatctctctttaccatcagacactccttaagttaagagctagataattcgctcagcctcaggccaggccgagcctcactctagaagtcacattcctgaggtgtagggggtcaaaatgcctctcattgttcagaagcaggtgaggggccagccagggcacatcctgctctccaggcttggttcagataactgtcagcccagttttcaagagcacacaccaaaaatgcaccaaagcttacatccatacaaacacccgcacatggatgtttatggaagcttatttgtttttattcataatcacccaaactcagaatcaaccaagatgtccttcagtagatgaatggataaactgtggtgtgtccaggcagtggaatattattcaacgcaaaaagaaatgagctatcaaggcatgaaaaaatatgggggaactttaaatgcataaatgagtgaaagaagccagtctgaaaaggctacaccccgtgtgcttccaactacaggacatcctggaaaaagcagaattaccaacacagtgaaagataaggcctggtggtgtggggaaggatgaacaggtggagcacagggatctttaaggcagacaatctactctgtgtgatactgcaatgatgagttcatgccactatatattttcccaaacctatagaatgtacagcaccagtggtgagccctgatgtgagctgtggactctgggtgacaatagtgtgtcaatggaggttcatggactgtaacaaatgcatcactctggtgggggatgttgataatgggggaggctatgcatgtggggaggtgggtacatgggaaatctctgtactttctgctcagctttgctctgaatctaaaactgctctaaaaatcgtttatttaaaaatacaccaaagcaatgaggccgggcatgcatacagccaaagccaaatgatatttgtgtgagtcaggtaaatttgagatctgaaaaatgatcactccagggaggctgagctgtcatggggcacttattgagaacctactttatgcccatctggtgcttagaattacgaattagctattattattactaaacaattcaaaacaaagtcacttatctcagggcgctttcaatcttgttgccatcgaagctaacaaaagtggaaacagaacaaagctacatacggcacatttcccagaacatgccaggtggagcctggccctgttgattgtgtgtggctgtcacttgcaggagggttccatggacaagtgagtttgggaaatgctgggttgggcaaatatcaacaggcttccttactgcaagatttctcatagtcaaaacatactttaaatctccaagaggatgatacagagagccatgtttcccataattagttggccccagaaacagtttcttctgggaacattttgtaagattagtgctccttgaaacacactgagggagaggctaaactgagtggtagagattcatagactatttggattctggccccagagtataaaaggccagggggaaaggactgtgttcctgagatggtgaggtggagaaggggacgtgtttctccaccacccacagagagggctgagaagccctggcacacgggctgaatctgggaggtcagaaggtgaggtgagaggacaggaagacagcccacgagacttccaaaggaaatggtgagtcttaccatggctctctgggctgatggcagggcccggcacaaggtaggaactgagtgtgagtgcgggatgcacccaggtctgaaatgctcaggaaggaccctaggacatgagcaacctgggctggtcactcatggaacctgaatggctggaaagaaggaagggtgatcctgctaagacagggcgttgtgaagatttcctttccctccgaactaacatctcactcacttctctcagtttccatcattatcttctatggagttcttcattcccacatctgtggaccttaaaatcctaccgttgagtgcctgccttggatcagcagtcagttcgttaccttggttctcagacgatgcttgcaacaacgccatgcgattcgcccactcttgggtaggtggagacattggggctcaggtgtgggtaagtgattgtgtgactccttgttaagcggcagaaccgggactcaaattcacacagatctgattccaaaccctgtggccctaagcatagtgttattagacaataagccctctgcagggagatttccagtgctgatggcagggtctgtcatgaaggaggactctgctgaatttttctttgaaccccaggaagtgcctggcacagttctctgaagaaattagaatgcagccagtggttactaaagaaatgaataagtcaagtaaatggacagagctgtgtgctaagagttcttttgggacacagaaatgggtcagaattggaaatgtccagaaaatactcttggataattatgaaagctacatataggagctcaggtttaactccatatgaaatgaagagtcacaaaagaaaaggaggaggagcgtgttcaggcggaacctcaagcttgagagtgctatgaaatatgtttgagactcagaaaacagttcctgaaagaaatgacacattaatgaatgaaggtatagttatttggagaaaatgaacctagatataagagtaaccatatcaaaatgtgtttctttaactgcggtcttcagaacctatgaggttcattggtatattcttgggaactatgtgtgtttgagaaacatatttctggcgccaaactgacagtcacctcaaatccatcacagcacttatgatgaattcttttcaagttaaatgctgtaaagaaaatacttctcttttttactgttaattcacaatttaaaagtgttttcttactgaactacatgttggtccctcagataaggatttctcgagtctcaggtctttggggtctttgaggagtgtgacttctcaaattggatgacactgatctaactggctgtagtatccattcaagcatgagggaggtcagagcctgggaaagctcaggtccaaacagctcttgaaagaggacgttgcagggcaggctgctttgcacaaagggacctgtagacactgagaacatcagtataccaggaaccagcccaccctttcactctgccagacatgaggctgtgggttacccatctttccctgtctcctgaactcatagcaaaaacaaaaaacttcacttgtttgttaacacatatagttcaagacggaagggcctacactgaagcagaaaggattgaggtttatcagcatcttcgctttgaggcctcataatgtacttcccatggactaaagttgttcactttctttagaggatattagctaaagatgtggtaaaaccacatttttgcagaaaagtgaatattcaaaaacaaatgtatatggtgattatttaatagttttcactccacttcgcaactcaacttttggttgatgcaagagggatgcgaagggagaattgtgcttctaattccagcattgtggtggaataaaagagcacagcattgcagctgttgaatataggcagttttttctttttataggcagttttaagaagaatgcattgattctacaacgtgctattgtgaagccatccgggactgttcactcactcatttaagaaaggtgtattttccacttgaggtgtgagagaaagtgtggtgttcactcattgctcttccttctggcttttatttttctcacttttagagaaaataagagaagtatccctgaaggatgaaatatcctcgaatatgaaaaggtctgctctctgaagaccaactgtctcagtctgctttttgctgctgtaacagaataccacagacttggtaatttataaacagtagaagtccatgtggcttatgcttctggaggctgggaagtcccaggttaaggggctgcatccggcaagggcttctcgctgccttatcacatggcagaaggcaccttgtggtgagacagtgaggaagggctgatttcactctcacaacaaacccactcccatgataatggcattaatccattcagcagggcagagccttcgtgaccccatcacctcttaaggctcccgctcagcatggttgcactggggttaaatttctaacacctgaactttggggacatgttcaaaccatagccagggccctgagaaacccatttccactgacttcaaaatagttcatgaaaatggagtgctgagagagcagcagggcattcacaagaatggttttgagaggcctcactgtgccaggcatggccctcagggcaggcagctctgcacagccccccatggcagcagctggtcaggctgcccaaactcaccactttggaatcacttcagcaccacctgtcttcacttgaaatcaattgtctgcagattttaaactcgtttctatgtgcccagtaggcagagaagccttcagagaaggatcctgactcggtggtttgtgcagtgacatttggcagtgttttctcggcaagcgagtctttgaggctgccctcatgctgctcagtgggcacaccaagaacaagagctggccagggatgacggacgcatctaggccttctcggcctaagggcaagtcccattcttccttgataggtctttagatgtaccagtcagcaaatgtcatccccctctgcattcacgtcaagctgtgcagggaatgctaaacagaggcagatctaaacttaggagttaggcttcttctccatggagatgtggatctgcacagacaaagtgtccaagtgggattttcctgctatttcaaggactgctgctgcaccctgctggctcttcctgcactccctgcctccaggaatgactgtgtctctttgagttagtgaagtcatcaacttttttttttaaatctcttattattattattatactttaagttttagggtacatgtgcacattgtgcaggttagttacatatgtatacatgtgccatgctggtgcgctgcacccactaactcgtcatgtagcattaggtatatctcccagtgctatccctcccccctccccccaccccacaacagtccccagagtgtgatgttccccttcctgtgtccatgtgttctcattgttcagttcccacctatgagtgagaacatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcgttgttggacattcgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctcatcaacctttttaaaaagcatttaggagctgctggttgtaaatgatcactgagaaatagtatttccctcacttgtagccatctgcttctctttttggttctggaacattctagaaccttggaaggtggctggggctgagtctcagccagcagggttgcccagtgccccttgtcaccccccgagcaacacaagccaggctgcggttactctgggtctgtgcgtctgggatcatagtttttaaatctgccccagggtcctccagtcccagctgtggaaagtcaccctcagagggtgaggcgggcggcgcgcctctgtgtgagtggccccatccttcacagcgagtttgtgtctactgaatcgcagactctgggaggctgaagggttacaggaggtcgtgtgtctcacgtcgccacttcacggttgaggaccccgtgacccgctttgctcagtggctgcgcaagatgagtaatgacctgaaacagggaaaatgtcttggatacatcttgcgtaatgaggagaaaaatgcagccatgttgcagcctgataaaatactctgccagtgtcctgccataaaatgacaggcgaattttcagtagcagattctctaatagttctgtggtcttctaggtgctaaactgtttaagtatctacattttctaagcccgcctaatgcaaatattctcaaaaaacataaacccttcattctttctcaaataggttacattagttatacactctggaggtgacttgacctgtcattgtgaacaattattgctcttggacgacccaggacataggccagccagtacgtaccccagtgtgttggagaatcgcgctcggcttcttcctctgtgctgagtcatgaaagttgccggagcaggtgcagttacacaacctccaggtaacatcacatgatcgttcaaaaaataatcatccaagtccaggatgcagcatctgtctcagtttttggcataggatgacagtctgaaatacacttactgaatttgaataagaacgggctcaggtcagtgattatcgctagtgccttatcaacgccctgtggcttttcagcattagtccccatatcctcgtccggtgtggcactgagagcagctaactgttgccctcgttggttcccagttggcttccgtgactggtcagggtcaggtccactgccaacaggctggtgttgaatcccttggagaaacacagacattctgaccctaaattatgctttcaatgccatgtgttttcctatcacaaaaatcctcgttctcaagtttcttctttctttatttttatttcatttcattttttagcattcctccacaattcattgcccaaatctactttttactcaatttacttgctttggtcatttttcaatatagcactttaatttcttagacaaatattttcaacattctcctgttttctcaaggatgtctgttttctccccaggtatgatcctgtttaaggactggatttaggataactacttagaggttaaaagtcacaagggtgtatggatgaggctggagtgatctgggaccaaaggtatgggtgataaagcagagtatctaagcagctcctgggattggtgtctttaaaaaagtaataatgcatttgcttattttagagacagggtctcactatgttgcccaggctagacttgaactcctgggctcaagggatcctcccacctcagcctcctaagtagctgaaactgcaggcatgagccaccacactcaactcactatctttttttttggagacggagtctcgctttgtcccccaggctggagtgcagtgctgtgatctcagctcactgcaatctccacctcccgggttctagctattctcctgcctcagccacctgagtaggtgggattacaggcgtgcgccaccatgcccgtctaatttttgtattttcagtagagacgcggtttcgccatcttggccaggctggtcttggaactcctgacctcaagtgatctgcccgcctcggcctcccaaagtgctgggattacaggcatgagccactgtgccctgcctagctcactatctttcaatcagtagagattctttagttattttttaactccatggatcccaagctttgatttttgttttccaaacaaattgcatttataaataataatttttatttataatcaacagacatctaggcttgctgtcaaggcttctgatcaacatgagatgaccgccgtgtggtaaactgatgaaccctgaccctgatcaacatgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatcaacgtgagatgaccgccgtgtggtaaactgatgaaccccgaccctgatgaacatgagatgaccgccgtgtggtaaactgatgaaccccgaccctgatcaacatgagatgaccgccgtgtggtaaactgatgaaccccgaccctgatcaacatgagatgactgccgtgtggtaaactgatgaaccctgacccattaggctttggctacagaatgtggaaataagttgtgttactacatgtgtgtaatcctagggtgcaggacaccggccgggaggttccatagagtgatgggttctgcaggtaactcatcctctagtcctctgtaagctcctagaaggaagaaattatgtcctttagactaataaaattcctccaaaccaaatacagcacctactgtgaagacacaaagatacttttagaatagtaaaaactttatccattgagaaattccttaatgaaacagtatccaagaagtcatttgccagcagatttcttagaggtgcgataaagaagaggacattgccagtcgtcacagcagctgcaatagctcctctctattgttaaacagtgggatatcttgtgcaggttttcagttgacaatcaattttaaagattagtttcggtccccatcaatcaattatttattaacccatcaataaaaatttaaatgctctgtgaggtacaatagctattaaaagagacagaggcactttctgtgtccagaggggcttttagtctgctctggaaagcaagatgcgtgcagatgagtgacgcagtgcatcgtgtggatgcaaagggagggactcacatgggaaccagaggagctacgaagggaggcagtggggactggtgggtcgagacctggaaataacacatgaataggcaacaaaggtttcctttcctcttccatgcacttcagtccttgaaaaacgtcttaccacggaattccacagcgtaccaagcgattccacagcttgatggcacactctcctttctcagcattcttgaaaatggcgtgtgagccaagccatcttactgagaaattaccttaaaccatttgatgaaccaaaaatattttgtaatacccatctccgacattaggtaggcaaatcacacagaaacaccgaggtcttctgagtcatatttatctgaaaaatcacagcttgggtgcatgtgaagccagaggagcactcctggggcctgcggtgccatcactcagctcccctgggcttcacatggccatggagcacccagcaagtgtaggctctgagccttcagggaggggcggcatcagccagcaccatcgtctcctgggtcttgtgcctcttccttggttgcggtgttgtcagggccagaattgggcaattccgggtgacatccaggtgtggctgctgacacggagcacaggtgaggttcactgaggtaagtgggccatggccttgggcttctagttcagagcacaccatccactcagcatgtgaacccagctccaaagcgtatgtgtgcatgtgtgtacctgtgcacattgcgcatgtctctgtgtatgcatgtgctttgatgcatgttgatgtacgggtgtatctgtgtattgtgtatgcacacacgagcatatgtgtacatgaatttgtattgcacatgtgtttaatgcgaacacgtgtcatgtgtatgtgttcacatgcatgtgtgtctgtgtactgtgtgcaacagtgtgtgcaagtgtgtatatgtgggtttatgtttgtacagtgtgtgtagtgtgtgtacacatatacacctgtgtgcatgtgtacatggtatttaagcatgtttgcacgtgtgtttgtgcttgcatgtgctgcgtgtttgtgttggtgggatgtggggaggctgctgtggagacaaaagctggagagaacttggtagagtaacccaggtcaggaaatggcacctgcaaaggaaggctggagtgcctgggattcacgttgaaatggccaatccgtcagctgggctggacacagccatcacgctgggcagctgtgaggttaaaacagaaagtctgggctgtggggaggctgagaattgagatgcatgtatgagatgagtcacgagggccaagtggtgtgtgtgagaaagcaggcacagcaccactaaacactaaggagatttcaggggagttacgggtggagggaggacatcagatctaccctggaagttaaacgtgtttcgagtgcattaaatactatgggccacagacgccttgtctccatatctactcttttataaatgaagtaaagttcttgggaaatacttttctcactctaaagctcacaatctatcttgcaaaaaatattttaaattccatctcaaataagccagggtgaaaagggagcctgtgcaccagacactgccagccttgcctggctctcgccttcttgctcttccttccccacctgctggggattttcttaacgatggagatgggtttgggtttgtcctgctgtgctctgctccccattcccggatccaaggtcctgcctctgtcctgtcccctgagccacctcagggatgcagggtcccccacctggtcaagtgcccagtgctgtgttgtcatttgcaagttcttcctgtgactgaactccaaatggcactgggactgctgactccacccactggacaacccgtgttcttgcttttggggtttctgaaacagccccaagactctgggcatcttgattttgctcccattgcttctcaggacaccctgctcctgtggtttgcagccccggccttctcttcgaggacgcctctgctcttctgcctcacactcggattggaccttcttcagcacagccagtggccgaggcttcctccctggggctcagtggagcaggacagatgctgcatccaaactcttccattgggttccagtctgttccagtcatgcccttgagcctctaaagctcctaggtgagagacgtagcagctgacagcacttcccacttgatttgggtggactccagcctccccagcaacaataagagatcaaaagcatcgttgaggaagcagcttgctgaaacgctgagtgcccgccactctcaggtcaggtgggaccggcaggccagcatgagttcctgaacacttggttctcaatactggccacagccacactgtaaggggaaacaagagggcactgtatgcaaacatctcttgaactctggagtctgctcaccttcctgcctcaagcccctctcccacgtggtccagtcaccattctccacagagactaccctaaaacccagcgactctcgtgtgcctgcagaatggcacagcccgttctcatagcagcactcctgtttaatcagagggatgttaacgaccaagtcatatttgctcgatttgtgttcaacatatttcatttgtaccgataaaacttaaaaatatccccacacatgcattgcctattaaagagtatcttccaggtacacctcccttacacatcagttaacttgataatttcttcccattcttgtgcaataaatttccttcctgatcagctctgtccagcagcaacaataatccacgtagagacatgcaaactaaaagtccgttagtggaggcacgaagctgatgaggcttggaaaaaaatgaccgatttgattaaaattaggacccatgggagtggagctctgcctattttagaggcaaagtaaatgcctgggagtccaatcaccgacattctgtttgaggtttctaatcacaaggaagatggagaaaatgcagaacaagtggtcaagaacagggagataataaatagaatatttatgggctgaggaaaacaattaccaggggaaagcccaagaagcaaagatgaacagagaacgtgctgactgcgctcgtttggaaaggcctcatggccaaaggaggagaggcattatgaggagcagtgaccgagtgggcaggacccccggggatcaggaaaggtgcacggggggaaatgagaggcctgagcggcttcccagcgaaggtttttgaagcacggtttgattttctctctccccctcaccatccccaaattttagttgtgactatctccaggtacatggcttgcgacaggcggtgtataaaaactaatgtcagtttaattttaaaaccttagccattttctggaacttaaatatcaaagagaaaatgtccacatatgatgttaattgaggtttgtctcactggtgatttgtgctgattcaattcctgtttctttttttttttcttaaggggtcagttttagaattgggagataggtgtataacatatgactatacagcgcaggttggttttttaacatagaaatatctgcctttaaatgagaactgaaaacggagcttcttggaggccacctgctggtggcagtgatctgaccgctgtttaagctttctttgaactcctttttttaaaacagcctccataatcaatggtgtacgatctactctcgtggtaaaacttactcagtgaagagtgtgttttattttctgaggagctgaactgttccaacctgagtattctgaataaggacagtggtcgagcatgagtgatgccatctgggcttagaaataagtgggcctaaaatctgattgttttcatacattgttcagatattgacgcaaatagcaatttattttgtaaaaaatgattggtatccggaacttgcaacagctgtgtgtggcttgaagggagatgaagtggtgaaggcctggtttccaccgaagctctcacagcccagcctttcactgtgtggccgggggaagggtgctccgggtgggggacgggaatggtgggactggggatgccacgggacaaggctgctggcctggaaggtagtcacgtggagaaccgcaggagatgagattggaaagtagtaataagccatgtggataagaacagaggagcgggttttaagggggacgtcctgaaatgctgctcatgtcgtttcagttccatagaccacaggaaatgcaggtgagagggcagcccggtgggaaggaaggaagagggtggtggtgagccaggtgagtgtggagccgcccagggcaccgtgctgtgcgatagctcaggcatcgggtgcttctgccaaacccttcagcagctggtttggggccaaacgtccttcctgtgtgagagaaggcagagcctaggcagcattccaaaccccatccagatgggaggctgagtgcagagcaaacggagcccagcactccagagccgtgtcccttcactgccatgatcacatcacaaacagcgaggcttggagaggacttaagagctccttcaatgccatcttccatccactgcgtgagccagaatagaaaaaaaggaataagaagaggtcggttaagctctctattaagttgagaaaatgggaacttcaggtgatcatgtgagatattcaagttaaaaaaattatttaaaaagcacattcttattattaaaattttagaaagtacagagaaggaaattttaataacctacacctagaacactaagatactggtaacgtagaaaaatgtgtagttaatgccttgatggattcttttctatttttttctctagcaatatttatgtctatccacagaaagcgtacactcatgtatttgcatggctaatatattttatgtaaagttctatatatttctcaacatttcacttaatatttctttataaacatttttccagtgaataaaaatttttccaaacagtaattttaatgactatataacatttcattgcatttatatatcatttgttatttaactacttcatcattttggattcacatattttcaataatttccattataataataatgtcatgaatacctttgtacaagaatatttatatttctaattatttccttagtctagtatcctaaaaactaaaattcctacatcgaaaggtcaatgtgtatcacggctcttgattgacatattgatttccatgaagctttcatcaattaacccatgaacagtgtctgcaagtgctccttgccccataccttccacaatgtggactcttattggaagtatctaaatttcacttcagaattgcagccctgagttattaaacacacctctactacacctatgaaattgtctacaaattgtcttagtttcttttcagctttgatttctagaattgcatgacattgaagacaaatgatataatacccataaagaaggttttatgacctctttcattatctccaacaatcagaaaggcaaattcacagtagagggctgagaaatcttatctgaaaattaactaaaatgctgcttttgtcaacagaattacttgggcttcatttcattccacaatttcctgtgtactgtttattacaagaagaaaaaatttcctgccatacaaaatgctccatgcaggtagaaccaggaatctaaagaaacctgaggaaggtgctagaatcatcactaccatctttttttttttttttttttttttttttttttttatggagacagggtcttgctcttcacccaggctgcagtgcagtggtacaatcttggctcactacaacctccacctccaggggctcaagcgatcctcccacctcagcttcctgagtagctgggaccacaggcaaacgccactgtgcccagctaatttttaaacctttttgtagcaacaaggtctcactatgttgcccaggctggtcttggactcctgggctcaaacaatcgtcccgccttggcctcccaaaatgctggcattccaggcaggagccactgtacctggccccaccttctttttgctgtaggctgagcacaggagaagttgaatttatcagggaacctaaagacatgcccttctttgaaggcagaagtcctgtccacgtcaaatgccctccctccatccctcccagctccctagtcatccttcctattctaggctccaggagcgagacctcctccatgtgcctgctaacgtcagtgccacgggccctctttggttctcctgcccaccttctctgactctgcccaacacccacgggccagaggcccttttccttcttggcacttctcggtgttgtagcaggatgagccacggacaaaacccctcagacgccgggttaaggaatgatttggttttattcggccaggagcttcagcggactcaagtctcaagaaccgaactctctgaagacagagttcctggcccttttaagggtttacaacctttaggttccacgtgaaagggtcgtgatagattgagagcacatgcgtttagagtggggtgggggggttaatcttttaacctcaggcctgatcatcaggggcaccagctggtcttgccactgacttcattcctgttgtttttcaacttttacttcctcctcctcttcagacaggagacagtaagagaaatggcctctctcctcagcggcacaatggactttagacatcgcgcctgttttgtactctccaagccggacttctctactcgctggcctggcgctgatgcccagaggccccctgtgcttgtggtcgtggccttagacagttccctgccctttgtaagtactaacttaactcttgaatgtggacgttttaagctgacttttcttctcagccctctgtaagagtttcgaatctccccatagcaatcaatgtaattgttttcacccagggtgttggtcctggctgcttcgattttaaagtaatctctcattttgctgaggagaatttattagagtaaatgactgttttcacctgtcatgtcacattaaaatgtggagagaactggttgtaggggcagtcaaactggctgtgagacccttcgagcagccatgcatctcctggacagctcgaacactgatcagggaggagatactgaaaataagaaataagaattgcctttatatgtgtgtatgagtatagacacatacatcatgtacatgtatgtgtgtatgtgcatatgtgtgcatgtgaagatggatagatgatagatacataggtgatttatgtataggtagatgacagatattggtaattaattgatagtagataggttgatagtatataggtgattgatagatggatgatagatcattgatagatgataggtagatagtagatagattataggtagataaatagatggatgatggatggatgatagatacttgattgatagatgataggtagatagtagatagatgatagataatgatagatgatagctagatagtagatagatgtgataggtagatggtagatagagatgatgatagatggatgatagatggatggatggatgataggtgattgatagatggtagataggtggatggtagagatggtagataaatagatggatgatggatggatgatagagagctgatagtagataaggtagatagtagatagatgatagatggatggatgatagatgattgatagagagatagagagagaaggatgatagactgagcatcataacttcactgaatgctaccagttggattcaaaagtcagcaaactgaaacgtcgaatttcagccagctatcagaaatattgtaatctgacaacaaaagataaacaagggaacatggaagtggcagctattccagaagctgcacctctcagcatgggcacagaaccacagaagtggagccagagtcctctccacatctcctctgggtcggcgttatcattgtcacaatgggtggaggctggaccttgtgaaggcaaaggcatacggtgctttcttgcttctgctgtttggtgactcccttactcattccctctgcggtggctgaggggctgatgatcagttcctctgcccagaatgccctgaccatgctgggtgtctgtcctccctagacctgggtctgcaggatgacaaggaccctgcagcagaaactcctctgtctcttccctgagcaccgtcttccatgctgcctgactatggtgctggttcccctctgatatggagattggtggagaatgaccaggatattttatgtggcaatgggggttgaagcccacttcaaaatggcttaggataagtgaccaaaagtcccagtgtgagcatcaggcatggctggatccaggtgctcagcaccatctggaaatttgtctccatctttgactctgctgtctctgtgtgggcttcatttctaagatggttttctctgcacagctgtaacaaagctcagggcttgcatgatgctttgcagccagtacatcagagaggactttccctcaagacttctggcaaaatttggggtaacatgctgttcttgctggggtcaggagccatcttgcaccaatctcagaggccaggggatggagaactctcctagggtagtcccaggttctgtgcctccccggaaaacacaaggtcggagcctccccatccaaattaatgctcagactgtcagggaggaatgacttccaaagaaaaaccaagggcccttatgaagaaaaggaaggggtgcacctacagttgccagttctgtttggaagtgagggaggggagggcagattcccttggcttgttccctaggacagctgtacttaggttttactacacagtccactgaaaatgcttctctcattagtgttgtgcctctctcatgcctctttccttggataaagagcaagcacattacgagccacacttggtgctggtgctgtggcatgcaacactacctaatgcgagagaaagatgtgagcaaatatccggaatatacaaatataatacaaaaatacaaatataatcagttatacagcaaacagctgtgggaacagcagctctgcttgcagggttgggtagtggaaggtttcagagttgatagcatttggattgggctttaaggtatgactaggagcttaccagatagagaagtggtgtttggacgttgtatgagaaggaaacacaatctgagaaggtgtaccatcctaagtgaatctgtcacagaagcgagaagatgctgtgtaaaccggaataatgcttgtgtgcatggatcttgatcccttcgtgagcaataaatgattttgtgaataaattgaagaatgctgaattagatcatagggtgtgtttgccggggtggggagagaggagagcgtcgaaactggggaagtggggaaccagagatggcaaagcctgggacttccagcttcacccacaggacgcgaggagcctcatcagtatcacccgcacaagcaagctcccatgaaggcagcggtgtccaggctctgtcgcgtcctttctttgcagcctgggccttggtttcttgcaggtgctgtgcccaaaggttagattgacagatgtggccgtgtctatcagggaacatggactgaggccagtgctttcaaccatactcacttttcactgtgttcagagggggtgggaaatctcccctaaggaggagatacgacgtgtgcagattgagagctgggaccacacggattcctccaggggcaagggctggtgaccttgcagtaacttccagaggcctcagcaccctcctctgcacaatggtggtgggctagccagggcaccacagaaagggccagcaaggcacaccctcgtctattgcccaggcacacatgggcatccatgacagccatgcatgtgttagagcccgaccagagctgcagcctcctttggctgaggttggaaaagcggagatgtgttcacagttggagaattggtatgccttacccaagtgacatccctgtccttggaaacttattctggggtcacagaattaattccccaggattgggtgtcacgaggaggtggttcctgtggctgaaaaccaccaacacctcctttcctggaacatttccctcctggcatagggcagttctcatgccagaacatcttgggccacaaagaacctttaggactgagcatgtctttctgtttgctttaagcttttaagaaaaagaatatgcaaaggctgattgaggcaaaaataacaggctatttctgacgttcattcagaatgccacctaactaggccagtttttggactgtatgccagcctctttctgcgggatgtaatctcaatgtctttaagttcagtcagtcctataaattgctatccctattcatgcagtgtgttttcccctgtgtgaggcatttgtgagttccattagcactgataggacttttaaatgcagaagcagcagtgaagggaatggcatttcccagctgtagggcacgggccttctttgagataaaaacccaccctggcatcgatgacatgggaactattctgtgtcttttcacccgagagctcttcaatcaactgatgatcgcacctgcataactgctaccagacctgctaagggggagcctggcccagccatctcttctttgtggtcacaagcatgaacggccctgggacatcctctttcctcactgtcccctcacagcatttcctgaccactgtggccttggtcccaccacccacctgtgcagctcatctggccatgaacctctccagctcacaactctgttttctccctgttgtttctatgaaaccaggttccagccccgccacacagtctgcacggcctccaccgcagctctggtgagcctcttggccagctcctggtgacagcgtgcacctccctgctctgagaaggtctccctctcctctctgcccaccctgtacagagacatctttcaagcccatcccagaggagagtggcctctctcctcaaccccaagaggacggcctctcatgtggctgtcacccatctgacccctatcacagacctgagggtaagtggtgctcacgggcccacatctgtcagcctgcgcctggttggagacgcctccctctcatttgtccttgcttgctgcgtgactttggcaagtgcttgcctctttgagaccctcagttttcacacctgagaaatagaaaggtggtgcctgccccagctgccacgcagaagagtttaggtggcatgtgagaaaatgccttatgaactacgatgtgagcaactgcagcatgctgtgaacaccgctttcatgagctcctcaggggcagggtaacacccaagcattcttacacctcccaccgggcttgtcacgaccgtatgcaaatgaaggccatcaagcgtgtttgatcagtgatgtatttctttatttttagttgtagaatatgacaactctatttttagcagctatagcggccaaaactttgttaccactcagcagttgtgtgttcttcaagagtaggttttgtgctttcaaaatatctgaatcctctaccatttacaggtgttctgtgcatacttggtgtatgagttcctcaggaaggaagaaaaatgtgccctttttatcttttaaaaagatggcttggcttggtactcctttgcctgcattccttctctgtatttagaaacgaacctacacaagtgaaggcaaaggaagcctcttgaaagataaggcaggaaaaatgaggatagaaaacaaaacccttctagagagtttacgtggaggctaccacgggcatcgctgctctgcagtctgtcaaccagaggcccctggtgctgcagcacggccttggcagcttcaccaacaggaatgtgttctcctagggtactggagggtggcagtcccagagcaaggtgtggcagggctgctcctcctgaggcctctccctggcttgcagacgacatcttctcccatgttctcatgtgggcctccctctgcacacgtatatctgacatcctcccatgtcctcacacgttcctccctttgcactcgaatcccggacatcctcctatgtctcacgtggtcctctctctgcactcgaatcccagacatcctcctatgtcctcacatggtcctccccctgcactcacatccctgacgtcctcccgtgccctcacgtggtcctccctctgcactcacatccctgacgtcctcccgtgccctcacgtggtcctccccctgcactcacatccctgacgtcctcccgagccctcacgtggtcctccctctgcactcacatccctgacgtcctcccgtgccctcacgtggtcctccccctgcactcacatccctgacgtcctcccgagccctcacgtggtcctccccctgcactcacatccctgacgtcctcccgagccctcacgtggtcctccccctgcactcacatccctgacgtcctcccgagccctcacgtggtcctccctctgcactcacatccctgacgtcctcccgagccctcacgtggtcctccccctgcactcacatccctgacatcctcccgtgctctcacgtggtcctccccctgcactcacatccctgacgtcctcccgtgccctcacatggtcctccccctgcacttgcatccatgacgtcctcccatgccctcacgtggtcctccccctgcactcacatccctgacgtcctcccgtgctctcacgtggtcttccccctgcacctgcatccatgacgtcctcccaacagtgagcacgatatgttattggggtgggtgtgggataaataaggtataccaggtgagaataataagaaactcaactttaaaagacggtgctgatttggactgtggagagattcaactgccctgcttagcatttgagattgtgatggatgaactaattaagagcccaaaatgaaagcttgggataaatatctgagggtgtctaatatcccaatttttcatcctagagtgggcagagtccttgaccgcattctagggagacttccaaaagaaaaaagacctgcatttcttcaacaacccacactgagagactttcctgcacttctgacctgtggctaacactcctcaccgttcattctgtcatcagtgttttggggaagcacctttaactctctgtgatttacaggttattaagtggcccttacaattccctccagagatggaaaagacatgatgatggtgtctgagctcacagcagcaagcaggcgtgtgtgctcagcagccacgtggctcatctgctgggagcttgctaaatacgatgttctacaacattgcctaacacaaggggagacgctcctgactcagagtgtttaattgctcacctacttctttttctgccctcttgggcttctgaaatgaaaagaaccctggggtgatacagtgagtcaaaggggtgccagctgcatcacagcaaaatagattcctaaaaaatccctggcctaagatgatacccttggctggataagtttgaatgtgctcatagtggacatggtagaatgaaggtggttgaaatgttcacattaaagaacttccacccagattgcaagaaaagagagaagaatggagacggcagcacgagtccctacaataaaagcagatgttttgagatcagttatatttcttctgacaaaaattaaagacagaaaccaaagtttagcctgaggctacaattaattgggcaataagccagaggcacatatggcatagacagatttaaacatttctccctgatattaatacaaatactaaaattacaaatactttgattccaaataaaacaaatatttaaaaaatttaatgaataaacactggggtctacagtagtatttgaaggacagctcacaaacaggtttggtttttgaaggttagaactggtggtctagagaattcatttcattccagagagagaaagagaggaatttcttgggttccttcaggaatgcgtctagctttgcctcatctttgtttgaactatggatacggcagaagaaaacatgaggatttcacagatttaaggtgcaaaaagtcactgggttctctaagaagtctgggattcttctgctggaaaaataagtttgttgagaaaaaatgagttggaggaggctgttattgaagtgaagcagaattgtttttactaatctgcttattacccactctgtagtatggaaacaaattattcatgcacaaggtcctcttgctgttcctagaatgcagtggaaagagaacagattagttttcctccctcagaacacaatccctagagacaacctacctcagatgagatattgcctaattattttcaaaagacagtgaaacatcatggatgtaaatgtttgctgcaaaataaatacatgctagaaacagaagcatctgggtcacagctatattagagctgcctgtgttcccctgtcactgagattaaaacaaaaatgtccaatacaatcattcacagcatgggagaggggaagatgaaggatggaaaggccaggcataaaaggatttcagaatttcggtccataaggaagtggctttgtgcattgtctgttactatgtgcaaggtgaagtttgaagaatgaaaacgtgcagtaacaaaggctgctttgtccatctcacctccccagataccaagtttcagacatgttgcattttaattgaaaggttgatataattttttaaaagaacacttgtggtgtttgaagtgacaaaggctgctgtgacaaaaaagcagggaaagggaatttaaaaaaaaaaaagcaaacaacaacaacaaaaaccccacagaaaagcaaacaacaaacaaacaaaaaacagaggaagaagtcaaacaccctgggctgtggctacttccaggaaggggctacaagaggcagttggaaattctatttgttttgcaactgtgggttttccggcctgcttcctttctaaagtatattactctgcttttggttcatgaagttatccatttctgttttctggaacagctatgtatttatctatcatctatctatctacctgcctatcatctatctatctatttactatctatcttttctacctttcgccatcaagagcttcaacacctggacacattccgcaaagtttcctaagaaagcaagaaaaataattaaaaaaaaaaatccggagtccggggggctaatggggctttactgggactctctggcttaatcctccaaacaaccctgccatagcagcccatcagtcctctgagacaggtgaggaaactgaggtcgcaggagggcacccagaaggtccaggcagagcccccaggcccccacacctccccccgtggcagctccaaccccagctttttcactagtaaggcactcgcgctgctgggccacgcccactcccccacgcggggaaggagcttcgcgctgccgcctggctggggactgggcacgccctcccgcggctccggagccggctgccaccagggggcgcgcccgcggtgtccgggagcctggcggcgcctgtgcagcggccagtgcacctgctcctgccctcgcctcggtctctgccaggaccccgacgcccagccggaccctgccctccagcggggccgcggctccacggcccgcaacagcagccccacccggcattcggcgcgctccgcggggcagaggtcgcggtgtcctcaggctgtggcgccggcctacaacccccacgccgggcccgggccccgtgattatatttgggccccgtgtgattatatttgacaggtcttagttgacgcgctgttcagcgctttgagttcggctgagttttgggttggagaattttcttccacaggggattgtcttggatttttctatttctccctcagtatccacctggaaaacatttcaattaatttatattcacttaaacatttccgtgcaaaaactgtgtacaaaagccccaaagtataatttgcgcagttgagcacatgttctgttgtccagcatttatggtggtttgtagtggaaaagatttttagaatatgtggatttttgggatattcccagaagcccagatggccacactttaactttggaggaattaattctcagaatattgcacacaatcaatcgcctttggaaggagcatatattcccagcaaaagctctggttttttgaagtctgtgttgtgtgttatttccaggagaatatgcaatgatgacaatgttattaactgattcgaatatgaaatgctgttatgccaaacaatgaatctttgtgttacacattatgcctaactataaatcttcgtgttatacattttaatgtcattggagagtactcctgtcttcttggcattattgataattcgattctaattgctaataagtcagaaaaattaggaacaccaaatttcagtcgtctcaaaagcactcctcttattaaatttggatttttacctttatcacatcaaaagaaatattgttagaaaggtgtttaatgttttccagatggttagattactgttattagttctgatttcattgttaatttttaaaaccatagagttggaagtatcaatatgcctttcaatataccttagtggaatttattaaattttcatggatgtcctttaggaggttcaggaagttatttctattgctagatttctggaagatttatcaggaatgagtgtcagacattgtcagacgtccattgaaatcatcatggtcttttcctttattctattaatatggtgtattacactgatttttagatttgtattggtaggataattccacttggttatattgtctaacttttttctaattttctttaatttttattagagatgaggcctcactctgtcacccaggttggggtggagtggcacagtcacagctcactataacctcaaactcctgggctcaagtgatcctgccacctcagcctcctaagtagctggcactacaggtgtgcaccaccatgccaggcttatctaacatttttatgtgttgcttcttccagtttactagagtttttggagatttctgtcttcattcatgagggataatagtctgcacatttattttcttgtgatgcttttgtctgatttgttatctgggtaatactggcctcaaaaatgaattgaggttttcctgcttctctgctttgcaagtgtttgtgaaggattggttattcattaagtgtttaatagaattcactagtgaagctttgtgagcctgggctagactgatgaagagttttcattagtctaatctgtttacttgctgtatgagtatgcatatattctctttcttcttggtttacttttacaatttctgtatagcagggaatttgtttctaatttgtagtatttcatgcttctaggttttcatggcagttgagatgtaagaataaaaataatgttgggagaaagaagttgtggacaatctgtgaatatcccaacatctgttgtaggaaggttaagattttttttttttttttgctgtacttaactgaatactcatatttatagtgtgagacaaatgtaatgttgtgtataaatagaactaggaaaatgtcttagtatttaatcgagatggaagtctgggcctacctcctctcttttattaatatgtagacaggacaccaacacaaatttgaatgaggacaaataaaatgttagcaaatgaagaatagtatgaattggttaaaatgtgatgaaatagagtggtgaatatttacatagaatccatgatgtgttaggtgctatttcaagctatttgcacatatagttttaataccagtgacattaagatgtataacacaaagattcatataaataaaaattacaacattgaaaataatattagatgacactaaaactatcgtagaaatacacatttatataaaacaaagtaacatcaagtattaaataaattttagacactttgattactaatcagatgaataagtgattagccttttaatccagtaaacaaggcatacatattattttcaaattccagagacaaatattttaaatattgaagtctaagacctaaaaatgtgtcctgtaactctgggggagggggtttcatttgttccacctgcagtgaggtctgttagcccgtctcaggtttgactcctgacttaattcctaacaggggaagctgctgtcctgtaactctgggggagggggtttcatttgctccacctgcagcgaggttagcccgtctcaggtttgactcctgacttaattcctaacaggggaagctgctgtcctgtgactctggagaagggggtttcatttgctccacctgcagtgaggtctgttagcccatctcaggtttgactcctgacttaattcctaacaggggaagctgctgtcctgtaactctgggggagggggtttcatttgctccacctgcagcgaggttagcccatctcaggtttgactcctgacttaattcctaacaggggaagctgctgtcctgtgactctggagaagggggtttcatttgctccacctgcagcgaggtctgttagcccatctcaggtttgactcctgacttaattcctaacaggggaagctgctgtcctgtaactctgggggagggggtttcatttgctccacctgcagcgaggttagcccgtctcaggtttgactcctgacttaatttctaacaggggaagctgctgtcctgtaactccgggggagggggtttcatttgctccacctgcagggcgaatggtgctctcacctcacacgtgacacttggtcctttttgcattatggtggtgaccactgatgaccgtatacctggccgtggagtgactggctgtactgtcttacaggtcagtgtggggccagaaaaaactgggccaagggacactacacagaaggcaccgagctgatggagtcagtgatgtacgttgtcagaaaggaggctgagagctgtaactgcctgcagggtttccagctgacccactccctgggttgggggactgggtctgggatgggtacccttctcattagtaagatccgggaggagtacccagacaggatcataaacacattcagcgtcctgccctcgcccaaggtgtcggacaccgtggtggagccctacaacgccaccctctcagtccaccagctcatagaaaatgtggatgagaccttctgcatagataacgaagcgctatatgacatatgttccaggaccctaaaactgcccacacccacctatggtgacctgaaccacctggtgtctgctaccatgagtggggtcaccacgtgcctgcgcttcccgggccagctgaacgctgacctgcggaagctggccgtgaacatggtcccgtttccccggctgcatttcttcatgcccggctttgccccactgaccagccagggcagccagcagtaccgggccttgactgtggctgagctcacccagcagatgtttgatgctaagaacatgatggctgcccgtgacccccgtcacggccgctacctaacggcggctgccattttccagggtcgcatgcccatgagggaggtggatgaacaaatgttcaacattcaaaataagaacagcagctactttgctgactggctccccaacaacttaaaaactgccgtctgtgacatcccaccccgggagctaaaaatgtcagtcaccttcattgggaataatacggccatccaggaactcttcaagcgtgtctcagagcagtttacagcaatgttcaggcgcaaggccttcctccattggtacacgggcgagggcatggaagagatggaattcaccgaggccgagagcaacatgaacgacctggtgtctgaatatcagcaatatcaggatgccacggctgaggaggaggagtttgaggagtatgctgaggaggaggtggcctagaattttccttttctaggtaaaggggggaagcagcgtggattcttaactgttctgacagccatgtgtctctaagcacttattcatttgtgtcttcacctctcctcctgctgcattttaaagcacttttatagtatgcagttttgcctaatattttcacagcatctggtttcacctccaacttctttccatgggccctccggctactgctgccagatgtgcatagttgtcctgcaaggctgaagctgtctgggtttatcacatgcccaggaacaagcattccagtggctctaggaggggtcggcatgggttgtggacatggcaggcaggtgccacatgaacttggggatgccctgggccttgggcagcgacgtggtggaaaacctgttcctgaaggcaagccttggcttatcccatgtgccaaacttctaggggaccagctggccctctgtttctggaattttaaaaggggtcagtgaccctggtggacaatgtccccaaagtctcatctcagggtaggaatgtggtcagacagctggctctgaaccagcaaggaagggtgggcaagtaggaccccaggcactccatcaccacgatggcctgggtgtgtttgtgtggcctcattctcttcaccaggtgggcatggggtatctggcagggactaggcaggaatcaagcccggtgtatactcacatgcactgaaccctatgtagaagggattaggtcctgggggccatagatggcggttgctgggcctgtgtgctcggggcagtctctccaaaggcacagatggggtttctgaacaggacctggggagacaggcaggtgctcacaagtgctgcttcccccaactggcaaccagtgaggaaaaacgcccgagtggaggtctgacctgccccactctggagggctgatgctctctggaaaggtgggtgatgtgcagtgtctgctgtctccctgtcccccactccaaaacttcagggaaaaaataatccaagattgtcaggatgagcctggtgagggtggcacctttggggataggcccttcagcctggcagagtctcctccccaggcttcttggggagcctggactgcaaagcctgctttggggaagctgtcaaatgagagctgtgtgtgtgagctgggtgctgggcaacacgcacggacagtgttcttctccctggctcttgtagaacttgtccatggcctgtgtgttggtctcttggtaattcccaccctacccccatcacacagataagatgaagccagcatagcccaggggtggggagatgaacaggcgctaccccaggtcccctaggcatgcccatctgcctctgacatgtccgggaaagcaggtgaggccccttcttgttctctgaatgttgtcaatggtctattgcagccaaatggggacaggcaggcaggagagtgtctcatctcgaaagaagtggttcctggaagcagctgggaggtgggagaggttccccaaactcccccatactcccccatactcccccacattccctcacactcccccacgctcccccacgctcgcccacgctcgcccacgctcctcccccacactctcccacactcccccacactcccccacactcccccacgctcctcccccacactctcccacactcccccacactcccccacactcccccatactcccccatactcccccatactcccccacactcccccacactcccccacactcccccatactcgcccacactcccccacaccccacactcgcccacactcgcccacactcccccacactcgcccatactcgcccacactcccccacaccccacactcgcccacactcgcccacactcgcccacactcgcccacactcccccacactcgcccacactcccccacactcgcccacactcgcccacactcccccacactccctcacagtcgcccacactcccccacactcccccacactcccccacactcgcccacactcccccacgctcccccatactcgcccacgctcccccatactcgcccacgctcccccacgctcccccatactcccccacactcccccatactcccccaaactgttctcaggttaggaaaaggggcctctgtgacagccccactcagtggctctcactgtctgaggggtgtccttgcccaacccaggtgcgcacccatctgagatggccttgcatggacctggttgggaaggttcagctacagcaaccactggaacctgcccacacctagtgtctccactcacacgtggggctagatgttcctccctcccgtagtggcacagccagtggcagagggggcaagtcaccgctgcagttcccacttgagtctgaggggggatcaggcttagtgcccatgtatttcccaattacctggttccatctgggggcttcatggacaggagtggtgcttttccaggcctcttttccatatgccagctacaggcccaggtttccaagtttctggagcccctcttccagcctggcaagcatggcgtgttgtaggggaaggacatgaagcctacaggcagcagaacctgtctgggtatgttctctacccctggaggcccctggttgtttacctcttgggtgagagtcggcttaggatctcaacattcttgtaggacttcagaactgtgccgacaggggcccaggaaggagcagaggctggggctggcagctaaccagtgtagtgggagttgtagggctcagtttggtcttgcagggaattcagggaggcttggatttgctgaagctctagatgagcttgggcttggatatggaaacggcatggagccagggcccttctgcacactggggtctgagtagttgcactctggtgcatccataggtgttccccacctggagcacagctgtggatagaagccgggagagctgtggagggaagaggaggaggagggagtctcggggcagccccagctgccaggcagggcctctgcaagtgagatgcagatccagcctgttggccacttagcacttgcttggccgcctgcagatcacctgacctctgctcacctgtaaatgggggttgcagcagcacttaccttctgggactcctgcagcttgaaggggcagcacacaccacatgctgagaaggcgcctaactcaggcaagcttctccaacagcaccacatcagattaacatccaacctgtacaggacatcaaatctccccatccctcattccaatggaagaaaagggagtctctgtcctaggggagcaagcacaggcctatctatgcagttggcagttggcacttgacccaggttggggaaaggcccttggatacatgctggtttcaccaaccatctgtgggttgggtttggcctggacccatgtaccccaggaggccagcagccccctgcatgggacaggactgggaggtgtgtgggagggctgagctttgagggaagccattatttggcctcatgggaagtggtgcaggtggttgttggtggctcagttttgcagggcctgggtgatcacccaaggagtgaaaattgcctttttatgagaaattgccaaaactgatgcaagctcatccgttgaaaaggtgagtaatgctggcagttggcttcacctgccccttccccacaagtaactggtgttcagaggtggatttggttccttcccagcctttcccgtttgcatgtagctgtgtgcatgtacttttgtgtgtacacacacattccctggaggggttacttttatttttttatttggggggataactagtgaggcagcctgacactttcttatcttgtcttttaagtgtggagtcctctatggagtgggcatcaggtacttcctagctggcctctgccagctgtttggctgccccagtttctgcccttcacagacatgccagccacctgctgtgacattcagtggccttgtttgcagctagtgtgatgagacaagtggatcaggtacattataaactgaaaaagcacacgacatgcagagggaaagggtaaatgaccatgtgtgtcctgctcggctgaagtccacatcacatgactgagatgacattttttcacctaacatttgggccctgagaaacggcatctatgttttactttttatttatgacagagttagaagaaatactaccaggctttcttttccattttccccaactccctctttaccccctcaagtttacctacctcagagagaaagcggagctcgcctggttaatgacagcctgaaattatttgagtcaggtcactgtgtaaaggtcatactgcttctgtctccttgtgcatcacctgcgcagctcagatatttcatggctccctgtatacaggtagctgtgttaccctcctagccgctttcttggtttgatacatgcctgggagcatgtgggagcagttaaggtctaggctcatgggaggacagttctgcccaccccagctcatctctccagctcagcctgcatacctgccttcctccatctgattccagagtaggggatgggaggtctcacactgacctcaagtttatgtgactttttccacctctgctttcccagacagcccctgctgtgggacttgtaaggagatttgtgaagtcagtatctacttttcttgtgtgggtgtttgtttataaattattcccctggaggggaataaatgttagaggtactccaaacccctaacatataaacatctaagcctggcccttttttggtggtaaaatatatataacataaaacttaccattttaaccatgtttaaaggtacagttccatggcatccaatatattcagtgttgtccaaccatcgaatttatccatatctacaacttctttatcatcctaaaatgaaacaccaaaaccatgaagaagtcactgaatagaagactgatgtatttgactccataaaaattaaaactttgtatgagagaaaaatgcctcaaagtcaaaagtcaacaggctggggaaatagatctgcaatatacatgacacacaaaaagctaatttgggatatatatatacacacacacatatatatacatatggatatatgtaaatatccatttttaacaccatttaaaaaataccatcctttccccattgaatagtgttgactcccttgttaaaaatcatgaccgtgtttttcggttctttatttctatcgcattggtctttatgtctgtctctatgctggtacaacattgcttcgggtactgaagcattacagtaagtatgaaaccaggaggtgtttgtcctctaactttgttagtttttaagattgatttggctacttaggatttttttagatttcatctgaattttagaataggtttttctatttttgaatatattggaatttttatagtgattttattgaatctgtagatcgctatagataacaatggcatcttgacaaggttttgtcttccagtccataaacacatgatgtcttttcatttatttgtgtcatctttaatacttttctgccatgtttatagtttttgctgtacaggttaagtgggtttctaagtattttattcttttgatgctatcatacatgatactgttgtcttgatttcttcttcagatagtttattgttattgtagaaatacaactgatttctgtgtattgattttgtatcctgcaactttgctgaattttatttattgtatctgacagtttatttcacagaaactaaaagatttttaatatataaggttatgtcatctgcaaacagataattttactttttaaaaaattggaatatcctttattcttttactcaccttattgttttaactaactagaaccttcagtactacattaaatagaagtagtaaaagcaggcatccttgttttcgctctgagggtaaaagctttcagtctttcaccatgttagctgtgttttttgttgttgttgttttttggggttttttttgtataacattatgttaaggtgttttctttctttttataatttattaagtacattttatcatgaatgtgggttaaattttgacaaatgctttttctttaagatgatcacatgaggttttttccttcattatgttaatgtgatattacactgattttcatgtgttagaacatacttttatttcaggagtcagttatactcattcatagtgtataatccttttaatgtactgctaaatttgaattgctggtattttgttgaggatttttgcatcaacatttgtaagggatgtttgtttgtagttttcttatggtgcctttgtctggcttggtgtcagggtaatactggcctcatataataagttagaaaatgttacctccttttcaacgttttgaaaaagtttgagaaaaactgggttaattctgctttaaacgttgggtagaattcaacagtgtagccatctggtccaggcttttctttgttgctgggttttttattactgatgcaatcttcctgctgaatctccttgctcaataggtttattcaacttttctgattcagtcttagtaggttttttgtttctaggaatttgttcattttatttaggttattcaatttttttagtgtataattccttatggtactcttctacatcctttttttactccaaaagtttgttagttatgtacccattttatttttgagtttggtaatttgagtattccctttttttcttagtcaatctagataaaattttgtcagtttttatctttttcagagaacaaactgggttttgttggtttttgatatctttttctattctctatttcacttatttccactgctatctttatcatttttaaaattttgctagcttttagttgtccctctttaatagtccctctttttccctctgtttttctttccttaggagtaaagttgttgattcggtatcttattttttataatcatttatagctataaatttttcccgtgtggtactgtttttgatgtatctcttaacttttggtatttcatatttttaatttgtctctagatattttctattttctcttgtgatttcttcttttatccattcttgggtgtttaataactatatttttagacataaaatgtgtaacctacaaaattttcttgatttgttacagttttatttgttgtaagtttttatttcagaattaaatatgtgtatcaacatttgttgtgttctcataaactttgtaatacatggagatttctggtccacatatgtaagtctctacattaatattattttgaagcatttaaacttctgttttaatatttcaaaggtctaaatgaaattgagatttttggtttctgagatgaaatcatggtaggtgactgagaaatgcttaaaaattagccaaaacttaaaattaagttaaagtttactaagtcaccctgtattgctggtaataaaaaataagtctttaatggtataaaagcaaacttcagagaatgttttcttttccccagttgacatctaaattaaaagctggaaaaaaattttatggctttatgcgtttttcactttacaatttcaactttttctggttaaaatttttccaaacagattcctgtgtatttgaaagacaaattttttttagttgaaatgcttaagcagttaaataaggccatgaaactttcttgaacctgtgggaatccatgagaaaatctgacattatgttctattctcttggaaggtagaaatatcgtttgacttctgttttgctgacaagaaatatggtcctgagcaaggctccctgggacaatgacctcacacatggaaaacgctggagcccatctgtctccaatctgctgttttccaaaaattagggaacttcagttttccctttgatactctgtatttctaccaaccacaacgccagggctgtcctgcttctacaagtgacaatgacaaatataggcctgaaggaagatgagctgatggcattcccagcttactaccactccttgggtgccttatctcacatacgtggattcaactcatagactcaggtgggtgaggatctattgttcagctacattagaagtgactgcttaagactctggtgtgtggtgaaatgaggcagaattttctcaatgcagtgttaggagaattttctcctcataattaccatcttactatcactaaatcatagctaaaataaggaaattattcaagaagaaatagagatgtaatcttatgaagacataaatttagagatttgtggagagcccttcataatttcatggtgttctctttgagctgggattatagttgacatttcattataatatattagctattctagactttatgcatttatgtaaagttttctttgttgcactttaagttctgtgatacatgggcagagcatgcaggtttgttacgtaagtatacacgtgtcatggtggtttgctgcacccatcaacccatcatctacattaagtatttctcctaacactatttctcccccagcctctcaccccatgacaggccccagtgtgtgatgttcctctccctgtgtccatgtgttctcattgttcaactcccacttatgagtgagaacatgcagtgtttggttttcttttctttttttctttctctcttttctttttttttttttgagacaaactttcactcttgttgtccaggttggagtgcaatggcgcgatctcggctcactgcaacctctgcctcccgggttcaagcgattctcctgcctcagcctcccaagtagctaggattacaggcatgtgccaacatgcctggctaattgtttgtatttttagtagagacggggtttctccatgttggtcaggctggtctcaactccccacctcagcctcccgaagatctgagactacaggtgtgagccaatgctcctggcctggttttcttttcttgtgttagtttgctgagaatgatggtttccagcttcatctacgtccctggaaaggacataaatgcgtagtattccatggtgtatatgtgccaccttttctttatccagtttatcattaatgggcatttgggttggttccaggtctttgctattgtgaacagtgctgaaataaacatacagtgcatgtgtctttatagtataataatttataatgctttgggtatataccccgtaatgggattgctaggtcaaattgtatttctggttctagatccttgaggaattgtcacactgtcttccataatgactgaactaatttacactcctaccaacagtatgaaagcattcctatttctccacagcctcatcagcatctgttgtttcctgacttttaataatagccattctaactggcttgagatggtatctcattgtggttttgatttgcatttatctaatgaccagtgacgatgagctttttttcatgtttgttggccacataaatgtcttcttttgagaagtgtctgtttgtttcctttgcccactttttgatggggttgttttttcttgtaaatttgtttaagttatttgtagattctggatattagccctttgtcagacagatagattgcaaaaattttctcccaatctataggttgtctgttcactctgatgatagtttattttgctgtgcagaagctctttagtttaattagatcccattcgtcaattttggcttcttttgttgccattgcttttggtgttttagtcataaagtctttgcccatgcctatgtcctgaatggtattgcctaggttttcttctagggtttttatggttttaggtcttatgtttaagtctttattccatcttcagttatttttttgtataaggtgtaaggaagatgtccagtttcaatttctgcatatggctagccagttttcccaacatgatttattaaataaggaatcctttccccgttgcttgtgtttgtcaggtttgtcaaagatcagatggttgtatgtgtatgctcttatttcagagttctatattctggttcattggtctatgtgtctgtttttgtaccagtaccatgctgttttggttactgtagccttatagtatattttgaagttgggtagtgtgatgcctccagctttgttatttttgcttagaattgtcttggctatttgggctcttttttggttcatgagaatttttaaatagtttcttctaattctgtgaagaatgtcattggtagtttaatgggaataccattaaattcttttataaattactttggggagtatggctattttcacgaattaattcttccgtatccatgagcatggaatgcttctccatttgtttgtgtcctgtctgatttctctgagcagtggtttgtagtcctccttgaagaggttcttcacttctcttgttagctgtattctgatgtattttattctctttgtagcaattgtgaatgaatttcattcatgatttggctctctacttgcctgttgttgatgtatagaaatactagcaatttttgcacattggttttgtatactgagattctgttgatgtggtttatcagcttaagaagcttttgggctgagatgatggggttttctagatacaggatcatgtcgtctgcaaacaaagataatttgacttcctctcttcctatttaaatacctttatttctttctcctgcctgattgccctggccagaaattccagcactatattgaataggagtggtaagagaggccatccttgtcttgtgccagttttcaaggggaatgcttccagcttttgctcattcagtatgatattggctgtgggtttgtcatttatggctcttattattttgaggtgtgatccttcaatagctattttattgagggtttttaacatgaagggatgttgaatttcattgaaggccttttctgcatctattgagatagtcgtgttgttttatgtttagttctgtttatgtgatgaattacatttatagatttgcctgtgttgaaccaaccttgtatcccagggatgaagccatcttgatcgtggtgggccaagctatccttaacagtcttaagttcagtctttttacataatcccacatttcttgaaggttttgttgttcattcttttttgttcttttttctctattcttttcttcctgtcttgtatcagatagttttcaagctctgagattctttcctccacttggcctattctgctagtgatacttatggttgcattgtgaagttctcatgttgtgtttctcacctccatcaggtcagttatgttcctctctaaactgaatattctgcttatcagctactgtgttcttttatgatttttagcttcttgcattaagttagaacgtgcccctttagctcagtgaagtttgatattacccacctcctaaagcctacttttgtcaattcagccatctcagccttgggtcagttctgtgcccttgctggggaggtggtgttgtcatttagaggagaagaggcattctgcctttttgagttttcagcgtttttgtgttgatgctttctcatctttgtgggcttatctacctttgatctttgacgttgctgacctttgaatggggtttttgtggggtcttttttgttgatattgttgttgttgctttctgtttgttcttaacagtcagaccactctttcctagggctgctgtggttttctgggggtccactctggaccctagtcacctcagtctctcctgcacctggaggtatcaccggtgaaggctgcaaaacagcaaagatggcagcctgatccttcctctgggagtactatccaagtgggtaccgacttgacgtcagctggaacgctcctgtaggaggtgtctggagacccctgttgggaggcctcacccagtcaggggaaacaagatcaggaactgcttaaagaagcagtctggctgccctttggcagagcaggtgtgctgtgctgtgctgatccccgggagtctccagagccagcaggctggaaaggctcagccagctgaactggggagatagcagctacccctctccctggggacttcatcccagggagaaatcagagttctgtccatagaactctggctggagttgctaaaattccaatggggaggccctgtccagtgaggagggatgtgttttggtctcacttaaagaagcagcctggccacaatcaggcacagcagctgtgctgtgttatgggaaactcctcctggaccctggtgccagcaggctagagtggccaactcaaaccacagatatagtggctgcccttccctccaggaactcggtccatctctggctgtctccagcctgctgcctctggccagctggaattccaagccaatgggttttgtgaggtgctgtgggagtggggcctcagaatgatgtcacttggctccctggattcagcccccttcctaggggaatgcacagatgtatctcccactttgctggaattctcggggcataggatgcaaaactcctgggtttccacgcatgccccagtgagccagcgagcattccgccgagactccacacagctctgtgcttcagacccaaggccatggtggctgagctcaccgggggacctcccaatctgcaggttgcaaagatccgtggggaaagcatggtttcccaggcagtcacgcaatcactcaccgcctcccttggctgcgagtgggggctccctagctccgtgccacacctggatgggccatcaccccacttgcttttcctcactccctgtgggcctagtgggcctagtcagtcccaatgcaagaacctggatacctcaactcaaggtgcagaagtcacttgtagttttcattgctctccatgagagccatgggccacagctgcttctaatcggccagcttggccccatctaaagtatgatttcttaatacatgagatgttttaagtacatgacaataatgatatttatcacaaataatattttatctcaatttcatataaaaattgctaacaaatcaattatttttggttaccacaaagctatctggaaatgtaacatctgccatttataaaatttctgtagagttaatagaacttttcctgaagggaggccggcaatatgcatcatgaattcaagcactaccagtgaagttgtggagtttgaagtggtactcacatcttgttactgggattataaattcgtacaaactttatctaatgtgattaaacaatatataccaaaattatcagtggaaatactctctgattcagcaatttcatttccagaaatttaccctacagacatactcatgatgcctggaattatgtatgaatgggagaaagtattataccacctttttcattaacaaaagtctggaaatcaccttaatgtttatcagtcacattaatggttatcaccttactgtgtattgaaattatggttattcatacgatagcatactatgcagctatttaaaaaaataaattttaaaaggatgctcaaaaatgatgtccaatatatgttacaaagtaaaaacaaccctgggtgcagagccatgtgtctgatatgcctccattcctataaaatcagagtgtgtagaaatgcatagaatatctctattaactggtaactgttacaaaattcaaagttaatgcaggcaagacctttcttttttaatgctaacactccaaggaactgcacaacatttgaggattcccaacacatgccaatctacctttgaacctatagattttaggaaatgaggctcttgaaaaatcaagcattaatattcctagctacagttgtttgggacataattagaatgatccattctttgaaagtttgtaaaatttgctcatacaaccatctgggcctagtccttcctttgtgaaagattttattttactagagattttattttcttcacattatagtacttcttaggttttctatttcttcttgattcttgagtcaattttggtaccactttgtaccccacagggtgcttgggctcagaacacatcagtcaaagaaagagagaagaaaggaaggcaggaaggcagggtgaaaggaaggaaggaaggaagaaggaaggagacaaggaaagagagagaaggaaggatggagggagagaaagatggaaagagagaaagaaggaaatgagagagagagaaggagagaaggaaggaaggagggagagaaagggaaagaaggaaagaaacaaggaagcagggagggagagaaagaggaagggagaggaaggaaggagggagagaaagagggaaagggaaagaaggaaggaaagaaacaaggaagcagggagggagagaaagaggaagggagaggaaggagggagggagggaaaggagacagggagggagagagggagggagggaggaaaagaaagagagaaaggtgaaaggtggggacgggaagggaagaggagccagccaaaggctacaggctgtttgttcactcttctacttgacccaagcagttctgccttttaaatattccaccttctgccatgagttacactgttcaatattcatttctcagagcattcaaaggtctatgtgtgccctgccatgatggaccatggcttcagctctcaaacacaaccctcagccaaaatattcatgactgttccctcccatatactcatcaatcccccatgctatggtctgcatgtgtcccccagagctcacgtgttgaaaacttaatcctctatatgacagtgttgagaggcggggcctaataagagtgattaggttataagattctgcccccatgtatggattaatgtcattatctcaggagtgggttagttatcttgggagtgggcttgtattaaaagcatgttcagccccttttgctctctttctttcccaaactcttgctcttctgccttcagccatgagatgacacagccagaaggccctcacgagatgcagacccctcatccttggatttcctagcctccagaactctaagaaataaatttcttttctttatagattccctagtctgtggtattctgttatagcagcacaaaatgggttaagatgccccattacatggagagtgctgatccacagggttcagatcattgacttagggcttggagtcttatacaacatccctatgggagttgacctccatattccctatcttcccggaatcgcaaatggtgatttcagaccaaaatatagcccagatattttgcatttggcaatattgccgacttttccacaactttatcatggcaggtttgatgtgctcacttctatgatccctgaaaggatatgggttcaagatcctgcaaggttacaatccaaggatagaagagcctagacaagagtcccatcacctgggcgatcagtgcagagatatgtcacaaagcccctgtaggcagagcctagacaagagttacatcacctgggtgacaggcaaacaacaatgacaacttattttcatccccacttcagtctttgaggttagacagacctggattcaaatccaagctccacccctcgctgtgtgagtttgctcatgctgctaacctctctgagacttgactcttcatttatgaaatgaggataaagccccttctctcaggggctgtgccaaggatgaaatgagtcacgcattggtcaggacaggtgatgctgtgtaacaagcccctaaacctcagtggcgtcaacagcaaagttgacttcttttcttttttctattttttcttttgttgggggggtggggaggtggatggagtctcactctgtcacccgggctggagtgcagtggtgcaatctcagctcactgcaacctccacctcctgggttcaagtgattctcctgcctcagcctcctgagtagctggggctacagatgtcagccaccaggcccagctaattttttgtatttttagtagagatggggtttcaccatgttagtcaggatggtctcgatctcctgacctcatgatctgcctgcctcagcctcccaaagtgttgggattacaggcgtgagccactgcacccggccttgacttctcaattgatttcacatccatcacgggtcaacaagggggttctggtggtcgtagtcaatgagccgagaccatgccactgcactccagcctgagtgacagagtgagacttcatctcaaaaaaaaaaagtctcaggctatgtctgaactaggagggtagaaagaatagtcattttggttgccacaaaccatcgaaacaaagatgcagatcattgatgtaaaattacagttagttccttcccactccttttcagcttctcttcgttgctatgacccagcgtctcctgtgtcagttttcagtctattgtctcccagcttctagtgcacctttcaatatgtgcactgtgataaactgggaagcacttttcaatataccttctggaagtgaacattctgcaggcatctagatagaggatggagagactgcagggggcaggagctctctggctgggccttgttcaagccccaaccacagagacctaggcatggtccctcagccaccttgcagccttggctagcaacatctcgacacggaaaccaaaacgcagcagagcccatgtgatctgaaggttcctgaaaagttgcccagacctcctcttgtacccacatacaaagagtgtgtccagggtcatgagtgagcatgatattacagaggaatgtaaacaggaaaaccatagcatagagcagtggggatccatagctcacagtgatagcatggaagtttcctggttacatgaagtaattaagacgtatttaaaagccaagagtacaaaattagacctgatgaaaaagcaggagttatcatcccagccatgcagaaaagccaagccttctctcccttctcaagaaggaacagaagacaatgatgtgatctgtgagtcatgtgtaacatgaaagtacaggaaaagttgaatttctgatacacaaatctgaaaagtttttatagtaacagatttcaggattaaaagtcaatatttattacttcattaagagcaaataaatactttaagaaaaccttgttgttttaaccaaaatttttagttttgtatcactatgtttttaatattatacctaatttaaataaactttataaacaatctatctgatctcaatcagttttgacctcgaggtaagatttacgtaaacttttaataaccttgtataattttttccatcttttccaactttttatacacattttatctatcttttttattccttcaatttaaaataatccttaaaaatctctaagcgaatttactttctctgaaacaaaaaccggtatacattttgcatacagaattgtttctcttgtacctagtagtcttaatcacatatatctaccacaatattaatacttagtaacctttattttaataaaaaacctaggaagcaagaaatcttgaattgtcatatagcagtatcttacagatgagaataatttcataatttagaaatatgtgttcctaaaacatttttttttaagatggagtttcgctcttgttgcccaggctggagtgcaatggaacaatctcggctcactgcaacttccgccccccgggttcaagtaattctcctgcctcagcctcccgagcagctgggattacaggcacccgccaccatacctggctaattttttgtattttttagtagagatggggtttctccatgttggtcaggctggtcttgagctcctgaccttgggtgatccacctgcctcagcctcccaaagtgctgggattacaggcatgaggcaccacgcctgggctaaaacataagtttttaaattggaaataacccagatagttaatgagtatctattatttaatttaacataactaaaatttcaaaaataggctgggcatggtggctcacacctgtaatcccaacactttaggaggccaaggcaggagtatcatgagaccagcctgagcaaaatagtgagatgctaactctacaaaaaaaataaaaattagctgagcatggtggtgcatgcctgtaattacagctacttgggaggctgaggtgggaggatcccttgagggcaggaggtcaaggttgcagtgagctgtgatcataccactgtacttcagcctgggtgacagacagagacactatctcaaaaaaatttcaaaaatacattaagatgtcttggatagacatgtatccatttacatttacttatttttaacagtttatctagagtatttgtgagaactgaggtattagacaaagctagtcatcatttctaggttattttcttgttaaccatgttatagcctgtgaatatcaggtgttcacgtaagtgaggacttcaaagttaaatacatgggtattttaccaataactcagaaaattccattacttttgttcaacaaaccgtattaaattggtcttatgtattaaaaaaaatcacaaaaacaaatattcctttttttcctgtgtttatagctttataaccttcatgccaaaccctagcaccttaaaatatctagcaaatgtaaatataaaacacagtcaaaaatgtatgctgacaattctgaagacatttctattttccttttatccatactttttaaattatttgtatttataaaagaactcttttgtctgggcacagtggttcatgcctatatcccagcactttgagaggctgaggcaagaggatcacttgagctcaggagtttgagaccagcctgggcaacatagcgagaccgaatctctactaagaataagataaaaaattgccaggcatggtggtgcatgcctattgtcccagctactggagaggatgaggcaggaggatcacctgagcctgggaggttgaggtaacagtgagctctggtcccactactgcactccagcctggggaacagagtgagaccttagagagagaccttgtctcaaaaagagaaaaaaataaagaattatttcattcttttgtttttcttcagccaagtaaccttgaattggtaataccacagacagtaagtttcatctcaacaccagtagacaagtcagcagattcaaaataggcagggaaaaaaaaatagacaggcaaaagaactgagattttttcattttagggtttttaaaaatataaactatttgagttctgaattttctttcatgttattcggccatcaggtttaaagtgtgcactagaagccaggcgtggtggctcctgcctgtaatcccaacactttgggaggctgaggcaggtggatcacttgaggccaggagttcgagaccagcctggccaacatgacaaaaacccgtctctactgaaaatacaaaaattaactgggtgtggtggtgtgcacctgtagtcccagctactcgggaggctgaggcaggagaattgctcaaacctgggaggtggaggttgcagtgagccaagattgtaccactgtactccagcctgggaaacagagcaagactctgtgtcaaaaagaaaaaaaaaaaaaaaaaaaatatatatatatatatatatatatatatatatatatataggcctgtgcgcagtggctcatgcctgtaatcccagcagtttgggaggccgaggcgggtggatcacttgagatcaggagttcgagaccagcctggccaacatggtgaaacctcgtctctactaaaaccacaaaaattagccgggcatggtggcacacacctgtaatcgcagctactcaggaggctgagacaggagaatcactagaacctgggaagtggaggttgcagtcagccaagatcacaccactgcactccagcctgggcaacagagcaagactctgtctcaaaaaaatgtgtgtgtgtgtgactagaatggtctataatatatagccagctcgagtcccagaaaacctagcaagcttaaggttagagcttctcattttggccttttcaagattaaatctcctttagtaggcccctcccctctagggaagtacttgccggagcgctgcctaaagttggttttctgatgccctgttgtttctgttctgaatggtttatttctcattataagggctcagcaaagcaggcagagttaaaaagcagagacaggaagaatttttaaaatcgtggacttcactcctacactgaatctcaggtccccagaaagacagaaacaccatgggaccacagcaaaggcaggaggaggagtgagggagggaggtggacagaacaacaaacaggagttggctctcagtttttcacgtgtgccattttctttaggtttttctagtttatggagtctctttgttcaagttgagcacacagataaactagagatctcacaaggcttttgctgagaccatcaaagcctttaacctctgttgggccaaatattttagaccaaaaatacagatagacacacaaaagccagaaccagaccagattgagtatctcagtggctgcagcctttattccctttattctttaggatttgaactcaaaccagattcagggttctaacccaaccaggatccccctggggtgaaactgaaacccacagtctagacaaggttgggggtctttttttatttttattttttcattttttttgagacggagtttcactcttgttgcccaggctggagtgcaatggtgcaatatcgcctcactgcaacctccgcctctcgggtttaagcactcatcctgcctcagcctcccaagtagctgggattacaggcatgtgccaccacgcccatttaattttgtatttttagtagagacagggtttctccatgttggtcaagctggtctcgaactcccaacctcaggtgatccgcctgcctaagcctcccaaagtgttgggtttacaggcgtgagccaccacgcccggcccgcttgttcttttcatttcatcctgatgtccgaatacaggagagtagctgagttggtgttcactaacaagcacggaagctttgttacatttacagtgtcattcttggcaaaacctgaagttttgcctcccgggttcacgccattctcctgcctcagcctcccgagtagctgggactataggcgcccgccacctcacccagctaattttttgtatttttagtagacacggtgtttcaccgtgttagccaggatggtctcgatctcctgaccttgtgatccgcccacctcggcctcccagagtgctgggattacaggcgtgagccacgcgcccagccagaagctctgtaatttcaatgatgattgtgcttttaatctctttctcggcatctggctcatgataaagtttcaggtgtcttgatggtatctaaatcagttgttgattcggtcctggagaaacacaagcataacctctacgccaagttattattttacctatttcccaactttttgttattggatctgtccaccaaaccagttgttctgcttgtgtctttgcagctggtttctgtagatgctgttcagctgctggtaacatctggcctttgggaaggctcgaaaaatggaaagttaataatgcaagattcaattgtgtctgggctgtcccgtaatccctgtttccccccttttttgtttttattatcagttgttcatctgtatgaaatcgtaactgagcattttcaattaactgtgtggaatgaaccatgtatgaagaatcagaaatcacattaataggcatatcaaaagcagtcaatacctcaattacagctacaagctccactttttgagctgaaatatagggcgtctggaaaactttaccttttgatccagaataagaagctttaccattactggacccatctgtgaaacaatgaaaacgcttagcaggctgcaggttgtttactgcaggaattgtaaatgcaaatcgttcacagtcttgctcagctaaaagggtagtaaagaaacagtcttttaaatctgtgactattaaaggccaattttttggaattatagtaggagaaggcaatcctggctgttatatttccataggttgtataactgaattgatggctcttaagtcagttaacattctccatttacctgattttttcttaattatgaaaactggagaattccaaggggaaaatgttggagctatgtgcccattttctaattgttcagtaactaatttctctaaagcgtccagtttctctttgcttagcagccattattctatccatattggcttatctgttaaccatttgtaaaggtataggttctggaagcttaacaacggccgccgtcaaaaatgatatcctaatctttggcaggaactttgtctttccacttgaagcagttctttcaaaccttgcaaatattttcctagtcccataccaggaacatgccccatttcatgaattatatgtcgactttgagggctatataattgttctggaattagaacttgtgctccccattgttgtaataaatctctcccccataaatttataggtacagaagttataattggttgaatagtcccaggttgtccattgggcccttcacaatgcaaaatataactactttgatatacttcaggggctttaccaactccaactatgttaaattgagtgggttgaattggccacgcggacggccactgctgtagagaaataattgaaatgtctgctcctgtatctaccaaacctttaaagttctttccctgaatagttatttcacaggtaggacgtttatcagtaatttgatttacccaataagccactttgtcttgtttatttgtgcttccaaatcctcctgttcatttaatttcacttttccccattcccacatatggcacaatcaggagccgatctcctggctctgctttccagggaacagaagtagatataacaatttgaatttccccattgtgatctgaatcagtgactcctgtatgtatttgtaccccttttaaacttaaactagacctttctaaaagtaatcctatcgtccctgctggcaagggtccacagactcctgttgggaccttttgcaggggttccccaggcagagggctcacagcttttgtgcagcataaatctactgcaacactaccagctgtggcaggggacagacattgtacggtggggagggaatggcctgagttggaaatgccccggtttagaacgggcctaggatgggcccctcatggtgtttcccgaaatcgggttccgttcttcatcaaacttagagtgacattggttagcccaatgatttccttttttacattttggacatatttcagcttagcagttctcttttttcccctatctgacagccgactcactgattttttttctacattcttttttagtatgaatagcttctttaaattctttgagtaatttaaaaggaaaaggttcaaatgtagctataatatctccctgttgatctggggggtgtattctaacagggaactgccaagcctctaaatcaccctctcttctagcttgctgaattcctgcctgaatagaactaagagcagtcgctccaggcgctgctcagtcactggggcaactacttttcgcccacagtcctctggaaaagaaatacctggagggtcattttcttcaaaataataatgagggggtgcagaagggtagggatgaacctctccctcctttgccgcttcagctttagctggcaaacaaacctggtctgtaacctcttctgttacgtcgctatactctccttcctcctcctcatcagtgtgaaaaggttccaaggtgaaacgaaccagaccccacgcctgtcccattgttaccctgatgcttccgagctccccttcttactcaccacggggatggctttaagagtactcaggtgtcctccagctagttccacgttctccaaccgtcgctctggcgacccttcgacctggattcgagcccccacgatggacgccacttgcagagaccagctcggtcaggaagaccctaacccagcggcactagaggaattaaagacacatacacagaaatacagaggtgtgaagtgggaaatcaggggtctcacagccttcagagctgacagccccgaacagagatttacccacatatttagtaacagcaaaccagtcattagcattgtttctattaactaaaagtatcccttacgggaaatgaagggatgggccggaataaaggggtgggtttggctagttatctgcagcaggagcatgccctgatggcacagatcgctcatgctatgtttgtggtttgagaacgtctttcagcggttttccaccctgggcgggtcaggtgttccttgccctcattccggtaaacccacaaccttccagcgtgggcgttagggccattatgaacatgtcacagtgctgcagagattttgtttatggccagttttgtggccagtttatggccagattttggggggcctgttcccaacagtaaccaatattaagtcattctcatttcaacatttaaactcttccaactgaatgcattaaaaaacaaaagtcacacaccactgtaccccttatatgtacacagcggtcggcaaacatgtgacaggtggaggtcctgaggcaccactgggagcttgtgagcggatgggcgtcttccagaacgcactctgcaggcactcggcaacgtgaagtgttcacgtcctgtgatgcagcctctgctccaggccacttccggaactgcgagggaacagctgtgggcgcgctcatttcagctttgcttcagatcctgggagttgggggcaccttctttttttttttttttttttttagacggagtcttgctctgtcacccaggctggagtgcagtggcgcgatctcggctcactgcaagctccgcctcccgggttcacgccattctcctgcctcagcctcccgagtagctgggactacaggcgcccgccaccgtgcctggctaattttttgtatttttagtacagacggggtttcaccatgttagccaggatggtctcgatctcctgacctcgtgatccgcccatctcggcctcccataaagtgctgggattacaggcatgagccaccgcgcccggctgggggcaccttctggcccacagtgagggaataagcaaaccagaatggggggtgcctgcacggaatactcctaagtgctcagacacggcgtccacagatggatccaaatcagtgctggatgacgggcactcaccccaggtctgcagtccaataacacgggcctgagcagaaagcacgtggcatggagccccgtggcagatatggggacgagcggccaatacatcagctcaggtgtccgaggggtttcagggacatgagagagagtggggaacgaagggggaaatcgcttggagacccaggacgagcctggcacaccaggatgctgattctgaaagggcgattaaggagattccatgttttaaaaatctggatttctggcttcttctgaaaaaaatcagaagatgtttagcacaacagcgtggcatcgtcagctgtactcctgccccactgtcccccagggagcctggctcatcccatggctcacagaggcccacactgtggccagacaggtccactgatggctcagcacgtgcaccccggctgcagggagatgggtaccagcccaggaagtgggacactggctgaaacaggatgggatgcagggatggggtgggatgggagaccaaaccagtgtgaggaatgaggataaaggagatgctggagataaaatctgggcaagtaagcagggggtggtcctgctggctgaggccagagatgccagcccactcagactcctgcgctggcccttccacaccatcccaggcccaaggcctcccacacacagcgtcacatacacaaacagcaccctcctcatggcaacaggtgaccctgccccttcacagacctccctgcccccacagtcaccccacattttaaagggaacttgagtccatcctgatatgtaaacgtgaggttaaatatctatcatgggggagaacagacaaatctccagtgcagaatagttctaaataacctaagtggaggctccactcttgaggagatccagcctaactccccacctctccaacgcggctcatcgcagcgacctccttcttccaacgtggctcatcgcagtgacctccttctcaggagtgcagagtggaggtcagtggtggagtgaagacggaccagggttaacatcggcagtgatcacttgacctctgcacacttgactctgggtctttctccccaaaaaaaaccagaacctcagtataatcgtgaggaaaatagacaaatcctaattgagggacattctccaaaatacctgactggccctcctcaaaactgccaaggtcatggaaaaaggaaagtctgaaaaactcacagtttaggaacctaaagagacttgattactaaatggaatatatcctgggatcctggaaaagaaaaggacattatgtaaaaactaagaaaacctgaataaaatgtggcctttagttaataagaatccatcaatattggtgcattcgttgtaacaagtagttgtaacaagtgccacgctaatgtaacacgttagtaccagcgtaactgggtgccaggcgtttgtaaactctgttccgtcttctcaattgttttgtgaatctaaaaccgttctttaaaaagagtttatttagtaggctgggcatggtggctcacacctgcaatcccagcacttgggaaggccaagactggtggatcacttgagctcaggagttggagacatgcctaggtaacatggcaaaaccccatctctactaaaaatacaaaaattagccaggtgtggtggcgcacacctgtagtcgcagccacttgggaggttgaggtgggaggatcgctggagcctcggaggtcgaggtggtagtgagccaagattgcaccactgcactccagcccgggcaaccagagtgaaacgctgtgtccaaaaaataaaaaaagagtgtatgtaaagtgaaaacagagagagtacaagaaaagagggaaaccaggggctcagtggaggtgggcaggggctggtccatgtgcattcagcccacctggttggcagctgcccaggtgtctcctcaggtgtcggaacaggagtttcttccacagccttcagtttgctcaggtgggcatgtggcgatggcagacccttgggctgtgagaaactatgttgctgttttatccaagtcttcacagaccaaagacggggctttgcccagaggaggccttgagaagccaggctggagtttgtggagagagtgtgtgtcactcacaggacatatgacgcatttgcaacatgcgttctcaaagtgggagccacagcagtgttcgttttactattgctgggcctgtaaatggagcgttttatctttttcgtcagctggttcattgaacaagtgtttacagagcacctgctaggcaaatccatcgtgacagagactcggtgtgcccccaaggagctcacagtctagcggtaaagatggtgcataaactccctgacactcagggtggcaacagccaccccacctgctcctccctttcctaatgcccacacggagcagacactcgagggctgcttttaggagtgctgactacatgcttccctacctccatgtaggcatgtgtgtacacaagcgtgtcctgttttcaccttttcacaaaactatgtcaaaagtgaaacattttggaatacatttccagttatgcaaaatgtttaaaatatgaatttcttcggttaacacaaattaggcatgaaatgtaggcaaccctgtttaccaagaaacatcagggtgcggtgtgggtctgggaggtgcccatgagcacctcatcttgaggccagtcttcatgctagaccctgggtggagagagcgaggcggctggaggtgggtgtgtgacaccaggtgacttagcggccccaggagggtgacttcccctccggaggtgccatgcgactgtacagctcaggagcactcggggtcacctacaggaggggcaactcctgggtgtctcccaacagagcccaaaacctggaagtggacagagcaccccccgctcatctcctgggccctcgtctcagaggaaggacggccattctggccaacactgaccaatgctccagcccacactgccctgcactgcctagaaggagaacctaggctgggctcccagacaggagagaggggtgcgtttgtggggctaattaatagtaataataggccgggagcggtggctcatgcctgtaatcccagcactttgggaggccgaggtgggtggatcaccttagctcaggagttcaagaccagcctggccaacatggtgaaaccccgtctaaaaatgcaaaaaaactagctgggcgtggtggtgcctgtagtcccagctactcgggaggctgagacagaatcacatgaacccgggaggcggagcttgcagtgagccgagatcgcgccattgcacccagcctgggcaaccagagtgaaactctgtctcaaaaaaaaaaaaaaatcgtcataataataatcccccctcacctgagttctgggaggtcaatccaggttcaagattcctcctttgaaaggtagactggatttggatacagagggtgcccatgcgtgaggggacgagggggcccgggatgcgggtccgtgtgaggggctgaagagttgcccctgtgctagtcagtgccgccgccataaccgagccccgccggctgcgcggcgtcttcagcaagcgtttatttgctaattctgggggctggaggtccgcggtcacggtgtccacagactgacttctccagaggcctctccttggcttgtggacaccgtcttctccctaaatcctcatctcctcttcttatacattgtatcagggcccgccccatgaccccatttcaccttaatcgcctcgttaaagaccccatctccaaacaaccatattctgaggtcctgggggttagggcctcagcacaggaatttggggcggggggacacacactctgacttcgcaccacctccccaccactgcgtggtgtgtgctgcggtttagcttgtgtgactgtgatctttttcgtcaactggttcattgaacaagtgttcaacgggccctctaagaaagtaattaacgtcaaatgaggccctaagggtggggccctgatctgatagaattcgtgtccttataaaagaggcaccagagcacccactccctgtctccgacgtgtggggacagaacaggcggccatctgcaagccaggtaagagccctcgccaggaaaggcccagctcacaccttgaccctggacttccagcccctagaactgtgagaaaattaatttctgtttaacctacccagtctgtggtacagtcatctctcagtatctgtggggcactgattccaggatccccacagataccaaaatccacagatgttcaagtcccccagtgagccgtctgcatccatggaggcagccccagccttggagaccgactgtgtttccttagggcagccctaggcgcagcggtgcaaggagagccacatttacccctggcgctgcacggccctgaggctgggcaaggctgtccaccccgctgtcagaaccccagcagggaaggtgtccagaaggcagtcctgggaaccctgcacagaggcccagcgggcacaaggttggggcagctctgttcccagcaggccgagcccgggtggctggagagggagctctggaaggtcagcctaggggccgtcggcccctgcagaccctgtgcccagcccagcatcccggggagctccctccacatgctcatctcacgaggttcctgctgcactcagagtggaggatgggaggcctggggcggagggccggggctttggaatggctgagggggacaaggatgcacaaggggccagtgcagaggacagcgcgactcccaggggcccggggtcctggtcttcctggtcctgccgtttttattagaagcgagccctccaccccagtgggtgtagagcccaggacgcagcagagggtgggggggtggggggcggcatcggggcaggtggcaaccccttggacgcaggctcaggacgccagggtcagggcgtgagtgccggggccccctcaaagccgcggggtccaaagaggccgccggccccggccccgccctctgctcctcctccccctccaccgccaggcccgggtggccgccgcctcctccgaacgcggccgcctcctcctccgaacgtggcctcctccgaacgcggccgcctcctcctccgaacgcggccgcctcctcctccgaacgtggcctcctccgaacgtggccgcctcctcctccgaacgtggcctcctccgaacgcggccgccgcctcctccgaacgcggcctcctcctcctccgaacgcggccgcctcctcctccgaacgtggccgcctccgaacgtggccgccgcctcctccgaacgtggccgcttccgcagcgcccggcgcaggccgcactccgccaccagggggcgccacagctcctcgcgccgccgcctcccgcaaacacaaagagccgcgcggccacgacggccgcgtgcccggagcgccggggtctttcctgggctccaaagtcaagagctcacgttccgggaggatctgtccgcggaaattcggttctgagcgtcgccggactccgccgcggggaggcgggtgaggggagggggccggagggtcgggggtgccggggggtgcgggaaggctgcgggggaggctgttggggacgttcgtggcgggggaggctgttggggacgttcgtggcgggggaggctgttggggacgttcgtggcgggggaggctgttgggtcccctccccgccccaccgcgtcccagggaaccccggcagggcacccagtgaggggggcccgggcgtccgcccattcctcactgctgtccccgcctgtgcccgaaacccccgttcacgttcaccgagaaaacagacataaacccagccaggcacatccactagaatggctgtgatttcagaaaagcggacgtaagtgctgccgaggagatggaggcgttggaccccctcgcgcattgtcggggcgggtgcagccgcggtgcaaaaggaccttcctcagaaagttgagcacgaagttcccacaggcccggaagttcccctcccgggcgctccccagagagctgaagactgggcgcgtgccggcggcaaatgttcacagcaaagggcggcccagtgcgcagctggaacatcagccccaggcggtcgctgcgacagggacgagcctgggaaacgtgaaaatgtccagaacagggaatccacagataaagaaaagacatcgtggttgccagagctcgcgggagggggcaacagggaccgactgcttaacgtgtatggttccccttcagggtgaggacgtgttctgggacgaggtcgaggtcagggttgcaggacaagatgaaagcgctaaatgccactgaattgtttgctttaacgtcattaattttgttatgtgaatttcatctcaatagaataaataggtcaagctggctgcagggcccaccccaccgcggcctggagcagggtcttctggggtgtaccacctctgccctcacccaggctccaccacgaccagcttcgtccaccccccaggagaccatgaaggcccacgtctgaaatcctcactaagcccaccctcccatctccctgaactacgggtaggacccctctggcccccagccctgcccttgacccggcccaccaagcccccacccagatccacaccaccaggcactcttgcccttggcctgctgccaggctggccccgctccttctgggcctcctggagcttcaacccctgcctccacagcagaccttggcctttagcatgttcagtctcctcagtggcagccccgggagggccatcttcttgggtcaaagccctcctcactacccaccctcttgccaggactagctgtgtcctgcagcagcccagcatgtgccgttgagctggccttttctcaggcccagtgcccaaggaggagctgattgcataggctcagagtttccaggaagagtggggactcagatgtctgcccaggtgtctccaccgcgtccgccagggcctccagctttcctaaccaggaccctggcctctggccttggttgagtatttcaccttcttccatgtttagtcccttgggctctgctaccctcctgctggaggtgagagcatcctgtgtgcaaccagagatgccctctggctttcagacctgcctgcttttcaccctcagccctttctcactcagcaaaattgtgggggtccctagtcagcagctccctgggcagctctctgagcaaggtggtctctgtggtcatgaaggagagccggctaggacagtgccggaaactcagctgcctctccccttcaactcagctggccccccgcacctgaagtgcacaggagccgggaagagagtctggagcccaccccggagggcagcacaggaggtgtctctgcagctggtgtcctgccacccctgcaggcagcacacgtcccgggcattctccttagccacagacagaacagccagtgccagagtctgctgtcgcttcccctttaagcacactcattcaccacacccgaggaggccagaggtgcagggagcatgggctgtcgcttcccctttaagcacactcattcaccacacccgaggaggccagaagtgcagggagcatgggctgggtgcacctccgcaggagagaaggctgagccaccgccgtcccgggagcccggctcccaggcctctcgttttcccctacctccctaagacttttctgtcactctctggccattgaaaggcttctgttccttaaagtgctgttacactctcctttcccaggatgcagcaagccaaaacagtaccactgcacgtcagcctgggtgacagagtgagaccctatcttaaaaaaaaaaaaaattggctggacatgatggctcacgcctgtaatcccagcacttagggaagccaaagtgggcggatcatttgaggtcaggagttcaagaccagcctggccaacatggtgaaaccccatctctctactaaaaatacaaaaattagcatggtgtggtggtgcatgcccataatcccagctactggggaggctgaggtgaaagaattgcttgaacccaagaggtggaggttgcagtgagccgagatcacaccattgcactccagcctgggcaacagagggagactgtgtctcctaaaaaaaaaaaaaaaaaaaaaaaagtcttctttccatgatgagaatgtcaggccctgcagcctcttgcactggccagaggggctggggtcactgtctgtttccttgcccaccctcaagggacaaggaggagaggtgaggctgtgggcgcacctgattttacctgctggagtctgtgttctctgggattagggagcatctggagctgactcttcctccatgggaccctccctttttcaggaaaacttcccctcctcggggatcccgcagggctaagaaacaccctcttcacctccctcctgcccggtccttctgaccagccgagagagtacagaccctccccgatctgggaggagggcccatcactggctccctgccccctgctcgccaagccccccgggacttcccaggctgttccttccacctgaagggtctccctctggccaaggcgaggctcacagttcccctgtcaggatggggccttagacacccagactgacccagtgacaatcaccttaattctccacagataactacctacaagttttctgatttattcattagtggatttgttcgtgatcagccccacacctgttagaatggaagctgcaggcagcaggaaccagtgtggccaagtcggagggcagcacaagccggtcctcctcgtggacagcaggtgtggagcaggccaggcccacaggagggcgggcaggagggcaggcaccgagaggtgcggatggcctctcagaacaggggtgcaggctggtgggggcagcagctggaaggggaaggtcacagagccagaaagatagggtgtccgccacagccagttctttggaagtttccctgaaaaagggaaaagagacaagatatggttcaaaggaaagcagggcctgggagaggcctgtgtgcagtgtgtctgcaaagggaggaggaggcaaagatactgaaggtgaagagggaaaggaggaagggacaggggaggtgacagagggaggggagggggaggaggggcgggggagaggagggaaaagggggaggcgatgggacgggggagggaatgggggaacaggtgggaggggaggagggggtgggggagaggagacaggggagaggggagtagggggaggggatgaggggaaggtgggaggggagaggggaggggatgggggagggaatgaggggacaggtgggaggggagaggggacaagtgggaggggaagggatgggggagggatgaggggacaggtgggaggggagggaatgaggggcaggggggaagggagggatgaggggcaggggggaagggaggggggtttggccctgcagcaggtgggattctgctcagcccatttcctgggccacgggattcatgaagggcaccgggtcaggccccccgggcgcaccgttgctggtatatgcggtgatcggggtcaggcccccgggcgcacctttgctggtatatgcgggggtcggggtcaggcccccgggcgcaccgttgctggtatatgcgggggtcggggtcaggcccccgggcgcaccgttgctggtatatgcggtggtcggggtcaggccccccgggcgcactgttgctggtatatgcggtggtcggggtcaggcccccgggcgcacctttgctggtatatgcgggggtcggggtcaggcccccgggcgcaccgttgctggtatatgcgggggtcggggtcaggcccccgggcgttgctggtatatgcgggggtcggggtcaggcccccgggcgcaccgttgctggtatatgcggtggtcggggtcaggcccccgggcgcaccgttgctggtatatgcgggggtcggggtcaggcccccgggcgcaccgttgctggtatatgcggtggtcggggtcaggcccccgggcgcatctttgctggtatatgcggtggtcggggtcaggccccccgggcgcactgttgctggtatatgcggtggtcggggtcaggcccccgggcgcacctttgctggtatatgcgggggtcggggtcaggcccccgggcgcaccgttgctggtatatgcgggggtcggggtcaggcccccgggcgttgctggtatatgcggtggtcggggtcaggcccccgggcgcaccgttgctggtatatgcgggggtcggggtcaggcccccgggcgcaccgttgctggtatatgcggtggtcggggtcaggcccccgggcgcaccgttgctggtatatgcgggggtcggggtcaggcccccgggcgttgctggtatatgcgggggtcggggtcaggcccccgggcgcaccgttgctggtatatgcgggggttggggtcaggccccccgggcgcaccgttgctggtatatgcgggggtcgtttgtggtgtcatcactgctatcttccaggccgggaggaaggaccgagggtgggcccggcgcgggtgggggtcctgggcaggggcggcggcgcggccgggctggtcctggcgctgggacccgcagctgcgccctctgcctgagcagagaccggggcccccacgctccgcgccagcacccggccgcgccgcggagagggaagggttacggcggggatgggggtgggggggttggcgggggcgcgactgacgggctcgggattggctcggcgcgcgcgggacccgggggcagctgcgggcccagacttcccggacgccctggcgcctctgctgcccacggcggccccgaggccgcgcccgcggagaggggggcccccatctcctgtcagccgcagtgactgcgggtgcctgacggcgccgccagcccggggggcccctcccggccccagcggggtctcccggggctgcctctgtcggtcccgacctgcctggtccctggagctggggtgggagtcgtgctttgatcagtcaccgggggcggggagactggtcgaccacccctgagggcccgggacttgtttgccacacctggggagtttcgcggcggcatctggaggggtcctggttgagcagctaggggggtgtctggtaaccagccgggcccctcaggctccctcccggcaggccctgaacagacagccagggatggaactcgccccctgggcaccctgtgcctgccctcagcctccccactgaggcccaggactttagaggtgggcgtgcccgccaggctgccaggccgtccctccgtgggcagctgagcaggccacagtgtggaagaggctccagaaaacccagccctgccgctgcacacgtgcgtggccagcagataaagtcttccttgttattgtgggcagcgtagctgcacctgcggtgaggccggcactgctgaagagatgtcaattcacagagcttgactatgacccaaaggtgaggtcaggactccgggagaggatggcagcggtcttcaggggaaactctccttttcttctgtctggacactggagccacacactcgcctgtccccatcctcccacagcatagggctcctgggacctcggccctgggcaggatttgggggatggccacgtctctctgagtgggctctgctcatggtcctcacaaggcccgggacatggatgagaccaggcttgcgtcctctgcctccccgccccactgtggctgtgccagcctccctgacaggggctcttccgtccacgtgcccctcctgggccactatcccgttataaacaggcaggagtcttccttccagcctccctctggggcgggcaggcagcacggcgatcacctgcccccactccctcatctatcaccctgaactgtgttcacggtaaaattactcatcctcagccagtgataaatggcatcagtctagagccagcccgcggcagggggtggggctccctgctcagggttcccaggcctgggccagataaacctggtgagctgcgcctttgtgctcacacgcagctggcaatggcaagtcagtggatttgtacgtgtctgatgtgtgcccttggtaaaagcacacgtgtgcacgattctgtgtgcatgtgcttgcgggggctgggggctgagggaggccatctgggatgtggggtctggatgtggtggccagggtgggcgctaggcaggcagcagagtggagaaggtatgtcaccaggagaagggacccaaggaatcgaagagcagggggagccactgagtggggtgcagggaagatggggtgtctgggagctcagcctcgtgcagagggagggaagcaggcagctcctgggtgcacgggtggggcatactctctacagattcaatgctggatttgtatagtgtatagattttcaatagttatttaaaatcatcaaaaacaatcgtgtttacaatttactgggcagccactatatgctggtcaacatctagaatttatcaacaattgtacaagccaagtattttatcctcatttctacagaggataaaaccgagaataaggaactttacattgtcaatgatcaaacacctagtgcacccatggccgtgcgtccgcaggacaaagcagcctttggagccctggaacttaagatgtccagagatcagcagctctcggctcaggcccaggcagctggacagcacccagcgcctcctccaggtcctcctgggtcccctcctttctttcactttcagcccgggaatctctgtgaagtcctagctgataactaaggggttaatgaataatcacagtgatgagctctggaggagccatggcccagagcagctgtggcctcctttgattaaaccacagaagtccggaggatcaggcctcaaacctccaccacctgccagctggcacctgtgaaggaggtgggaccagcacccacctcacagtggctgcagggtcacctgagatggtgattgcaaagtgctgagccatcgggacacatatttccaagacctcctgagtgccggctggcccctggagcagagatgagacccctgtggggcctacagtccagttatgaaggcagggttcctgtgtaagccagcaggcccagttctggaaaggccaggatgtgggttcagaagctcaaggacaatggactcattctgactggagggatccaggaaggcttcgtggaggaagtggcatttgacattggcatcaaggatgaacaggaatagagagaggggactggtgtctgcgtgaaggatcgccaaagcgctgttctggggtgagggcgatcagcccctcctgcccctcctgaactatgaggctcgggagcctttggcagaaggtggctctgcacgccccaggtgcaagcttggagcttccttttctgcactccacagcaggaagaagggcagtgtgaactgctcaccactgtcttcctgggtttgcagctctgcgcctggcacagagacaggctcagtgacggttgaaggaatcggagaaataatgaaaagtgtgttcatcctgcaggcagcagagcctcgggttaaccgttaacgtcaggaaatgacagatccaacgctcctgcttggggcagcgtggaggccagcggaggaactgcaggagcctaaaggagatggcgcgcgggcctggctcaggagagcagccgtctgaaagatggcggcgaagggtgcgggaggagatgccccgggcaggggcttggcggggtctggcaccaaacttcccaaagcagctgcctctgtgaactgtgcctggcagggagggagccacaccgggagtgaccctagacgctggctccccaggggtgactggaggcagtgtctcccgcccatgtgggcctccggcttggggtccccagagctctgccctgctgctggctgcactgagagaggtggccttctgaatgggccctgtccccggggagcctctggtaaagagattcacctgcaccctcaaaacacgccatgcccattggaggctctgggtgcaggctgcccctcaaacagagaaaaaccacacgctgtttaagacccaaaccaaggagacagcccctcatgcccccttctatctccccttctgtccagggccccctgcctgctctggtccaccccgtcctgaccccctctgcctgttcatctgagggccgtgagccaaggcctgggcctggccaagggtcagggatcctgggacctgcttgagaccatgccccatacactccttcggccagaaggtcagccgtagagacaaacccccaccctgagcccgcagtgtcagcaacgccctgtcctcagtgccaggcagtgtcaggctgagacccgggccacctgatccaacgtccactccaagcaagccagagccaggtgctgccagcctgcccatgtgcacacgttagcagacaggtttcctggtgtggcacacacgtgttatgaccgcggctgctgcccccagcccagagtgcacttccgggtaatccagcaccctgaggcttcactgctctcctgagagttttctaagattaaatctccttcacaatgacagcctcctgtcacctgggccctggtgacaaagcctttggagaggcaaggacccagccggggcattcacagtgggcatgctatccaccctccgcccctgtcctggcccccacagtggagccgccaccttgggtaacaggggctgcctgaggtcctggagaaggaagaaccaggtggcccaccttcggtgcacagggaacagcagggacctgacggcagcccccgcacccctccctgggctgaagttcaggctgtctcatcccttgccaggagctcagggctgagctaggttggcaggggatgggttgagggtctgttgtccagcagattgcccgggccccacccaggccactcagaaaacacctgtgagagccccgcaggcatgcagggcactgtcgtgagcacaccagtggggacagacgtccaggcaggagggagcagccagacccccatcccgccagggtcaccaggtgagcaaggctggggaacaatggaggcggagccccgcgactgcccagctcactgcccccagtgtccaggctgtggtgcaggcgtggggacccaggtgtgttcaggggtctccttcagggaaggagaccaagctgggagtctggggaggctgaggtgtgaggtgacagcaggtaaagagtgagccacaatcagcattttcacatgaaaggaaactacaggcctgggcgcagtggctcacgcctgtaatcccggcactgtgggaggctgaggtgggaggatcacctgaggtcgggagttcgagaccagcctgaccaacatggagaaaccccatttctactaaaaaaaatacaaaattagctgggcatggtggcgcatgcctgtaatcctagctattcgggaggctgagacaggagaatcacttgaacccgggaggcggaggttatggagagccaagatcgcaccactgcaccccagcctgggcaacaagagtaaaactccgtctcaaaaaaaaaaaaaaaagaagaaagaaaaagaaaaaaagaaaggcaactacagaaggtgaggagaaccacccgagatcaccagagggaaccgtggaaggtccgtggtccaccagccaggctggggcacctcagcccctgggcagagcaccaagcagggccgtgccctggtaaaggagggcacagtcagccccagactacaagctgccttggtcctcccagcagggcttaaaagcaagaccccaaaggaccaaacagcttccaagtaacttcctggagtcctgagcaaagtaagcttttctcagctttgctacaaaaatagtcagcacccagcaaaattcacaatccctgtcacccattcaaaaatcaccaggcatgcgaggaagcaggaaaaggaaaatgcacccagaagagaaggagcacccatcaacggggccgcctcagaagcaacagacgaccgggcaagtccaagggcaccgaggcacctgccaccactgcgcccagcactcccgaagccagagggcaggtgggacataggtggggacgttctgagcaaaaacgcatgcggccaagctggggtcgcccgtgggaagagggcgaaacgcttgcacgtgggtagggcagtctctgcaaagggctgtgtgggctccgggaccagatgctgtgagggcctcaccagctgcgaggtggcaggaccagatgctgtaagggcctcaccagctgcaaggtggctgtctctgccccaccccacacgctcaatgcatgttaatttcatcttgtttcattctcattcccattttacagattgaggttcagagaagtcagaagccttcccaaggctgcacagccagaagtgggcacagcgtcctggggtgagggctcacaccatctgcgccacctgccctccaggtcccaccatcctcacaaattcaaggcaaggttctggaacccccagccctccagaaaggggaagctgagcccaggaagcacatctgagagttcgggtccgtgagtttaccctgcgctcacgccgattcctcctgcatcctctgtcgggatgtctggattccagagtccccaccctgattttccaaccttgcctcagccttggcttctcccttttggggtgggacagggaaccccagcagcaggtgtatgagggcatgagagggcaggaggtgccctatgcctacccgccagaccagggccccagccctggacacagggagagagcatgagcgctgttcctgctcccactccctcatctgagcaggtgctcccaggtacaggtgccgagtcccacccagaggggccctgccacaaccagaggactgacaaacccagacacaactgtctcttccccctggtcagggtctgggcaagggtccctctgggctgctgtccatgctgtgagtgtccgtgctgtgggccactgccgtgggtgtccgtgctgtggcctgctgtcgtgggtgtccgtgctgtggcccggtatgtgaggttgtgtttccaacagggagtaatttggctttggttacctgagggtctgaggacaggcactaaagccccacctttctggcttccagagttgccggctccagcagcagcctccaggcctgagcaggctctggggctcccacacctggggggccagggtgggggtgacaaagggccccaggcgacggctgagagccggccctgagccggccagggcgggcagcagaacagccaccagctcccgccaggccctggcagcatgagcgatggcaggcccagcgataagaaactaataatttatgcttccagctcccggggccggcgccgagggaaggttgggccacagcctcccccgcactgagcggctgcagtcctttattgcacaaattattaacgaccagagaatgaatgactctgtaatcagatcaggttgccagcacttttcattgcatttatttgtataaattctgaagtcggggtctgccctaagctcagcaagccagcgtcgtgctggctgggcgcccaggcccccacccagaaggaacacccgtccctcaccctgcccacgggttccagaggacagagggctcaggaaggggtgcagggaactgctctgagccagaagccgagttcataggcacccaaagcagccctgggccagggtcagagctctgtccttgaacctgcctcagggaagattcccaactgtcctcagagccaggggcacccagggcttgggagctgaaggggggtgggtctgagaccaggagaaggctccccagccctgagggaaccctcatcacccccctgctctcctcgatccaggaaccgtcccagggttgccccaggcctcctggctctcccgcctccatcccgtgggcttcccgggagccccaggctggtctcccacctgccccctccttttctggtcttgcctgggctgggcccaggggctctggctgtgggttttctgtgcagcacctcgcagtgagcctgacgctggtcctctcctgagcccccgtttaatcttattgacctctcgtt

SEQ ID NO: 442 - DNA, 339343 bp, Homo sapiens
tttgtttaatatattagatttgaccttcagcaaggtcaaagggagtccgaactagtctcaggcttcaacatcgaatacgccgcaggccccttcgccctattcttcatagccgaatacacaaacattattataataaacaccctcaccactacaatcttcctaggaacaacatataacgcactctcccctgaactctacacaacatattttgtcaccaagaccctacttctgacctccctgttcttatgaattcgaacagcatacccccgattccgctacgaccaactcatacacctcctatgaaaaaacttcctaccactcaccctagcattacttatatgatatgtctccatacccattacaatctccagcattccccctcaaacctaagaaatatgtctgataaaagagttactttgatagagtaaataataggagtttaaatccccttatttctaggactatgagaatcgaacccatccctgagaatccaaaattctccgtgccacctatcacaccccatcctaaagtaaggtcagctaaataagctatcgggcccataccccgaaaatgttggttatatccttcccgtactaattaatcccctggcccaacccgtcatctactctaccatctttgcaggcacactcatcacagcgctaagctcgcactgattttttacctgagtaggcctagaaataaacatgctagcttttattccagttctaaccaaaaaaataaaccctcgttccacagaagctgccatcaagtatttcctcacgcaagcaaccgcatccataatccttctaatagctatcctcttcaacaatatactctccggacaatgaaccataaccaataccaccaatcaatactcatcattaataatcataatggctatagcaataaaactaggaatagccccctttcacttctgagtcccagaggttacccaaggcacccctctgacatccggcctgctccttctcacatgacaaaaactagcccccatctcaatcatataccaaatttctccctcattaaacgtaagccttctcctcactctttcaatcttatccatcatggcaggcagttgaggtggattaaaccaaacccaactacgcaaaatcttagcatactcctcaattacccacataggatgaataacagcagttctaccgtacaaccctaacataaccattcttaatttaactatttatattatcctaactactaccgcattcctactactcaacttaaactccagcaccacaaccctactactatctcgcacctgaaacaagctaacatgactaacacccttaattccatccaccctcctctccctaggaggcctgcccccgctaaccggctttttgcccaaatgggccattatcgaagaattcacaaaaaacaatagcctcatcatccccaccatcatagccatcatcaccctccttaacctctacttctacctgcgcctaatctactccacctcaatcacactactccctatatctaacaacgtaaaaataaaatgacagtttgaacacacaaaacccaccccattcctccccacactcatcgcccttaccacactgctcctacctatctccccttttatgctaataatcttatagaaatttaggttaaatacagaccaagagccttcaaagccctcagtaagttgcaatacttaatttctgcaacagctaaggactgcaaaaccccactctgcatcaactgaacgcaaatcagccactttaattaagctaagcccttactagaccaatgggacttaaacccacaaacacttagttaacagctaagcaccctaatcaactggcttcaatctacttctcccgccgccgggaaaaaaggcgggagaagccccggcaggtttgaagctgcttcttcgaatttgcaattcaatatgaaaatcacctcagagctggtaaaaagaggcttaacccctgtctttagatttacagtccaatgcttcactcagccattttacctcacccccactgatgttcgccgaccgttgactattctctacaaaccacaaagacattggaacactatacctattattcggcgcatgagctggagtcctaggcacagctctaagcctccttattcgagccgaactgggccagccaggcaaccttctaggtaacgaccacatctacaacgttatcgtcacagcccatgcatttgtaataatcttcttcatagtaatacccatcataatcggaggctttggcaactgactagttcccctaataatcggtgcccccgatatggcgtttccccgcataaacaacataagcttctgactcttacccccctctctcctactcctgcttgcatctgctatagtggaggccggcgcaggaacaggttgaacagtctaccctcccttggcagggaactactcccaccctggagcctccgtagacctaaccatcttctccttacacctagcaggtatctcctctatcttaggagccatcaatttcatcacaacaattattaatataaaaccccctgccataacccaataccaaacgccccttttcgtctgatccgtcctaatcacagcagtcttacttctcctatctctcccagtcctagccgctggcatcactatactactaacagaccgtaacctcaacaccaccttcttcgacccagccggaggaggagaccccattctataccaacacctattctgatttttcggtcaccctgaagtttatattctcatcctaccaggcttcggaataatctcccatattgtaacttactactccgggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggatttatttttcttttcaccgtaggtggcctgactggcattgtattagcaaactcatcactagacatcgtactacacgacacgtactacgttgtagcccacttccactatgtcctatcaataggagctgtatttgccatcataggaggcttcattcactgatttcccctattctcaggctacaccctagaccaaacctacgccaaaatccatttcgctatcatattcatcggcgtaaatctaactttcttcccacaacactttctcggcctatccggaatgccccgacgttactcggactatcccgatgcatacaccacatgaaatatcctatcatctgtaggctcattcatttctctaacagcagtaatattaataattttcataatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaaaaagatattagaaaaaccatttcataactttgtcaaagttaaattataggctaaatcctatatatcttaatggcacatgcagcgcaagtaggtctacaagacgctacttcccctatcatagaagagcttatcatctttcatgatcacgccctcataatcattttccttatctgcttcctagtcctgtacgcccttttcctaacactcacaacaaaactaactaatactaacatctcagacgctcaggaaatagaaaccgtctgaactatcctgcccgccatcatcctagtccttatcgccctcccatccctacgcatcctttacataacagacgaggtcaacgatccctcctttaccatcaaatcaattggccatcaatggtactgaacctacgaatacaccgactacggcggactaatcttcaactcctacatacttcccccattattcctagaaccaggcgacctgcgactccttgacgttgacaatcgagtagtactcccggttgaagcccccattcgtataataattacatcacaagacgtcttacactcatgagctgtccccacattaggcttaaaaacagatgcaattcccggacgtctaaaccaaaccactttcactgctacacgaccaggggtatactacggccaatgctctgaaatctgtggagcaaaccagttttatgcccatcgtcctagaattaattcccctaaaaatctttgaaatagggcccgtatttaccctatagcaccccctctaccccctctagagcccactgtaaagctaacttagcattaaccttttaagttaaagattaagagaaccaacacctctttacagtgaaatgccccaactaaatactaccgtatgacccaccataattacccccatactccttacactattcctcatcacccaactaaaaatattaaatacaaattaccacctacctccctcaccaaagcccataaaaataaaaaactataacaaaccctgagaaccaaaatgaacgaaaatctgttcacttcattcattgcccccacaatcctaggcctacccgccgcagtactgatcattctatttccccctctattgatccccacctccaaatatctcatcaacaaccgactaattaccacccaacaatgactaatccaactaacctcaaaacaaatgatagccatacacaacactaagggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccctatactagttattatcgaaaccatcagcctactcattcaaccaatagccctggccgtacgcctaaccgctaacattactgcaggccacctactcatgcacctaattggaagcgccacactagcaatatcaactattaaccttccctctacacttatcatcttcacaattctaattctactgactatcctagaaatcgctgtcgccttaatccaagcctacgtttttacacttctagtaagcctctacctgcacgacaacacataatgacccaccaatcacatgcctatcatatagtaaaacccagcccatggcccctaacaggggccctctcagccctcctaatgacctccggcctagccatgtgatttcacttccactccacaaccctcctcatactaggcctactaaccaacacactaaccatataccaatgatggcgcgatgtaacacgagaaagcacataccaaggccaccacacaccacctgtccagaaaggccttcgatacgggataatcctatttattacctcagaagtttttttcttcgcaggatttttctgagccttttaccactccagcctagctcccaccccccaactagggggacactggcccccaacaggcatcaccccgctaaatcccctagaagtcccactcctaaacacatccgtattactcgcatcaggggtatcaatcacctgagctcaccatagtctaatagaaaacaaccgaaaccaaataattcaagcactgcttattacaattttactgggtctctattttaccctcctacaagcctcagagtacttcgaggttaaaatattagatatttcccctgatacagggctcaatctttttctttttaaagcaatatttctcaaagtacttttcacagaacttaagtttcattaagcacttcactaaaagaaaagtctgtgatctaataaatttggaaaatattgagaattagagccccctcttagatatgtactgtagctactcagcttgttacagatgaagtaaacattgtaatattcacccagcttttgagtgatgtctattaacatcacccaaatgagtattccatggaatgcactttgcaaaaacctattattcaagaaaattctggagcatgaaagctattaatgataaacccattcacaaaatcacaccaaatatctaaaatcatgtttaaaatctcctagaaatgggttgaattgcccacttcagagacaaagtgattcttttgtaataacgagttttgtttagtgagtacttattatctcattgaatcctgaggactacctcacaaggtaagtatagctcttttcattacacatgacaaacaaggctcagagaggttaagtaacttgctcaagatcacaaaactgcagagtgacaaaactagaattttgaatctaagctcaaaaggtcaccaaaccaaatttgggtccacccacccagcctatcaaagtcaagcactgatatcggcattgctgagacagaagttgaggaatttattgcaggcagcaagcaaggagtatcaggcagctaatccttaaggcctaatctccctgatggcttatgtgtaagggtttttaaaggtgggaaggcagaggttgcaggcaaggtcatacaatacatggaggctacatattggtttggccaaaaaaggcaaaatatctcaaagtgagggcccacaggataggtgaccattagatgaattcaaagattttctgatttgagaccaggtgcagtggttcacacctgtaatctcagcgctttgggaggccaaggtgggtggataacttgaggccaggagtttgagaccagccagaccaacatggcaaaacaccatctctactaaaaatacaaaaattatctgggcatggtggtgtgcacctgtaatcccagctactcaggaggctgaagcatgagaatcgtttgaacgtgggaggcagagggttcagtgagctgagatcgtgccactgcactccagcctgggcagcagagtgagactctgtctcaaacaaacaaacaaaaacccaaagattttctgatttgtgattggttaagttttggctacaaacttggggtcagcagaaaggaatgttctgctctggcctgtgggtgtgacttcctccaggtccctcaggaagaaatttagaacaaagaacagttgtgagtgttcagtcctcagttcctccttatctgagatctacgagccaacaggtggtattttccatttagcggggtctgggtttctacaaaacaactcagggacatatgttaagatgttatctctagtttctatagggaaacaaacattttgtggctctaattttctttttttttttaattatactttaagttttagggtacatgtgcacaacgtgcaggtctgttacgtatgtatacatgtaccatgttggtgtgctgcacccattaactcgtcatttaagattagtttgtggctctaattttcttgactattgttttaagctattattaccttcttacttatcagggtgctcatctacttcttgaggctagccaggtggctggaattttccttggagggactcaagagtttcctttatttttcatgccttaaatgggtctgttctccctcttcaaagctcaagctcttaaggactatgctattgttagatttttcgtattggagcagtccttccctcctactcaagaacaccccttcttcagacagcctggctgggtcttcatcctgggagagctcatgaaacacaaaccagatcttggccctcacgtgtgtctaggcagagctgagcctgggcaacaccaagcgtgcccccaattttgcatgccccagccaattcagagtcaagatccacgctcagctccttccctgcaaagtgctaatgatgaaggatggggatcaagtcagcaaactccagaaatggtcttagactaggagtcaagccttgagatcctattacacaccagattcattccctgattagagctgctgaattcttttactctcactgcactcatgctaaagtttctttcctccagcctcataaccccagaggaggctgagccatgatacccattgtctagcaataaatatttaaggagcccctgagatatgtcaggcaccatcgcaggtgctgggacaagtgaatgtgaccaggaaagtccctcccctctcagaggttcttttcaagttggaggacagcaaatacagaaatatagagtctaacataacaacagggagtaataaacactttgaagaaaaataaagtggaataagagggtagggttgccatagggttctctgggcagtcttctatggaaaggccacttgttggggcagagaaaaaaaagatgtctgaaaggaggactaccggccccccataagtgcgctccggtccatgcacagggcaatgggcatgtaatttcctatgattaagacctacagtatgtacaatattactgcaacagacactgagactgacttagcattgtttcatagcatccgagttgctctgttggaggaaagtgcatgtgatgggcattcatttgcttccgccatcagacagattctctacctttgtctttcctacaagattccctaggaaggcagggctcagtggctcatgcctgtaagcccagcaatttgggagtctgaggcagtcagatcacaaggtcaggagttcaagaccagcttggccaacatggcgaaaccccgtctctactaaaaatacaaaaattagctgggcatgggggcacgtgcctgtaatcccagctactcaggaggctgaggcaggagaattgcttgaacagagacccgggaggcagaggttgcagtgagccaagatcgcaccactgcactccagcctgggctacagagtgagactctgataaataaataataaataaataaatgattccctaggaagctgactcccactgaatgtgccactcaggagtccctgctctctagattacagttgagtttgctcaatgcaaggccccagcagaaatgttgaaagtaagagcaaatagatagttaaccactctttaagacaacaatggatgtatacttctctggcctcagctcctgtggggaagctccagtgccagtccctgggtgcttcaccattttccgttagttcctgaaccttgtaaactgacccttcactaaattcttcctagttaaccctttgagaatgaaaccatttcctgccaggactctgacagatacaaagaacccacagccgactgctgggtgcgcggcagacctagtgcatggctccacactgccatcttgggggctggcacaggctggcactgagtctggggaagggagctggggctggaggtgtggaggggaagaccgtgcatagttgcttcctgatcagctctttattcgattgagagtgaggcagggaagattagagggaagcttacagtggaattcagggctgaggctgctattcttttgctccttgtaacttcctacagtgttgtcagcatccacatacttctctgtggggttggtctcagagccaggttaccttgtcttaggtccagtggcagcctgactggcttggtgtccttgaacaagttacctaacctctccatacctcagtccctcagctgtaaaatttttttaaaaaaaaagaagaagagtacctactgtatagcattgatttgaagattgaatgagctggtattatacaacgtttagaagcagtgcctgacatgcaaaaggctctcaacaaatactatcctttactaatatcctgtgtgtctgtatcagagctggtggggtggagggacagaaagaagtaggagaaggtaaagagatgggaaaatgatctctaaagtctctctggcactaacacaattctttattatgtgttttgtctggctctttatattgatagctgttccagaagcaatcaatagctattagtcggttttattcttatttttctgtctgatcttacaggggagcaaactgtggcaaagcatgaacttacttctcagaaaattaaccattatgttggcaatcactgtgattatttgaacttcagcatctggacaaatttagtcacatgaaatacagaagagagatttctcatggttaaaatgaagctctctttatttgcttctgctaattaaaaaatcagagctaaagatacttaaacactacagttaaaatgccatggttgtctattggcttaatgaattctcttatgaaatcaactctaaaatgttatccatcataaatcatgaaacacaatttttcttattctctttagagctttacaattcatcttaaagaccagtgtttacactctcttccgtaggttgtacaataacctttggcgagaaaaaataaatgtctggctttctgactcataggtgtgttccctttaacagaaaaagaaaatatgtcctctttaaaactgatgatcattggtcacctcaattttattgaagttcacttctgacctctttagatgtagttctctacataaaactgcccaacagaattctctgtctgaatgcctcctccacaaacaaaattttaagaactaaaatcatcatctttccttccaaatgtgctctccctatgtccccagggctctccatgtgtagagctgagaccatttgccactcagtttcctcacccaattaattacaagtcccaacaattttccgttgtttttttttttttagacggagtcttgctctgtcaccaggctggtgtgcggtggtgcaatctcagctcactgcaacctccactgcctgggttcaagcgattctcctgcctcagcttcccaagtagctgggattataggtgtgtgccactacatccagataatttttgtatttttagtagagaggggatttcaccatattggcccagatgatctcaatctcttgacctcatgatctgcccaccttggcctcccaaagtgctgggattacaggcgtgagccaccatccctggcccagttttgcctttttaacatccctcagctcttcaaatccattttctcttctctaacacctccccattccccagctcgtaatgaactcttaagtagattactacgatcacctcccaaatggtcttcctggctccatcagccttgtgaccttcaagttcattctccacatggatgtcagagtaactttctaaaatgaaaatctgaccacgttactctcttgcctaaatccgcctatggccgctgttaggatcaagtctaaactcccgaccctggaacatcaggtctttgtgctctgttcagtgcttctctacctcacctgcaaccaacaccactcccacatccatattctgctcaccgtgtatcaacatgaacaggaggtgggtgcttcagtccccaggaagacactgggccttttcaatcatctactgctgtgtaataaccaccctgcaaactgaccacatgatttcattttgcaagggttccttccttgggctgtgttcagcaaaagggtttactgagctggcaggtccaagatggcctcactcacaggactggctgttgatgggagccttgatgctcttgggctcaccccttatcctccagtaggttagagcttcttacagtggtttcaggcagcatctgaagacagtaaatgcagaagctccaaggcttcttacattctagcctggaaaatcacatcacattgcttccttcatatttttttggcaaatcaggttgcaaggcttgcccagattagggtaaagaggcaaagaggctccttttcttttctttttcttttttttttttttgagtcagaatcttgctctgttgcccaggctggagtgcagtggcgcgatctaggctcactgcaagctctgcctcctgggttcacgccattcccctgcctcaggctcccaagtagctgagactacaggcacctaccaccacgcctggctaatttttttttttttttgtattttttggtagagactgtgtttcactgtgttaggcaggatggtctccatctcctgacctcgtgatctgcctgccttggcctcccaaagtgctgggattacaggcgtgagccaccgtgcctgaccaagaggctccttttcttgatgaaaggagtagtgaagtcacattgcatgtccttgcaaagggacatgcagaccacattagtgagaatatgtgcctgtattttgcaatctgtaacatgggcataaactaaatgttttccaaagggaatagggcaaaacaaaaaggaccttgaccactcctttggccctgaataaatctaggaagcctaagagtatgactatcctgaggtagaaagagggtcacatgctggataagaggtacctgggctctccacttacaagaagagagcatggttacatttataatcaccattcccaacacgctgtgagtgcaggcagctaccaggaggagaacaaaggaaataaccaggacacccatctctaaacctgttaatttaatcacacggaacacttctatttaaaattcccgagggttaagatgtaagaatgcttatcaaggtaaatgctgttcacactgcttggagtgtcaggcctagatctctatccatcagaaacaacaatatcaataacaacaacagcaacatgatgatggggcaatttctgaaaagcaccatgtattttatcgatacatgtccgttgcagaaaatccaggtgaatccaaagaagaaataaatgtcttccacaatcccatagcccagagctaactaaccactataaagaacccagcgtggttttaactaatggatcaaaagatgctcatcaaaggctctgagctttcctgagtgctaacaggaaacatccagcatcactggtctctccaaggctgcaggtgtctttgcccatagtgcctgttttgtgtcagggaaagaatcaacctgggagccaagcccaggaatcaggatgaccaagacatactggacaaggagggaacaaacccatccaaggacactcaaggacaaatcaagcaaatgaatttaagggagacctgctcatggtctgctttgctgctcagcatggctgggaggcacagtggaagatcatgcatccttcccctgggactcctctgccagagcctgagagctttctcctgcacacaggctaggggtagggcagttggaattgatccatgccttctagctagactgtgggtcccctcagtcttgggcatggtgacagcccagcatcagacagaggtcagtatcaaactagaaaatttaataaatgctgtcagatttgtagacccaagaaaatataaactgccaatcacggaggaaaaaaatctctcaatgatcttatctttatatgattcccttgctgcctggagattgacatttccttggggataatctggtcataggattggtgaaggtggaagggaggcaacctccgaaggtggggccctctgctcacctgggacagggagggcctgaggtaggtgtctgtgtgggctggggaggaggatgggagcagtgcttctagatgtttccactttctcctcattagataataatgaatgggtgatttccctagtcactgcagtgtgaggaaatctacaaaattaatttcacaatacactttacaggataggtggagaaacacatgaagcacaactgcagtgggttataaaaaatggcctttcgagttgagcagtaaattcgttcaagcagccattctgaaggacaaactggctctgtatttaacaggggcattccagcacttctctagctactgggttgacaatgactcaccaaagcctctggtagccaccacaggacgcccagagcacgttttaaagctgaacaccaaactgcggacttcgggagtaagtgaactgactggtttttattttgttttactgcttttaacattacagtaactgttacaggttccagcaggataactgggtggaaatgagtttggtttcacttagtctctctaaagagaaagcaagttggtagactaatacctaataaaagcaaagctgccaacaattgaaattgcctggactgctctgtgtgtcccacatgcatgggtgtgggtgccagtgtgtgtgcgtgtgtgcatgcatgtgcatgtgtgttgggatagagtggtaagaaaatgggaaataataagaatgttcagtccatagcccttcattataaaaaggtgagctgtaataaatactagtgccacatttagccaaaactttactccagccaaaggtgatattttcatgataacatcctgtgattgctttgttcttcgtcttttatgttcttcctagatgggctcagaacatacaagaattaagtacacatcttattttccagtgataatgctaccggcaaattctgttgtttgtataaacatcagccatgtttatataactaaactagtgttttgttttgtcaattcagcaagaaattagaccacatggtggcttaatgctgcattgatttggctatcaatttgttttcacttttctgcaaaatatttaatacattattaaattgaattatgctgatgccacagttgttcttatctcaattgtcttaaaattcatttaatttttttttcctttggtttcattattcaaattttaacttcagttctcaacattttatctgatggaagagatggagtccattactaaggactccattgtgctccatcatgccagagttgtaaaatagatcttttaaaggaaatttactgtgatttttttctatttaagagcttcctctccagttgagcatgtaagaaaattataccaggagaatacagtaaactctatgaggcaagctataaacatgtagcattgtgattagggctggttctccttctagagacatggtaggattgcaatttcataccatccttgaagttagagagagccacgtgactcatttagccaatgaactgtgagcagaatgacatgtcacttccagcagaagctttaagaatctgagagacattcatacgttttccatgtgctgtagccttatacccaaagcctgggtcccaagtgaccatgacaggcagagctccctgttgagccacagagatttagagaatggctgttaacacagcataatccagcccatcctgactaatctgatattaacatgtataataaagaattctatcaatgctgagggaagatgattagttaaggtcctaggttgcaagtctcaaaacctcttctaaggattgtagacaggaaattaaatgacttctagtccctagagttcccaatctcctaccatcccatcctaatatgacagaagtaattcctgagttgcttctgaaaccagagcttccctcagaacccttagcctgccagatggcttcttggagagccctcactcacttttctccttctgctattgctgctcattcattccagcttttaaaaattcatctttatccaggaacctcgcttctagaaaagtcatacaggtgcttccaggaggctacatgggcacccatatttttctagccactttcattagaccaatgcagcagagaagaaaagcctcaataattattatgacatggcatgttaggataccaggtaaattgcatttgtaaaatgtgattttctgttggtgttcacttcggctctactgacatttggtaagtattattgactgactgactaactaatgtggtcattagtcttcataaagaaaggctctctacaaaaacggagggatgccctttttctggcatttaatacgtaagaaattgcctccgatagaaaccagagttgcctgattactatcagcacaggagaaatgtattaatgtgcctttctagtaacaggtttttagaaagtcaaatataaacaaatctgtctatttgtgtgtgtgcatgtggtagtggggagggaagaaaaaaggagggggagagaaagagaaataagaaccaagtttattatactgtattcagggggaaaacattttcccaaggttctaacagaagagcaaagtgccactgtcaatagcctcagtagtgtgagggttgcttttatgtatttatttatttacttatttatttatttttcctttttttttcctttctctttttttcttctttttttttttttggacagagtctcacactgtcgcctgggctggagtgcattagcgcaatcttgactcactgcaacttctgcctcccaggttcaagtgattctcctgcctcagccgcccaagtagctgggattacaggtgtctgccaccgtgcctagataatttttttatatttttagtagagatgaggtttcactatgttggccacgctggtctcaaactcctgacctcatgatccacccacgttggcctcccaaagtgctgggattacaggcgtgagccaccgcccctggccaggattgcttttatagccagtcttcaggtgcccactgtaggaacaatgtcatttagccctcgggattattctgtgccaaatatggataatgactaatattcaacacagatattctcagctcagaagagcaattagcaaattcataaattaagtgcttgcttcctttttagtcaaatacaaacatttgttaaaagatattattttgctttacactttgtctctcagaaataaacagatgcttgaattcccacagtgctgcttgagcctcacaccatgtcatcctgccaggcacccagatccagttctagagtttcacatgatcatgagtgttggttaataagtcactgtgaactgggaggggagatttttcaggagtgccacagggctctccctttaatcacatacactccctgctttcattggaaagtgtataatgatgtcagagtgccccagaatggagctagttggaagactgccgtcatagggatgccttagtgaatcaatcaggttttaatttctggctctcaactttgtagatgtaaaagttgatttatcaatatgtgagaaaggatgaatctttctgaaggttatgtcatcacactcactaagcacacagagaataatgtctagaatctgagtgccatgttatcaaattatactgagactcttgcagtcacacgggctgacatgtaagcattgccatgcctagtacagactctccctgcagatgaaattatatgggatgctaaattataatcagaacaatgtttggtgagccaaaactacaacaagggaagctaattggatgaatttataaaaatatacctcagccaaaatagcttaattcagtctcccttatcataaggatactcttgcctaaagggacagtaatattaaagacactgggaataacctctgtactttggacagtagacctgcatagcccattaggcctcaatgaagtcttatgcaagaccagaagccaatttgccattttaaggtgattctccatgtttctgctctaactgtgcttcacaatactcaagacactgaatcaggatgtttcctggagtgcagggagctgtccgtgttactgagcagttctcagcaacacaaagatcctactgactcctcatcagacttctttctcactggaattttacacctgggctgttaacaccaggccaggtcaaattcaaaggagagaaaaaagctcattatgaagggtaaaatccaaaacactgtgcataaagatatgtgtgcacaatttttatacataaagatttcataaagccaaagcatcaggaaatgaaaagagatacagaaagaaaaatgatggtaaatgagacattaatttacccttctaatctctatcacagcaaaaaggtaattaaaaaatctatatgaggaccaaaaaatacacaaagattatgtagcaaagcctatagcctaaaaaagtaaacattgaaatttgtatgtccataaaatgtttacaaaattcagtacatattacacaccccaccctaaaaacatctaagcaaagtagagaatgtagaaatgctacagattatattctctgattatgacacgacaaaactagaaattacagcatggaaatttaaaagctttctcttaaataattctatgtcaaaaagaaatccaggccgggtacagtggctcatgcctgtaattccagtactttgggaggccaaggtgggcaggtcacttgaggtcaggagttcaagaccagcctcgtcaacatggcgacaccctgtctctactaaaaatacaaaaattagctgggcctggtggcgcatgcctgtaatcccagctacttaggaggctgaggcaggagaattccttgaacccagaaggtggaggttgcagtgagctgagattgcaccactgcactccagcctaggtgacacagcaagactctgtcaaaaaaaaaaaaaaaaaagaaatccaaataaaatttccagaatatgtggaaaatagtgacaataaaaatattacacatgtgtaatcccagcattttgagatgccaaggtggcaggatcacttgagaccaggagttcgcaaccagcctggacaacatagggagactccatctccacacacgccaaaaaaaaattttaaatagccaggtatagtggtacttcttgtaatcccatctacttgggaggctaaggtgggagaatcacccaacctcaggagttcagggcttcagcaagccatgatcatatcactgcactccagcctcagcaacagagcaagatcctatctcaaaaaaaaaaaaaaaaaatcacatgtgggaaatagctatagcacaataaaaataaatgtattaagtatgaacaacaaaaaagctagtaaaggttgaacaacaactatccttaggaaagtggaaataatgtgttaataaatatgaaagcaggctaggcacggtgactcacatctgtaatcccagcactttgggaggctgaggcaggcagatcacctgaggtcaggagttccagaccagcctggccaacatggtgaaatcttgtctctcctacaaatacaaaaactagccaggcttggttgcgcactcctgtaattccagctacttgggaggctgaggcaggagaatctcttgaacctgagaggcagaggttgcagtgagccaagatcatgccactgcactccaactggggcaacagagtgacactccatctcaaaataaataaataagaaagcagaaactaataaattagaaaacagaaacatagaactaatttataaatcaaagcactatgccttgaaaagagggagaaaaattgtgaattaaggaagggaagagatggttggagaggaggtgggagaaggcagagataattgaaggagcaaaagcatctggagaagcaaagccactgaaagatgaacagggctctgaaagaaatgcttgattgctatcttttcaaatgactgcagttcccagtgacatcatttttctcctccctggaagtctgaggggcagttcacttatctcctcccctcccctactcctcaccccacactcaaaacctgtctatgctcctttcattctcatatgacagatttcagatggcattcttatttccctgatttctttttgagatagcttgcatttccctactctatataaagccaccgtttatcaaatgcctacatggaccaagcagtccacaagggcttcacagacagttttactaaactcatgccaaaactttcaggttttatagataaagatctataccttatagataaaggtatctataaggtatagataaaggtaaggtatctataccttatagataaagaaattgaagcttatagagtttaagtaatgttcccaaagcctcgtggctagtaattcaaacctaatttctgcctactccaaagtctatttttcctcatgatactatactgcctctccatggataaagacagagatcacatattaataaaatttgcacaaagtcggcaaattgttgaaagggaaggctaagatgattaataaaatcaagagccagatgatctcaacaacctgaaataactggctgacaaccaatttgaataactccctgcgggtgaagttcaaagtactatttggggtttttttttaagtttggctgggtgcagcggctcacgcctgtaatccaagcacttagggaagccaaggtgggtggatcatgaagtcaggagttgaagaccagcccggtcaacatggtgaaaccccatctctactaaaaataaaaaattagccgggcctgctggtggatgcctgtagtcccagctactcgggaggctaaggcaggagaatcgcttgaacccaggaggtggaggttgcagggagccgagatcgcaccactgcactccagcctgggtgacagggcgagattccgtctcaaaaaataaaataaaataaaataaaaaataaaagtttgatatattcagaatcagggaggtctgttgggtgcagttcatttgaaaaattcctcagcattttagtgatctgtatggtccctctatccgtcagggtcctagcaggaaattgttgcactctcaaaggattaagcagaaagagtttaatgaagggtctctttccagggttaagggaactgctagggtttggatatttgaccactccaaactcatgttgaaatgtgatccccattgttggaggtggggcctaatgggaggtgttttggtcctgagtgtggacctctcacgaatgtcttggtgccatccaagtgagttcttgctcgctctttttttctttttgagatgtagtttcactcttgctgcccaggttggaatgtagtggtgcgatcttggctcactgcaacatccacctcacgggttcaacccattctcctgtgtcagcctccagagtagctaggattacaggtacccaccactatgcccagctaatttttggtatttttagtagagacggggtttcaccatgttggccaggctggtctcaaactcctgacctcaggtgatccacctgcctcggcctcccaaagtgctgggattacaggcgtaagccaccgtgcctacctagttctagctctcttaattcccacaagagctggttgttaacaagagcctggtacaaacccctctctcttgccacgtgatctctgcacatgccagcttcccttccccttctgccatgagtggaaacagactaaagccctcaccagaagcaaatggtggcaccatgcttcttgcacaccttcagaactgtgaaccaaataaacctctcttctttaaaattattcagcctctggtattcctttataacaacacacacacacacacacacacacacacacacacacacacgcaaaagcagactaaaacaggaactaattagaaatggtaatgcaccgagggattggcaccgaggctccccaacaggaactgaggccatggatagaaggacacattcatgttatttttttctaatggttaagtaattatttgctcttactctcaaaatttctgccaaggcctcccatggaccaaactcaactaggatctaggaagcagagaacctgagtgttgcattcagcagaagtcagcttcctagggaatattgcaggaagggtgaaggtagagaatctggtggggaagcaagcaaatgcccatcacatgcactttcctccaacagagcgactcagatgctataaaacttgctaacgcagtctcagggtctgatcacagtaacatacaagccaggttttagtcatcagaaatcgcagtcctattgtcttctgcacagacccaaacacacttggaggtcatgttcaatatgaatacctcacagagaaggaaatttacacacgagaagtacatctgcagaaagccagctggcatgtcaaccattcgaaaactcagggtgttcgggataaagaagactcaggaagacaagtatgaagcataatctgtgacattattgatatcttcctgatatcaatattattgatatcttcctgaagaacataattcctgcctaccatcaacaagcatcaatactttctaccagctattctcaaccctcatcatcggaagagacagacactgactgtgtcaaagtattagtcccatcattcagcaattaactttagctcaatgcttcaaaaattcttcaggccctgtgtaatttcagctatgtacattaatgatgagtacccatacaaccattctgtttcttattttcagtaccatatttaataaatatcagttattcaatactttatttagacattttgttagattattttgaccaatgaagtctaatctaaatgttctgagcatgttcaaagtaagctaggctaacctataatttttggtgtgctaaatgcatttttaacttatgatattttcagtttacgggggtttgttgggacataacttcatcatacatcaaggagcatctgtatatgggatatagttaaagcagtgatcagaggaaaatctatagccttaacacatttattaataaaagtgtaggaattaaattatcagctgaaaaatgtaaaaagtatctaaaagagtaagcagaaagtacaagaaagaacccatagtagaaaaaagtgaaaattaataaaataagaagccaaaaaacagatcaaatcagtaaaccaaaaatcttgttctttaaacaaatcaacaaagttgacaaaaaattagatcttttaatcatgaataaaaaaagagaaagcacaaaaatgaataaggaatggtgagagaaataactattgataatcagcaaataaaaaatcattaaaaacaatgttgttcacatctatgaaaaacattgaaagctagagggaatgggtaattttccagaaaaatacaattcaccacaattgacttcaaaaaaaaaaaaaaaaagaagtacagcacttatgtgagcaatttccatagagaaatacagttgtcatggaattataacacacacacaaacactaggtttagatgttttcacagagaattccaccaaacctttagaaatcagatcatccaaaggcaaattaacaaccctcagccatttgaggcaaaatattacaattgaggcaagatatactgtactgaaaacttgaggaaaaagcaggagagaaagttcctttgggaaattcgaatactcaaaagtgcttacatacaatgaaaaatttggaaatccataagcatggccaaggtgggacacatgctcagaaaaggcctgagaagacactaataactcacctttagtaattcctaggctcacagcaagaaaaaatgaaggctaaggcagaattatatatggctccgctaagtgttgagggagccccaatacagagtcagtaagcaaagtctgggagatgtttttcatatttttttcttttttggctccttgcagtcaaggaaatcatttttaaatcactaaatgctaaatgaacacaagctaaaggaaccgagccgccttcaaacatcaaacataaaaaagaatgcagatattacaaaaccagtttacaaaagttactaaacaaataaaaactacatcccacagtgggtaacaaaaataaccttgaagaagggaaaaatttggtttccagaataaacacattataatatccaaaatgtccagttttcaacaaaaattaagaagcatgcaaataaacacaaaactatggcccatttacagaagaaataaatgagactctccctgagtaagcagatattggaaatattagacaaaaactttatataactgtcttaaataaacttaaagagctaaagaaacccaagagaatgacatataaataaataagaaatatgaattttttaaaaggtacaaaaaaattctgaggctgaaaagtacaataactaattaaaaagttactttttacttagggttccaatagaagatttgagcagctggaaaaaagaatcagtgaacttgatagatcaagtgaaatgattcagtctgaagagcaggaaaatgaaagaatgacaacaaaaaagaatagagcctaaagacctgtgtaacaacatcaagaatgcctacatacagaatcctggtggggagtgaggggcaggaagactatttgaagaaatgtgtttgaaagcttcccaaatttcactaaaaacaaatatatacattcaaaaagctcagtgcacttcatcaaggaaatatacaaagatattcacaccaagacacactatgtttcaaattgtcaaaaggcaaagcgaatgtttgaaagcagcaagagaaaggcaacgcgtcatttacaaaggatcctcaataagtttgacagcagatagtgcattataatccatggatgccagaagagcttaggaaaaaggcaatgcatcatttacaaaggattctcagtaagtttgacagcagagagctcattataaaccatgggtgccagaagagcttagaatgacattttaaagttctgaaagaaaaaaacactgtcaaccaaaaattctgtaacttggaagatgccccttcaagtattaaggataaattacacattcccagattaaaaaaaaaagagagagagaaagagaaagaaagaaagaagagagagaaagaaagggagagaaagaaaaagaaagaaagaaagaaagagaaagaaagaaagaaagaaagaaagaaagaaagaaagaaagaaagaaagaaagaaagaaagaaaaagaaagaaaagaaagaaagaaaagcaagcaagctttaaaagttcatgtttggtaggctgtacttcaagatacacttttaaaaaaaaagactccttcagatacaaactaaaaaacactagaaagtaactcaaaaccacataaagaaataactccagtaaagataactacataggtaaatataaaagcaattatcatattttttgtaagtctttttaaatattctatatgttttaaaacaaatgtgtaaaataatgactataaatctatgttaatgaagcatgatgtataaagatgtggtttgtgaaattaccaacataaagaaattcataggaaactaaataataatagagattttgtatactattgaagttgtttcaatttactctaaattgttccaaattaagaatgttaattgtaaatccccatggtaaccactaagttaatatcttttgaaaatacagaaaaggaaagcagagggtaaacacagtgatatgctacaaaatagcaactaaacacaaaagaaggcgataattgaggaaattaggaacaaaggaggtataagacatacagaaaacaaaagcaaaatggtaggagtaagcccctctttatcagtaattacattaaatacaaatgaattaaactctccaatccaaagaaagagattgacagaatggatttttaaaaaatgatccaactatattgtccacaagatactcactttagatcaaaatacacaatgagttgaaatgaaaggatgggagaaaatattccatgtaagtaataaccaaaggagatctgaggcaaatatacttatatcagacaaaatagactttaagtcaaaaactgttacaaaatacaaagaacagtatatattgatttcaaaattaaacaagaagatataacaattataaatatatgtacaccaactaacagggctccaaaatatataatgtaaccattgagagaattaaagggagagacagacaattccacgaaaattgttgggcattttaaaacccaactttaataaaggacaaaacacccagagcaaatatcaagggaggaattagaggatttgaataaaactataagcaataactatagataacacttctctcaaaaactgcagaatacacattcttctcaagtgaacatggaacattctccagcacagatgatatgttaggccataagataagctcaataaacttaaaaagattgaaatcatgcaaagtatcttcactgaccacaatggaatgaaataagatatcaataacaaaagaaaaactagaaaatttacaaatatttggaaattaaacaacacagtatttaccaaccaatgaatcaaagaacaaatcatgagggaaattagaaaatgtttagagacgattgaaaacaaagatataacaagatgggtgtgatatatcaaaagcagtgctcagagttgtaacacctacattttaaaaaagaaacatgtcaaatcaataaccaaactttactcaataaaccataaaaggaagagcaaacaaaatccagagctagcagaaggaaggaaataaagattagagcagagataaatgaaattgagaattaaaaaattatacagagatcaacaaaactaaaagttggttcttttaaaatatcaataaaattaatatacttttacatagactaagcaaaacatctctattcagctgacttttttttacaagggagccaacattattcagtggggaataatagctttttcaacaaaaagtgctgggaatactgaatattcatatgcaaaaaaaatgaagctggacccctacctcacattatatacaaaatctagattggatcaataatgtaaatatacgagtgaaaaccatacatgcttagaagaaaacatggaaataaaacattgctgtggattggcaatgcattcttagataatacaacaaaaatacaagcatgaaacaaacaaatgtagccaaaatgtaccagaatctgaaaacatgtattatctataaagaattagaggggaatttggtgaaagaaatatgggagaatgggatattgctctgtgaatgcttttgtgcataattgtacatttttaattaagttaatcttttacactctcaaagtgtgatattaagcaagcaaagataagttattacaagactctaaaaccgaatgcaatgagaaacaagtgaatccaaatatatttcaaatgaatgaatgacataatcaaacttaaggggaaaataataattaatctgattaatttttgactgttctcttatttcaaattgacttttgaacatactttgactacatactattgcttgaaaaaataaaatatctgcaaaaaattattaaatcttcatgataggattttttctttttatattagtataaatataacaattctgaaacaaatgtatgtgcattgtaagattaagccaatgagtaaatattaatatatttgtattgctagaaccccagattctcactgtgaaaggacagagatacagatatggaataagacaaggaaagaagcagcccactgagttacattagaatcagtattatcaacataaatatacaatgtgctctctcacatgctctttccttctcttaaaaaatatataatatgtacatattatatattatatgcatagacacacgtgtgtctatacatatcctacatgtacatattgaggattaacaggtgctagtagaaaatattaactttctttgtattaacaggtgttagtagaaagtagtagtaggtgctaagataaaagccataattaaacctcctggtgaatgaacacaccatcacctacaatcttaccaaaaatagaaccaagcacgtgtcctagtcaaacctctggattcaactgtcatttggataaaacgcaaaggatagtgaaaatgtcgatcttcactgagagtctaaccagcaaaattcacagtgtggacaccaagtgacaaaaatcccaaatttttcaacaaatatattgtatgggaaagaaaactttgaaaagaaacctgtatgttagaagggattttaaaaacacgacaaatgaaaacaaatgggcaagactaaatcatagtgtcttggaatgcatgcaggaaggacacagccgtgaaaatgcaaggacgcctctactggaacagtcacgtttatcgtcacttttcaggagaaaggtggctgcaactgaggagagtcacatgcttcagggctggcaaagtcctatatcttgacttatgtgatgattacagggatgtttacaaaaatcaaactataagtttgttttgtgccatgttttgtattgtgtgtgtgtgtgttttgtttttcaacttaaaaataaataaaatcaaaaccaaggcttcattatcaagtagcacaaagtctccaatctataacctcctttgtctggatatctgcatttaactaccattgccagagctaatcctgacaatgcattcatatttttaacactgaaacacagtaaacagggaaaattttgctcctctaaaacagggcatcttcaggcaatcagaacaactcagaaagtttctgtctgttgcataaaactcccctgtgcaaagagttacacaaaatgctgtcatagtaaaggtagttaactaacggcactaattgttcttgggcagtggccaagtggaacttcagagacctggcattgccagccagaaatcacttgtcatgggaattgtctcctggaatcactttggttgtcccagggtaacgcagggaaagtggttaatgggtcacttgggggtggcatcttcatcagtaaatcacatttactttctcctactaagaattttatttttggccatgaagccaaaagtcagctcttaaataacaagggaagcaaataatcattgaataaaaatagcaggaagaaaaagctgtgcaaagaaatttatgtttttaatttgttatatatgtatatttttatcatactttaagttctagggtacatgtgcacaatgtgcaggaataaaatttatgtttttaaaatttattctacattatgaattctacattagaaaaataaaccatagcctcatcacaggcacttaaatacactgaagctgccaaaacaatctatcgttttgcctacgtacttatcaacttcctcatagcaaactgggagaaaaaagcaatggaatgaataaaatgatagccacaaaaatcaaggtgggagaaatacttattatatgtccataaaaaattttaattaatgcaaagtattaacaccaatgattgcagtaatacagatcttacaaatgatagttttagtctgaacaggactatccaaaagttaattttctatagtaacagtttttaaataaaatatcaattcctgaaacacataaaatggtccatgagtatacaacgagtgaaaaaaaacaaattcagagcaaagataaattaagaagtatctaatattcaaacatagtcaaagagagggagatttctggataatcacttaaacccatggttaaacataaatgcacatatgttaatgtttactgaataacttatctgtgccaagtggtgtattaatgattcatttttatttttcactaaatcttttctctaaagttggtgtagcctgcaactaaatgcaagaaatctgacctaggacctgcacttcttaccattttgctcatatttattccctgtgcatttttgtaacatgtatatgttatatatatagaaagagagagaggcagagatggaaagtaatttatggagtttgatgttatgtcagggtaattacatgattatataattaacaggtttctttttaaatcagctatatcaatagaaaaataaatgtaggaatcaagagactcattctgtccatctgtgatagttccatcatgatactgcattgtcaagtcattgctccaaaaatatggtttagctcaacactgagtgactataggaaaccagaaaccaggctgggcgctaaagatgcaaagatgaatgagacatcatctctgccgtccaaaagcttactgtctagtgggagagttacacacgtaaggacagtaatctaataagagctaataagtgaaaactaagataaattaataatacaagattacagggaaggtttccaaagtcaatgaggcctcaaatgaatcttgaaagtgtgcaaggattaaccaaatgaagaaatgtgtaagtttttcaaacaaaaaggaacagcatgagcaaatgcaaggaggcctaaaataaagagatgtgtaaagaggtgtaagcagctttgtactgctgcctgataattagaagaatatcgggagtaacaagagctatagaagagagtcacaattacggaaaaatatttattaaattataagaaatttatagcataaggaatagtaggaccgttaaatgttttaataaagatgatgcttctttttttaatatttatttttattatactttaagttctagggtacatgtgcacaacgtgcaggttacatatgtatacatgtgccgtgttggtgtgctgcacccattaactcatcatttacattaggtatatctcctaatgctatccctcccctctccccccaccccacaacaggccgcggtgtgtgatgttccccttcctgtgtccaagtgttctcattgttcaagtcccacctatgagtgaaaacatgcggtgtttggttttttgttcttgagatagatgatgctttaaattgaccactctagctgcattgtgggaggaaaaaagattttagaacaagactagaaacagaataattagaaaaatgcaactacaatgcagatgagtgattatcaaggtctgaactgaatagtggaaatagagataaggaggcaaattcaagatatgtgcgtgacagtaaaattaacatgacctggtgtttgattgactctgtaaagtgaaaggaaaggatgaataatcaacaaataatatttattctaccaaatgcctccatgccgctttgatgacaggataatatgtaagcttttctatatttcagaaactatatgacatgacgaaaagtaaaaaggggatgggggtaaggaggtatcctgaattgactgagaaataaggaggtattccacagagaatataaaaaaacatatacttagtgttcaaggaataataaaaaagagaacatctatgtgtccaccatacaggatatgaaatagaacatttgccggccatggtggctcacacctgtaatcccagtactttgggaggccgaggtgggaggatcacttaagcccaggacacaggttgcagtgagccaagatcacactattgtactccagcctgggccaccatgtctcagaaaaataaaaaaactagatgtcttggaggattggaaacaaaatagaactttactagtgccttagacgcccattgggtgctccttgccaattgtgttctcctttatttcctgctggatatgaccactgtccttccattgcattgtatgtgttttttaatagactttaatggttctcaagtgatgcattatttagtttggttctttgaaacttatataaatgaaattattttgtagaagttctttcacctttatcagaaggtactttcaccttgattcaataataagtttgcatattacaaccttgttgaatgttggtgtaattcatccattcgtattgctatatgatattccactacatgaatatgtcggacttcattcctcagatctattgttgatgaacacttgaaatttttccagtttttaactattacaaacaatgctgctatgaacattcttttgtaaatcacctggttcatatgtgcaagatatcctctggggtatatatttaaaagtaaaattattgagttattcaacattaccatgaaatgctacactattttttttaacaatcctaccaatttacacttctaccacgaacagataagcattaccattggtcttcatttgtaggaaccatatttgtcttttgctctgggggctttgttttgttttgctttgttttttgcttagaagtgctttggctattagggatctttttttggctccatgtgaactttaggatttttttttaattttgtgagaaataacgttggtaatttgatgggaattgcattaactctatagattgtatgggtgatatggtcactttagctattgatttttctaatccgtgagcatgggatgtttttccatttgtttatgtcatctataatttctttcattagtattttgtagttctccttgtagagatctttcatttatatagttatgcattcctaggtatttttcatggctattgtaaattcagttgagttcttaatttggttctcaacaaattaatctcaacaaacattcaaacagcttgaatgtatttggtgtatagaaatacaactgatttttgtggcttgtttatcccaagactttactgaagtcgtgtatcaagtctaggagtcttctgaagactttagggttttctaggcctacagtcatgtcatcagtgagcagagatcatttgacttcttttctaatttgtataccttttatttctttctcctttctgatagttctggctagcacttccagtactgtattgaataggaatgatgaaggtgaacatccttgcttttttccagtttctagaagcaacacttctaacttttgcccatccaggatgatgttggctgtggctttgtcatagatgactcattttttgaggtatactccatctatacctatattgttgagggtttttatcataaacagatgttggattttatcaaatgcttattctgcatctaatgagatgatcatagggtttttgttctcagttccatttatgtggtgaatcatgtttattgatttgtctattttgaaccattcaagcacccctggaataaagcccacttgatcatgatgaattatctttttgatgtgttgttagcttcagtttgctagaattttgttgagtatttttacatctgtgttgatcagggataaggatttgtagttttcttttgtgttctttttaaaattttccttgttaattttactgcacagtattattttaatgatgaataaagtgttgagctggacatgtgtaccttgttcctcatgttacaatgaaactgtttaatatgtcatgattatttataatgttgagagtagtttttgtgtatatattaagatatttacatcagttctcttctattcctagtttgttattattacaaatagtttcaaatgtgaacaagtgcttttcccacagctattgaaataaccatattttgttcttttattcagttaatgtggttaatttcattgtttggttttctaattttaaaccatacattcttgaaattactgcacttagtcacgatgtatttttctttggagtatattgttggattatatttgcaaacatttttgtttagaattattatgtagtatattagtctgtaatttcatttcttttaatatccctgtatggttttactatcatggaggtaccaccatataaaacaagttggaaagtgttatgtcttcccaattctctaaaaatattcatgtaacattggcattatttctttattaaatatttggtaatatttctttattaaatattgcatccacctagccctggagttctttctacaggaaaaaaaaattttctaaataaaatttctacaatgaaaaaaaaactactcagtttttctagtttttttctgatcatttcataaaagtaggtatttttcataggaacttgaccattccttatgattgtcaaatttattaatataaagtttcatattttatatttattttatcagataaataaaattatatgttttgaaatatatattcattgtaaaatagccatgttaagctaacatatgcattaccttacatgcttatctttttttatgagaacacttaaaaatctactcttagcaattttgaagaatacaagtacatcccctatggagaacagtttgaaggctcctcaaaaaagtaaaaatagagctaccatgtggtccagcaatcccactgctgcatatataccccccaaaaaagaaatcagtatatcgaagagatatctgcactcccgtatttgttgcagcactatttacaatagcgaagttatggagtcaacctaagtgtccatcaacagatgaatgaataaagaaaatgtggtacttatatacaatgaagtattattcagccataaaaaggaatgagaccctgtcatttgcaacaacatagatgaaactggaggtcattatgttaagtgaaataagccaggcacaaaaagacaaatactatgtgttatcacttatatgtggaatccaaaaagcaaacaactgaactcatggagatagagagtagaaggaagtataccagaggctgtgaagggtagtgggggttgggagaggtgggggatggttaatgggtacaaaaaaagaaagatttaataagacctagtatttgatagcacaacagggggattgcagtctaaaattcaattatacatttaaaaataactgaaagagtataattggattgtttataacacaaataataaatgcttgaggggatgaatatccaattttccattatgtacttattgtacattgcatgcctgtaccaaaatatttcatgtacctcataaatgtatacacctgctatgtacccacaaaaattaaatttaaaaacaatacattgttatccactatagtcaccatattgcacaatagatctgttgaattcattcctcctgtacaatgcaattttgtaccctttgaccaacatctacccaatcctcctggtaaccatcattctactctgtacttctatgtgttcagccttcttagacctccacatacaagtgagattatgcagtatctggctttctgtgcctggattattttactcagtataatgtcctcccggttcattcatgttgtcacaaatgatactttttttattttttaaggttgtatactattctattgtgtatgtgtaccacattttcttcatccactcatgtgtcgatggatacttaagttaattccacatcttggctgttgtgaataatgctacaataaatatgggagtacagataactcattgacacactgatttgatatctttttaatatatgcccagaaatagcattactgaatcatatggtaattctatttttacagaatcatttatactgtcttttacaatggctgaaatagtttacattctcaacaattacaaggttttccttttctccacatcctctccaacacttggtatcgtctgccttttctgtaacagccattctaacggatgtgaaatggcattttattgtagttttaatatgcatttctctgatgatcagtgataattagcatttttatatatctgttggccatttgtatgtcttcttttgagaaatgtctatttagatcctttgtcaatttttcattagggttccttgttttcttattattgtgttgtttgagttcctaagatattttggacattagcctcttatcaaatgtatagtttgcagataatttctcccattttgtaggttatcacttcactctgttgactttcttttgctgtgcagaagctttttaggttgatgctattccatttgtgttttgttgcttttcttgcctgtgctttagagtcatatcataaaatattattgcccagaccaatgtcttggagttattcccctgttttcttctaggagttctatagtgctaggtcttacatttaagtctaacttattttgagtttatatttttatatggtatgaaataagggcctaatatcaatcttgtggacattcagttttctcaacaccattttttgaagagactgttctttccccatgtgtgttcctggcacctttgttgaaagtcaattgactataatatgtagatttatttatgggctctttattctgtgtaattggtctatgtgtctgcgtttatgccagtaccatggtgtttcgattgctatagctatgtagtataatttgaagtcaggtaatgtgatatctcctgccttgctttttttgatcaagattattttggcttttcagagttttttgtgattccatacagatttgagagttgtttttctatttctgtgggaaaatgtcataggaattttgatagagattgcattcaatatgtacatcactttggatagtatggacatttcaaacatattactttttccaatccatgaacatgagatatctttccatttatttgtggcttcttcaatcgctttcatcaatgttttgtagttttcagtgtaaagatcattcacctctttgtttaaatttacatctaagtattttttgttgctattataaataggattgttttcttgatttctttttttgtatagtttgttgttgatgtgtagaaatgctactgaattttgtatgttcacattgtatcctgcaactttactaaattcatttatgaattctaaattttttggcagagttattggtgttttctatatataagatcatgtcaactgcaaacagaaacaatttaacttcttcctttccaattttcatgccttttatttctttcttttgcctaattgctctggctaggacatccagtactatgttgaatagaagttctgagagtgggcacccttgtatgaagtttcccacaacatctcttatctttttattagctatatattaatacggatgtttcttcttcatcaggagtttgaaaaatatgtcttttctctatattgttcttaatcagtcttcctagaagtatttcaatttcaaaaagtagcaacaactgtgggagttcagtcaggctggtgggaaaaattttaaagatagttttaagaaatcgacacaaaccttcatggaaggctgggggtgttgtatagcttcagtaatagatctgaatgaaggcggcctaatccttccttgagtaaacagcttaaagtaggtgcaaaggaatgtaagggagtttatctaaataacttgtttactcatgtggtcctgaagccaacctttgatcattcacaggcaggatggctctctctcgggggagggtgaccaggttaattaccctctatttgtgttgactaaaagcccctgtcatttaatgttttttcaataaatgctggcagggctagctagtcagggctcgtggctgccagaactctttctgtgcacggcccagccccctagcggctctttcactgaataattggtgtctgagtacattattcatccctcgtgcagctggggtctgcaggacagacccccacaaacaacaatttgcaaaagcaaacttccctgttttgttttttttcccgagatgataaattagaggcttttagtgtgcctcggccacttagaaatagcaagagagtgcacaaaggtcaactctgtgagctctacgtcaagaaggaaaatgggaatccaccagaatcatgaaggacatcatagatcccaagaaggagaatgtgagcaaacagtcaacatgacagcaaccagcttataaaagtgagcgaagtcctagtatgtgagagaggcagagagcctccctctgtaactgacattttcactgtgaatctgagcaaccccagccaagttgttgcattttgtttctcccaaggcctggagtcaacatggggagaggcttggagatgctgtgaagcaaagacactgggaacagctgcagacattttcccagaccaggaagtaagagcaagatgccattttcaatctggatgcatgcaaagtcagctttttttttttctttttgtgacccagcagaatgcctgcacaggcattttagtctcaggccaaagattggaacaactgctttggggcttggtagggaccttcacagccatattgtgggaaacacctcagcagtatgtgctggaattgtgctttcccccatcgcagcctcggggcaacagaaaagctgctacagctgtaatttctcccaggtgatgaaacttgcagccagggccagcttggagacctacaaccagtctgcaggtgtcattgctgggtgccccagcctgttcccctgagaatgtgatacagcagggctttctctgcttcacccccaggcagaaattcaggcattggagcacctgtctacctggaccagcatcctgagctaccccaccgtttgtaaacataggttgtggtgcagtggggccctctccagtctatggccaggcagatttccaggtatgtggagtacccacttgactggatcagcagcctgagcttccccaaccttcctgtgctgagattatagtgcagtgaggccctctcatctccacacataggcagacctccaagcaattagagcacctgctcctatggagaacttaaatttacaagaaaaaaaaaaccatcaaaaattggccaaaggacatgaacagacaatcctcaaaagaagacatggatgtggccaacaaacatatgaaaaaaagctcaaatcactgatcattagagaaatgcaactcaaaaccacaatgagatactatctcaaaccagtcttaatggtgattatcaaaaactccagaaacaacagttgctggtaaggctgtggagaaataggaatgtttctacactgtttgtgggaatgtaaattagttcattcactgtggaaggcagtgtgaaaattcctcaaagatctagaaccagaaatgccatttgccccagcaatccctttactggatatatgcccaaaggaatataaatcactctattataaagatacatgcacagggctgggtgcagtggctcacacctgtaatcccagcactttgggaggccaaggcgggtggatcacctgaggacaggagtttgagaccagcctagccaacatggggaaactccatctctactaaaaatacaaaaattagccaggtatagtggtgcacacctgtaataccagctactttggaggctgaggcaggagaatcgctggaacccaggaggcagaggtcaaagtgagccaagatcataccattgcactccagcctgggcaacaagagcaaaactccatctcaaaaaaatatatatatacatatacatacatatatatacatatatatacacatatatatatacatatatacatatattatataggtaaatgtatatatatgtgtatatatatacacacatatatatacacatatatatacatattataactacatatatatacacacacacatacatatacatgcacacatatgtttattgcagcactatttatgatagaaaatacatggaatcaacccaaatgcccatcaatgatatattggataaagaaaatgtgatatatattcaccatggaatactatgcagccgttaaaataaatgagatcacgttctttgcagggacatggatgaagctggaagccatcaccctcagcaaactaacacaggaacagaaaaccaaacaccacatgttctcagtcgtaagagggagttgaacaatgagagcaaacacgtggatacatggaggggaacaacacacaccagggcctctcagggggacaggggtaggagaccatcaggacaaacacgtggatacatggaggggaacaacacacaccagggcctctcagggggacaggggtaggagaccatcaggacaaacacatggatacatggaggggaacaacacacaccagggcctctcagggggacaggggtaggagaccatcaggacaaacacgtggatacatggaggggaacaacacacaccagggcctctcagggggacagggggtaggagaccatcaggacaaacacgtggatacatggaggggaacaccacacaccaggacctctcagcgggacagggggtaggagaccatcaggacaaacacgtggatacatggaggggaacaacacacaccagggcctctcagggggacagggggtaggagaccatcaggacaaacacgtgggtacatggaggggaacaacacacaccagggcctctcagggggacaggggtaggagaccatcaggacaaacacgtggatacatggaggggaacaacacacaccaggacctctcagcgggacagggggtaggagaccatcaggacaaacacgtgggtacatggaggggagcaacacacaccagggcctctcagggggacggggggtaggagaccatcaggacaaacacgtggatacatggaggggaacaacacacaccagggcctctcagggggacggggggtaggagaccatcaggacaaacacgtgggtacatggaggggaacaacacacaccagggcctctcagggggacggggggtaggagaccatcaggacaaacacgtgagtacatggaggggaacaacacacaccagggcctctcagggggacggggggtaggagaccatcaggacaaacacgtgggtacatggaggggaacaacacacaccagggcctctcagggggacggggggtaggagaccatcaggacaaacacgtggatacatggaggggaacaacacacaccagggcctctcagcgggacagggggtaggagaccatcaggacaaacacgtgagtacatggaggggaacaacacataccagggcctctcagggggacggggggtaggagaccatcaggacaaacacgtgggtacatggaggggaacaacacacaccagggcctctcagggggacggggggtaggagaccatcaggacaaacacgtggatacatggaggggaacaacacacaccagggcctctcagggggacagggggtaggagaccatcaggacaaacacgtggatacatggaggggaacaacacacaccagggcctctcagggggacagggggtaggagaccatcaggacaaacacgtggatacatggaggggaacaacacacaccagggcctctcagggggacggggggtaggagaccatcaggacaaacacgtgggtacatggaggggaacaacacacaccagggcctctcagggggacggggggtaggagaccatcaagacaaacacgtgggtacatggaggggaacaacacacaccagggcctctcagggggacaggggtaggagaccatcaggacaaatagctaatgcatgcagggcctcatacctaggtgatgggttgatgggtgcagcaaaccaccatggcacacatttacctatgtatcaaacctacactttctgcacgtgtatcccagaacataaaataaaatttaaaaaatatatacactgattcatgatctcctttctctccttctgaaacactctttaaaactttttagcatttccccctctgtcttccatgtctcctaactacatgtttcttattttccatttccttattcctgtgttcattttggatagccccttctgacctatattacagtttactagttcactcttcaactgcttctaacatactaatattctgttaaaaccattcatttgggtttaaatttcaattatgttattctctatggacattctatttgttttcttttaatcttcttggccattctctagagtttcctgttccattatgatatttttaattttttgttttactttaaacatactaaatatagttattttattttctgtatctgatactttcaataactgcagtcttcgctagtcttttttctgtgctcttgctcatagtttttttcgtttgttttcatgattagaaaaacagagagagaagaaggagagtaaagggaggaggaggaggaggagaaaagaagaaagcagagaagaagggacagagaaaaaaaggaagttggttctaacgtttctctaacaactgtcttcagtgaaacgctcccaccttgtggatttttaggttattgaaattaaccagtcttctgggtgcagcacaccaacatggcacatgtatacatatgtaacaaacctgcactttgtgcacatgtaccctaaaacttaaagtataataaaaaataaaataaaaagctacacaaattaaaaaaaaaagaaatcaacctaattcctagattaccacctcttgattcaaatgctttaaatctaggcttttcatctgagtctttctttttagttattctgtttatcttcaaaacactcctgctttgaatcattcaaaatctacctccctccctctgtttgactaccatcaatttttttgctcattcctaatgcattaatctattagctgtgaatatccaaaaaccctcatttcactgaatctttgacagacccctttgcatcctcttgttcttctaattatttcctcagacactttatgttctcttttctttacaagcatgccatagtttatatacaatgtgtgtattgtttttatatatacctatatatagcctctttttaaaagcactgtacaccatgctttgaaatatattctaaaatcaggtagcatgaaaatggaaacataacatactaaaacatatgggatgcaacaaaagcagttataagagggacacttatagcaataaatgcctacatcaaaaaagaaaaaaagatctcaaataagcaacctaatattatgcctaaaggagcgagaaaattagagaacaatacaagcccaaagatagcagaaggaaacaaataacaaagatcagagcagaaataatataatagaaactgaaaatttcaataaaaataagaattgttttttgaaaagataaacaaaattaacaaattcttacatagactaagaaaaaagaaaacaaactcagaaatgaaagaagagacattaaaactgataccacagaagttaaaaaatcataacatactactataattaattattcaccagcaaattagataacctagaagaaattgataaactcgtaccaaaactgaatcatgaagaattcaaaatttagaacaaatcgtgaataaggaaattaaatcaccaatgaaaggtctctcataaaagaaagacccaggattgaatggctcagtggctggattctaacaaacacttagataactaacaccaatccttctcaaacgcttccagaaacatgaagaagaggaatacttccaaattcatttttcaaaaccagcattaccctgataccaaaaccagagaaggacactataataaaaataaattgcagaccaatactcctgatgaacttagatggaaaaaccctcagccaaatattagcaaatattatttttaagaaaacacagcaaaaaaattcaccatgcttaagtgggattcatccctgggaagcttattagtcttatttgattcgtgtaatcagaaaatttctatgtctagtgaagagaaatgagagcaatagagactcatagcacctcaacaaatttccaggcttgagccagttaacaaatacaagtccttcaaatacaaaaagactgtgaaagaaaatagaacagatcaatgaaactaagaatttgttctttgaaaagataaacaaaactgacaaaccattagctagactagaaaaacgagagaatactcaaagcaataaaatcagaaatgaaagaggaaatattgcaactaataccacagaaatatagaggatcataagaggccactataaacaattacaagccaacaaattggataacctagaaaaagcagataaatttctagaaaaatgcaacttacctagagaaagtcaagaagaaagataaaatctgaacagaacaatactgagtatggagagtatatcaataataaaacatctcccatcaaagaacatcccaggaccagaaaacttcattgctgaattctaacattttaaaaaataataatacaatccttctgaaattcttccaaaaacttgaaggagaaagagtatttccaaactcattttaaaagatcagcattattgttttttttttaaagtgatgttccccttcctgtgtccatgtgttctcattgtccaattcccacctatgagtgagaacatgcactgtttggttttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacatttggattggttccaagtctttgctattgtgaatagtgctgcaataaacatacgtgtgcatgtgtctttatagcagcatgatttataatcctttgggtatatacccagtaatgggatggctgggtcaaatggtatttctagttctagatccctaagaaatcgccacactgacttccacaatggttgaactagtttacagtcccaccaacagtgtaaaaatgttcctatttctccacatcctctccagcacctgttgtttcctgactttttaatgatggccattctaactggtgtgagatggtatctcattgtggttttgatttgcacttctctgatggccagtgatgatgagcattttttcatgtgttttttggctgcatagatgtcttcttttgagaagtgtctgttcatatcctttgcccactttttgatggggttgtttgtttttttcttgtaaatttgtttgggttcattgtagattccagatattagcactggggcctgttgtggggtggggggaggggggagggatagcattaggagatacacctaatgttaaatgatgagttaatgggtgcagcacaccagcatggcacatgtatacatatgtaactaacctgcacgttgtgcacatgtaccctaaaacttaaagtataatttaaaaaataaataaataaaaataaaaataaaaaggcaaacaaggacactataagaaaagtatgggccaaccaatatccctgatgaacatagatacaaaagtcctcaaaataagtactagcaaacagaatttaacaacatattaggagaacatttaccatgataaagtggatttatcctccagatgtttcagcaaacacaaatcaaatgtgataaaccacattaacagaatgaaggataaaaaaatagctatctctatatatgcagaaaaagcatttgactaaattcaaaatcctctcatgacaaaacctctcaacaaattgggcgtagaaggcatgtaccttaacacaaaacaggacatatataacaagctcacagctcacatcatacccaacaatgaaaaagtgaaatcttttctgctaagatcaagaacaagacaaggatatttattctcactacttctattcaacttatttctggaagtcctagccagagcaattaagccaaataaagaaataaaagatattcaaattgaaaaggaagaagtaaaattgtctctgtttgatgacatattatatataggaaaccctaaaaactccaccaaaaagctattagaaatgataaatgaattcaataaaattgcagaattcaaaatcaatgtacaaaactcagtagtttctttacactcacaacaaactatatgacaaaaataaagaaatcaatctcattcacagtagcatcaaaaaaactgtattttttttgtttaggagcacatttaggattgtacttaggagtacatttaaccaaggaggtgaaagatctgtattctgaacactataaaacattgatgaaaaattgtagatgacacaaatacatggaaagatattttatgttcatgggtaggaagaattaatattcttaaaatgtccttactgcccaaagcgatttataggtttaatgcaacatttatcaaaatttcaatgtcattcttcacagaaatagaaaaaacaatttgaaaatttatatggaaccacaaaggaccctgaataactaaagcactcttgagcaataagaacaaagctgaaggcctcacaatctgacttcaaaacgtattacaggaaaagaacaaaagaaggaagaagagggtagaggagaagtgcagcaagggtggagggaggtgcccgcgctgggtcggaggagcaggagtatggagggaagactcctgggtggcatggagctcttgcacctctaggcactgcccagccctgtgtcagccagggctgaacccccacaggataaggaagcctgtgtgtgtaccaacaatcaaagctacatctgtgacacaacaggacactgctatgggcagtctcagtgttgtaactactactatgaacattggtggttctggctcgcgtggaccatcaccatcatcctgagctgctgctgtgtctgccaccacagccaagccagccctcaagtccagcagtagcaacatgaaatcaacctgcctgcctatccagaagcccgcaattactcagtgctaccattttatttcaccaaactatttattaccttcttatgaggaagtggtgaactaacctccacctgtttccctccctgtctgtccattgtggatgagctctgagccctgttttcctgtgaagattctttgaattgcggccattctattcacatgaactctcacatctggagcacagatggccctctcaaggtaatttattgtatgcattgactgtttaccaaacaaatgtcttactatgtactcaggtatattcagcagcattgtcgactgcagtcccctatgcttgccagaagatactgtattcaaagtagaagtttcacagtgatgagtaatcactgcaattttcccattgctccatggactctcagaggccggtgttctgttccctgtaaatagagatgtactctgaacctttctgcctccctcagctgttcctagtccttggtatcagcccctggagatgtccacaaccacttaggacaaaaggcaaaagtggaatttcagacaaaactttgataggatcttcagtgataaacttggactaactgtggcccaggtatcagcactcccaagaattgccaggaggaagctttggcagacaccacaggtatggcaaggcctatctccctctgctgaatccaacaggggcaagcaagctggcatgtggcttgaggtgacccgaatatgtcagcacccctcagatgtctttctttgcacttttaaaaaaaatctcagaatttgctggcaacatggccaaataggaacagctccagtctgcagctcccagtgagatcaatgcagaatgcaggtgatttctgcatttccaactgaggtacctggttcatctcactgggactggttggacagtgggtgcagcgcacggagggtgagccaaagcagaatggggtgtcgcctcacccgggaagtgcaaggggttgggggaattccctcccctagccaagggaagccccgagggactgtaccatgaggaacggtgcactccacccagaaactatgcttttctcacggtcttcacaatccacagaccaggagattccctccagtgcctctgccaccaaggccctaggtttcaagcacaaaactaggcagctgtttgggcagacaccgagctagctgcaggagtttttttttttttttcatgccacaatggcaactggaatgccaacaagacagaaccattctctctcctggaaagggggctgaagccagggagccaagtggtctggctcggcgggtcccacccatacagagcccagcaagctaagatccactggcttgaaattcttgcacagcagtctgaggttgacctaggacactcgagcttggtggcgggaggggcttccacattgccaaggcttgagtaggcagttttacccccacagtgtaaacaaagccaccagaaagtttgaactgggtggagcccaccacaactcagcaaggccacagcagccagactgcctctctagatttctcctctctgggcaaggcatctctgaaaaaagggcagcagccccagtcagagacctatagataaaacccccatctccctggaacagaccacctaggggaaagggcgcctgtgggcacagcttcagcagacttaaagcatctttgaaaagcctgatggctctgaagagagcagcagatctccctgcacagtattcgagctctgataagggtcagactgcctcctcaagtgggtccctaacccccgtgtatcctgactgggagacacctcccagtaggtgccaacaggcacctcatacaggagagctctggctggcatctggtgggtgcccctcttggacaaaacttccagaggaagaaacaggcagcaatctttgctgttctccagcctccgctggtgatgcccaggcaaacagggtctagagtagacctagggcaaacaccaacagacctgcagcagaggggcctgactgttagaaggaaaactaacaaacaaaaaggaatagcatcaacatcaacaaaaaggacagccactcagtgacctcatcagaaggttaccaacatcagaaaccacaggtagataaatccatgaagatggagagaaaccagagcaaaaaggctgaaaattccaaaaaccagaacgcctcttctcctccaaaggatcacaactcctcaccagcaagggaacaaaagaaaactggatggagaatgagtttgatgaattgagagaagtaggtttcagaaggtaggtaataacaaactcctccaagctaaaggagcatgtcctaacccaatgtaaggaagctaaggacctggaaaaaaggctagaccaattgctaactagaataaccagtttagagaagaacataaatgacctgatggagctgaaaaacatgccatgagaacttcatgcagcatgcacaaggatcaagcactgattcgatcaagcggaagaaagatatcagagactgaatatcaacttaatgaaataaatcaagaagacaagattagagaaaaaagaatgaaaagaaatgaacaaagcctccaagaaatatgggactatgtgaaacgaccaaatctacatttgattgctgtacctgaaagtgatggggagaatggaaccaagttagaaaacactcttcaggatattatccaggagaacttccctaacctagcaaggcaggccaatattcaaattcagaaatacggagaacatcacaaagacactcctcaagaaaagcaaccccaagacacatagtcatcagattgagcaaggttgaaatgaaggaaaaaatgttaagggcagccagagagaaaggtcaggttacccacaaagggaagcccatcagactaacagcagatctatcagcagaaattctacaagccagaagagaatgggggccaatattcaacattcttaaagaaaagaattttccacccaggatttcatatccagccaaactaagcttcataagtgaaggagaaataaaatctttacagacaagcaaatgctgagagattttgtcaccaccaggcctgccttaaaggagctcctgaaggaagcactaaacatggaaaggaacaactggtatcagccactgcaaaaacataccaaattgtaaagacaattgacactatgaagaaactgcattaactaacagcaaaataaccagctagcatcgtaatgacaggatcaaattcacacataacaatatcaaccttaaatgtaaatgggctaaatgctccaattaaaaaacacagactggcaaattggctaaagagtcaagacccatcagtgttctgtattcaggagacccatctcacgtgcaaagacacaaataggctcaaaataaagggatggaggaatacttaccaagcaaatggaaggcaaaaaaaagcaggggtcgcaatcctagtctctgataaaacagactttaaaccaacaaagatcaaaagagacaaataagggcattgcataatggtaaaaggatcaatgcaacaagaagagctaattatcctaaatatatatgcacccaatacaggagcacccagatgcataaagtaagctcttagagacttaaaaagagacttagaccctcacacaataatagtgggagactttaacatcccactgtcaatactagacagatcaacgaaacagaaagttaacaaggatatccaggacttgaactcagctctggaccaagtggatccaatagacagctacagaactctccaccccaaatcaacagaatatacattcttctcagcaccacattgcacttattctaaaattgaccacatatttggaagtaaaacactcctcagcaaatgcaaaaaaaaatgggaatcataacagtctctcagatcgcagtgcaattaaattagaactcaggattaagaaactgactcaaacccacacaactacatgtaaactgaacaacctgctcctgaacaactactgggtaaataaagatattaaggcagaaataaataagttatttgaaaccaatgagaacaaagacataacataccagaatctctggtacacaattatagcagtgtgtagagggaaatttatagcactaaatgcccacaagagaaagcaggaaagatctaaaattgacaccctaacatctcaattagaagaactcaagaggcaggagcatacaaaaagctagcagaggacaataaataactaagatcagagcagaactgaaggagatagagacacaaaaaaaccttcaaaaaaaatcaatgaatccaggagctggttttttgaaaatatcaataaaatagatagaccactagccagactcataaagaagaaaacagagaagaatcaaacagatgcaataaaaaatgataaaggagataccaccactgatcccacagaaatacaaactactatcagagaatactataaacacctctacacaaactagaaaatctagaagaaatggacaaattcctggacacatacaccctcccaagactaaaccaggaagaagttgaatccctgaatagaccaataacaaggtctgaaattgtggcagaattaatagcctaccaaccaaaaaacagtccaggaccagatggattcacagccgaattctaccagaggtacaaagaggagctggtaccattccttctgaaactattccaaacaacagaaaaagagggaatcctccctaactcattttatgaggccagaataattctggtaccaaaatttggcagagacacaacaaaaaaaaagaaaatttcaagccaatatccctgatgaacatcgatgcaaaaatcctcaataaaatactggcaaaccaaatccagcagcatatcaaaagcttgtccaccacaatcaagtcagcttcatccctgggatacaaggctagttcaacatacgcaaatcaataaacataattcatcatataaatagaaccaatggcaaaaaccacatgcttctctcaatagatgcagaaaaggccttcgaaaaaattcaacagcccttcatgctaaaaactctcaataaactaggtactgatggaacatatctcaaaataataatacctatttatgaaaaacccacagccaatactgaatggtgaaaaactggaagcattccctttgaaaaccagcacaagacaaggatgccctatctcaccactcctattcaacgtagtattggaagttctggccagggcaatcaggcaagagaaagaaattgtctctgtttgcagatgacatgattgtgtatttagaaaaccccatggtctcagcccaaaatcttcttaagctaataagcaacttcagaaaagtctcaggatacaaaatcaatgtgcaaaaatcaagcattcctatatgcaaaaaacagacaaacagagagccaaatcatgagtgaactctcccattcacaattgctactaagagaataaaatacctaggaatccaacttacaagggatgtgaaggacctcttcaaggagaactacaaaccactgctcaaggaaataagagaggacacaaacaaatggaaaaacattccatgctcatggataggaagaatcaatatcatgaaaatggacatactgcccaaagtttttatagactcaatgctatccccatcaagctaccactgactttgttcacagaattggaaaaaactactttaaatttcatatggaaccaaaaatgagcccgcagagctaggacagtcctaagcaagtagaacaaatctggaggcatcacgctgtctgacttcgaactatactacaagtcttcagtaaccaaaacagcatggtactggtaccaaaacagatatgtagaccaatggaacagaacagaggcctcagaaataacaccacacatctacaactatctgatctttgacaaacctgacaaaaacaagcaatggggaaacgattccctttttaataaatggtgttgggaaaaccggctagccatatgcagaaaactgaaactggatccctttcttacactttacacaaaaattaactcacgatgtattaaagacttaaacataagatctaaaaccataaaaaaccctagaagaaaacctaggcaataccattcagtacataggcatggacaaaaacttcatgactaaaacaccaaaagcaatggcaacaaaagccaaaattgacaaatgggatctaattaaactaaagagctcctgcacagcaaaagaaactatcatcagagtgaacaggcaacctacagaatgggtgaaaatttttgcaatctatccatctgacaaagggctaatatccagaatctacaaagaacttaaacaatttacaagaaaataacaaacaaacccatcagtgggtgaaggatatgaactgacatttctctaaagaagacatttatgcagccaacaaacatatgaaaaaaagctcatcatcactggtcatcagagaaatgcatatcaataccacaatgagataccatctcacgccagatagaatggcgatcattaaaaagtcaggaaacaacagatgctggaaaggatgtggagaaataagaatgcttttacactgttggtgggagtgtaaattagttcaaccattgtggaagacagtgtggtgattcctcaaggttctagaactagaaatatgatttgacccagtaattgcattactgggtatatatccaaaggattataaatcattctactataaagacacatgcacacatatgtttattgtggcactgttcacaatagcaaagacttggaaccaaccaaaatgcccattcagtgatagactgcataaagaaaatgtggcatatatacaccatggaatactatgcagccataaagaaggatgagttcatatccttttcagggacatggattaagctggaaaccatcattctcagcaaactaatccaagaacagaaaaccaaacacccgatgttctcactcataaatgagagttgaacaatgagaacacatggacagagggaggggaacacaacacaccggggcctgtctgggggtaggggctgggggaaggttagcattgggttaaatacctaatgtagatgatgggttgatgggtgcagcaaaccaccatggcacgtgtatacctatgtaacaatcctgcatgttctgcatatgtaccccagaacttaaaatataatttaaaaaaaaatctcaaacaactcactgaagtgtctcaaagctgaacaagttttaccaaaatgaatccttctcagttaactgatcaaatggatgaatcctgaccctctgaagtctctttcctgagttagagcagggaactgctctgagtgttaactgttggattcactgcagtgtcctacaatattttacaagaagatgaacaggcaacctgcagacctaagcttgattcccaagtcacagtctgacccctgctacaggaggttaccctcctcaggaagagatagaaatagggaatttgaaggaatagtgaggggaccagggagatttgattgagtctggtttccaggtgaattaaaaggaagggtgtcatccagggtttgttactacagtcaaaagaataaataaatcaatgaagaaataccttcattgtctgtggttttcatgcagatatactcatggaggttgtatctctccaaaaacagacaaatccaaggctgtgaacaagcatccgcatttgaattccattaaaccaaaatctatgttgaacgaagtgaagtctgtacacagcattgcaaatgtgaacacattcctgtgtgaggcacatcaccatttgtcagttattgtgaatatgtgtatttttaagcaataagatgcagctggtcagttttctgggcaatcttggtgaggcatttcctgtgctgtggttgttctctaaccactgtgagaaacccaaataaaaatcgatcccccccaaaacaagtacgtatcacaaaaccatagtaatcaaaacaatatgacacttgcacaaaaacagacacattgaccaggggaacagaataaggagcccagaaataaactcatgcatttatgaccaataaatttttgacaaaggtgcccagaaaacgtaatgaagaatagacatttgtttcaataaatggtgttaagaaaactagatatccacatgcagaagaacacgaatgtgtatggtgtgtatccttatctcacaccatacacaaaaatcaattcaaaatggattaaaggtttaaacataaaactgtaaaactactagatgaaaacataggggaaaagttccacaatgttggtttggtcaaagatttcttggatatcacccccaaagcacaggcaacaaaagcaaaaatatatgggattgcatcaaactaaaaagcttctgcacagcaaaggaaacaatatggtgaagagacaacctacaagttgtgagaaaatatttgcagagcatacatctgatgaaaggctaatctccaaatatataagggactcaactcaatatcaagaaaacaaataaccaagtcaaaaaatgggcaaggtcctaaatagacatttctcaaaaaaaatacaaatgactaacataaaaaaagtttgtcatcctaattatcagggaaatgcaaattaaaatgacagtgagatgccacttcatacctgttagaatggctactatcaaaatgataaaagataacaagtgttgaagaggatacagagaaaagggaaccctcgtacactgttggtggaaatgtaaattaatactattatgaaaaatagataaaagttactcaaaaaactaaaactagaattactatatgatccagcaatcccacttccttgtatatatccaaaggaatttaagtcaatatgctgaagagatatctccaggctcatgttcattgcagcattattcacaatacccaaatatgaaatcaacacaggtgtctatcaactgacaaatggatgaagaaaatgtagtgtatatatacaatggaatactactcagccttaataggaaggaaaacctgatatatgtgacaacatgaattaacccagaagatatcacgctaagtgaaataagccaggcacgaaaagacaaatatcacatgatctcactgatatgtggaatctaaaaaagttgaattcatagaagtagagaatggaatggtgattatcagaggctagtagttgggggtagacatggaaaaggtagatgttgataaaagggttcaaagtttcagttagacaaagtttcagtgaactattgcacagaatggtgactgtaataaataacaaggtattgtatgtttcaaaatgactaacagagtagattttaaatgttttcaccacaaaaaagatatgtatgtcaataagatagacctaatctttccacaatttaaacatgtatcaaaacattacattgtaccccataaatagatacaattattatttgtcaatttaaaatttttcactaatttatattgttattgttgcaccaactcctttccaccaggcagattctcataaagactattttctcttttacatgaagcatttcctacacacctcttaatcacggtagcattgacgtcattccaccagattctatctccagtgttaaaataatcaagaacccagaaatctccaccagggggcaaccaatgcgtatcaaagtttcccactttcctttagatttacttatgggtaacttatgggaaaaaatacttaagtacttccctttttaaagaaaaaaattatatgaattctacaaaattatggcagaaaatttaagaagagcagatgcttcccaactcattctaaagggccagcattaccctgattctgaaacgaaaaagctttacaaaatccaagatccattcctgactaaagataaaagaaattttcagcaaactgtgaatacagaaaactttctcagcctgttaaagagtacctatgaaaaaaattatagctaacattatacttaatgatgaaatatttaatatatttcataacaggaacaagtcaaagatgtctactctaactaattctactcagcattcaacaaaatgaatatagtgaattcatactagaattttaaaagcaaatgtctttattcactgacaacataatcatctataaagaaaatcctacataacctataaaaaactgatggaacttataagttttgcaagtttacaggatataatgtcaaacaaagatctattatgtgcccataagctaagaataaacaattgtaaattgaaataaaaatgtcacttaaaagggcatcagaaatataaaacttagagataaatataaagtacatatgcataaagtacctgttcaccaaaaactacaaaacattgctgaaagaaattaaatgggcataatatagatgtagagatgtgttgaatttatgactcattttgaacaaggaatatattcatcatatattcatcagataagaattatgttacaggtctaataacattcaaatcaatacataatgtctcatagttcctgaatctaaaatatcaaagaaagaaacataaagccatatcatgtttaatgagaagggcttattatatcatttatgagatcctcttgtaaatcactagctgtttgcatactctctttattgctgccttcatctccttattcctgaatgtatagacaactggattcagaaaaggagtgagaactgcatcaaaaatagccagaaacttgtccatctgtgaattagggtgtggccgtgtatacacaaacatgggtggaccaaagaacaaaaggaccactgtgctgtgagctgaaagagtggaaagggccttggatgaaccacctgaggaatgtttccaaacagtaaacaggatgaagacgtaggagattagaagtatgaagaaagtacccacacagataaacccactgttaacagtgaccatgaactgcaatctgtaggtgtcggtacaggctagtctgagaagccgaggaaggtcacagtagaagctgtccaacacattagggccacagaaggctaaattaacaagaaatgccagttggaacagggagtgactgacaccaagggtccaggcaacagccagaaatgaaaggcacattcttgggctcataatggtcagatagtggaggggcttacatagggccacatatctgtcaaaggccatggctatgagcagcaccatctccacaccaccaacgacgtggatgaagaagatttgagcgatgcagcctccaaaggagatgactttgcgctttctgaacaggtcataaatcatcttgggagaagtgacagagcaggctcctaagtcaatgaaggagagactggccagtagaaagtacatgggggagtgtaagtgagggtcagtggtcacagaaaacacaatgaggatgtttccagtaatgcttgccacatagagcacagaggaaaacactaggaggaggagctggatctcccatgaatgagtgagtcccagaaacaaaaactcagataccactgagtgattctctccatccattggtccagccaactgggctgtggctaaaattatgagaactaagaaaatggggaggaaattgtgattatgaagataataatatgtactaaaatcaatattgcaatgtcactatgaataaatagtatacagttattctgttcctcacatattaaaaacaaaaaatcaacataatattatcacaacatgtgagctgcaacctgatttaaacccatcatcaatactttcagtgtaatgtctgatctaaaattaacagattaggtaagaacaagattcctgactatccatgaaattcatcaggtgtttaaatgacctgtgatattaactattcctcatttccaacatattccatttgtacttatacatattcttataatttccttcccttcccagtttgcacccacaattctctgacagaaagtagacataagaggaaaacatgattaacagatggattatcactgcagtaagaggtgcctgggacagacttagttgaggtaggctgtggattgagagaatatagagactggggtatgtgaaatcggaaagcccacaactgtagcagactagagtaagtggactttcacaagaaatagaatcaccaccattatctaccacattttctcatgcttactgctatttaagtgcctcagtttctatacaatctttcacaattacgaagccctaaatggcttcccatcctgcaatgatttcataaggagcctatgccacctgtcatgtaaggctttttccatgcctaataaatatgttttggagggatttcaccagtgtttctgctaagatacatgcataaaatggccacagaggttgtgagaaatctctgcagtttctctttgtctatacacatgaaagtattgaagaccagcacttggattagttaagataatgttttaattcatcactgtctcctcctccccttggtaccagcttttatgttcattgcattccccacccttttaagtactcagtacctcctgcatggtaacctattctgatatttgatattatcatgcttaatttgactgaatccattcggatattttatctttaagaaatttgtagttttatacttttaatttatgataaaattagattaatatcaaacattaacaagtgacttttaggaaggtatatgagctttcttattgacttcaaactataaagtacaaactgtgacactagaaatttagtcctttaacacatattgtatttatatgtgaagtggagggtgagcagaaaacagtgttatatttctctgtgtccagatggatactcacctcaatcattttcctatagtagaaagtagttcctgaaaacacttaatagagattattttagaagttgctgaggtacaaataaaactgctatgctgacatcatacttttttgcaccaacaactccagttcttctgacacaaaggaccatcttcctagtgccataatttatcttagaccccaaaactcacagaggcacacatcatatctctaatacttgctcaccaccactggcatgagtctctctctatcctcttctacgtgaagtgattatactgtcacctctggagctaactgtccacagtctcaagatgcacactttttacaaccagaagcctatggactgggtgagggagcagaaacagccacaggtactgcccatcagggtaatgtaagtcagcatgcaaacaactgatcagatgaacatgaatagcaaggtgctgaggcactgggaagagggaccggaaaactctataattgttgaaaaagactcaagcccttgggaagggaaatgcctacgaaattatataaagaccattttatccaagttggtcatcattcagatgaaaaccatgaggcccagaaaagtaaactgagtttccagaattcacacaattgatagaataggaaccagaattcaggcctcttgcttcctattccagaaagacaaattgcaataataatcaaataatatgagcaatcatccagtaaaaataatctagtaaaaacagcaaaactcaaaagagtgatttttcctggttaagaccaaaactaaccatagattgctatacatagtatctattataaatactgaattatatagcagcctgacaataaatacataaaatgtgtacacaaagattattgaacctgtacaatacagtagtaaatagtaactttatatttgcaaagtgactgatcattactatcagaatttgtacccattcttcatattttgttggtcatataaccagttactacaactgcaaaaacaacctaaggtcatgtttctgtgaagtccatccttttggtctttaaattttattatcctcaaaggtcaattatgatctcaatcttttcttgtaattttactgacaattctccttcacactgatttgttctttctctaattcctgtaaatagaaagaaccaaaaaaagttgaaaaaacatgtattgtacatataacaaacaatcatatgtggtatacaatatatatcaaatgagtattaagataaacattcaaagagttttaaagaaaaaagtgttatagatattggagggcagaagagacgattgccattaagaacaggtggaggaggttatgccaaggacattgacctgaccctttaggaattagtgaaaattgaataggagaagaatgaggtatacaatgtgtgaaaaatacctaaattgatataacaggaggagaccttttcatatcaattatcattacttctgtgtatataaccatattagatacccacaaacgaatagaaagtggatagttcttgattgacaagtaagactaataatcccagatcatagtaaggtcttaacttcaagtcaataatctttattacttatggttcattcctctccctcatgttttccaataattttaaaatgcataattaaaacaattctcatttaaaaacatagtagccatgactaatgatcttccagtgggaaggtactaagactttacaacatgtttcttgctggggataagacagcctacagccagcattcaactcatttttctaaagtctatggatcaatttgaaatacagaaaaagtagaacagagataaagttaaaaaaagattaaaaatatgggaagaatgggagaaaggggagattagaagatatgaacaatgatttaaaaataaaagagcctcaaaggagaagagaaactgctaagcaagactaaggtaggatgaaatacagtagtctctgtttctgagaacacaggttaaaaagaacataaataaaataaatttatcacctttaatacactcattcaaggatgctactgagtttgactttgggaatttctcacctttaatacactcatctggggatgctacggactgtgacattgggttgcatttaaagggggagagaaagggcagttgcttctattatcgccctgttggactcacagagtttctttgaaaagcacagatgataataaatggaaatattgccttttatactatacaataatatacacatgcaattcactggaaaaagtatacttgttactatgatttgaggatactaccatatactaatcaagagaaacacatgtacagaacaaagaaggcacatgaaatttttactagtgtgtgttttccttgtgttctaccaccccaggagcagcttctgctactgaagatcacagtagagttatttccaaaagttgtgggtctgcagggtggacttatcacatagctgtttgccaaaattcaaaagtccagaaaccatttccaaattttcacctcttttatcttcaaatcctaaaactatgaaaattcacaaacttagctccatacattatggtagaaaggttaataatttggactttgaggttgaccaggcctgatttttgaataaattcacaaacttacctccatacattatggtagaaaggtcaataatctggactttgaggtcgaccaggcctgatttttggatccaggctgcaacactcacttgctgtgttaacgtaacaaagttcctagaccatgctgagcttcagtttacttgttattgaattagggatatagcgttcgaaggaagaagttctagtatttgattgcacagcagagaaattatagttattgaactggggatatgtagatagacataataaattttagtattcaattatacaatggagaaatcgtagggaacaataatttattatatattctaaaatagctagcagagaaaaattataatgttcccaacacaaagaaaagataaatattcaaggtgatgaatatccaaattactctgatttgatcattacacattgtatacatgtatcaaaaatatcacatgtaccccaaaacatgtacaactatgatacatcaataaaaaacaacaaaaaaaccaaaagaatagaaatcaaaaataaatacataaatacataaaatagggataataatacctcccttgtttgcttgctcccttgctccatttgtaagaaataagtgatataatataggtaaaaatacttaacctcatgcctaccacatagtatagcacaataaatgttatttattataatctgaggcctacctacataagtgactttcaagtatagaaaattatttctcaaattttaaatactccctgattctcaggtatggtaattagacctggctttaggtaaagctctcatgtctacacttggatttaatcacttaagtatatttcccagtgccccccccaaaaaaaattgctcctaggtggacacactaatcaaagacttcctgagaaatgcaggaagaagttttgtcctctgaccacgctacgccctttccttgatggtaagccccataatctaaagccataagtttcaattcctcacataaaaagaaaaaaaatgtcttttatgaccacttcagataacactggatatttcccttgtcattaggaatgagaaatgggaggaaggtaaacttgtagacaggagaattggtagatgcttgaaaggatttctgaaaactgtgcctatccaggtgtacaaatgtgttgaccagccaaggcaaagcagtcaaaccatacaataccttatcctcaggaaaatggacttttctcccaaattgcctttttcatgaaaaatataaaattctccagtttcaacctcatgttaaatttcacatgtgaagaaaacagtcatgcacatcagaaaattaaatggcgagtcaagaccaaattcctagtcacagttatgttctgtttccagtattaccttctcacttattcattttgttaaagtggagccaaaatagaagtgggtgtcacacatcaagaaagactgaagtcgtacaaagccgatccttatccaacgtgcattaaaatatgcatcaggcatgtgtgatgcatacagtagaagtggaacaaatcaggccaggtgcagtggctcacgcctgtcagcccagcactttgggaggccaaagcaagcaaatcgcttgagatcagcagttcaagaagtgtaacaaatcctctacaatataagtagagtgaaaagagatagctacagtgatgagggaaggcactatagtgatgtggcatttgagtatagccataaaagaggataaatattacaatacatgaatatagggtctaaagaagtcttttcaagtagattgtaaaatatttcaaaaatggtaagtttggtgtatgttgaagcatacagattgtctacatcctaaaaatcattttggtgaataaaggaaaataagaaaggtagtcaatattcatttgttgcctatcattagaaacttctcaaaggtatatgagaattattaaataaatttaggaagccagtgaaggtatgggtcccgggaattgaggatgaagccagtaattagggaagatgccccatctataagtgtgatgtatcaaatggaggaaaagaaaaacggagggaaggagttcccttaagagaagattgaaatagagcagacttggggggctacacagaggaactgggactacacagttccagctttaaggctatagaaacagaaatagaaatactggtaagtaaaaacccaaaggattggtgacttatcacagctggagtgaatacgaaggagcatgaactcaaagaaaatatcaagatttaagcaagaataaataggacaatggtaggtccatttttagaaattagaaagttgaacataaaatatgtcagggtggagaaaataatcacgtgtattttaagcaaataagagtattagatattgagatgctcaggtgaaaacatatgacaggatatatgggggaaaagtacaaattcaacatgtaattgtatagtaatccatataaaaataatagacggatgtgtaagagtgcataaggtccctgaaggaaataatacacaggaaaaaaagattaaaaagcaaagacccaactatagaaactatccacattgattatgtaaagtaggaaaaggaatcaataaactagacagaacatcacagaggtaggaggacaagtgctggcctcgaggagccaacacagaagcaggtatcaagaataaaggaggagaagagagaacaaagagagagagaagagaacttctgtggcagaagatcaagtgggatggtagaataaaggagaagaaatacaagaaaattgaaataaaatttacagaaatgttctacattgtaagtgggcagttttgacctggcacattgttggcacacattataaatgtcaaatgtattaatgaatgaatgaatggataatataatgaatgtgatggagttgtcaaaagctgaattaattaaaagtccccacgagaggttagatgacaaaattttcagaaactttccatgccactctgttgtgacatcaacagtgctggacccttgaaatcaaaccaaaaggattccaccatgagaatgaaaagggctgagaaggggaatgctgggtgacacagaaggtgacaaagggcgaaaggtttctaggcatttgatagactgatggacgtccgcgctgaccataaggcacaggccacacaggaaggaaaatgagacccaacgcgaagaaaagtagggctaaacagtcgggaaaatgtgggaagaaggatgaatagtcatacgatcaactcagattcctccctgacattcttctacagctttattctcgtcctttgggagccgagatgttcattttcctacattcttagctgcctacacacggcgacttttctccacggtgcctgatccctgctgcatcctccttctctagtggcaacagcaaatggccacacagaaggcagacattgcacccaactgaggagaatgtaattcactcattgccagtcacagaccttggctcaccgatttactaagtatagattttatttctatccctcacctacctgttttgccaagggaactaagaaaagagcatcatcaaaaattcagataggtatagttctcacaagatgaaccagatccagtacggcatcactgcagacatacacacagagctgcataaaacaggaagagagctgctaatcacagccccagagggtagtggccaaagtgatgccttggagatccgagaatgccagactgagatcacacggcctggggaattaccgcctatggtcattttggttttcccgggatagccatgttaattgggtgaaataaagcatatttgattttcttatgacaaaaaagggcttttgccattgtctacagatgatactttaaatctttattttatgactaaaggtgaattccagagcaacattaaatgttgtccctttaaatttttaatcatttacataacgattaccataatattcaatttaaacataaaatgtaattgaaagtatgagattaatatgtggacatgaaatcatataatgttccatggaaaaaatagaatgtataaggcaaagaggtttaaagtaacatcaaaactaatgctcactatacaaattctatgaaatcctcataattacactgtgaagcaggtgttgttagagccacataatctcaaacaaattatttattatctaaaattacatagatattaaaaggttaggccatatatgaatttaggattctctcaaaaattttttctctttctcctacatcaaacttccctaaattatagaaaagtcacaatgttaccaaacatattcacaaaacacatataatcttgaatccaaatttcagttacagcagaaaaaataaaactctagatcaatctcaatcgtgtaaataaattcagatttccaatctaagagtctcaatttgacatacttctttctctctcttctttcaaaccaggagaaatataaatatgagccacaaccttacaaaagctagaaaatatttacaattccacacaacaacacatgaagaaaaccttctggacatcaaaagtttaaaccagtcaagactgaacaccaagataaagtgcatgcctctgaagagcttgagctagtcaagaagcccagaaatccctaaaagaggtgtgtatactgaggactgaggatcaaaacctgtgatctttacttggaacagaaatattgcagcatgtgaaccctccacagagtgacagagggaaaggagtttaaagggaaacatgcaaatgtatcacctttggaataattaggacacgtgtgtggtgtaatgaaagaaggcaaaaagatggggaagaagccagacagatggcaattttcattctattatgaaaagaaaaggataagtcacaagtcacatgatgaaattaacaactatgaatccactctaagccatagtcaatcctatagcctaggagtcattctaacagatgagagtgttttggagacaagattccaaaactcgtctgccttccatcatacttactacccccagctcctcctccacaatatcctttcacaagtatctagaatattcaaagactaataatattatataattatttataataattgtattacaaaaataaaacttgatgacctttataaaaatactagaagaaaaagggaaaattacataaggtacagaacatacaaattataccatgaagcagtaaaaaacaggatcaaattttctatgttttttaaaaatatgccttctctaaaatgttttctctctgaaatgatatttagaagacataattgaaaataaatacaaaataaagtgataaaaaataatctggcaaaattcaggatgtaatgagtaaagacaaccatgaaagaaatgaagatcaataaaagcaggaaaaaaagtgggaagtggagagaataatgctgctaaaaacacagataagaatataaatgacaggcttaaatatatcctgagcaaaacgaaatagaaaacacaagaaggtgaaatgtaacattaaagtcaggtccaacaaatgagaaattagtgtgaaagagctcacaatatctggttaaaaaattcaaagataaaagaaaacttttctgaaatgaagaaaacattgaatctaatggttaaagggcttatctttatccagaaaaaatgtgttatagtatgaccacatcaaggcagatgcaactgaatttaccggacttcacaaacacaaaataaacaacccacaaaaaaaaaaaaaaatagagtccccatgaggctttaatgaagacaactattagaggccaggcgcaggggctaacacctacagtcccaacactttgaaaggccaaggcaggagaatcacttgagcccaggagttcaagataagaccagcctgggcaacatagcaagaccccatctctatcagaaaaacttaaaaaagaaaactatccactaaaaatgaatagagataacatgatacaagtgagcattctgaagcctaatatcaaaatgttctggggtttgcggttaaagaacagaatgcaaatgttacaaaccataactgtataaagactaattatattcataacaaaaataagaagagaaagatagtagaaatatattctggtccattcaactttcacagtgggagagaatcaacaaattatgttatgggtgattaaatattattttaaaagataaaggtcattattagaaaaattaaaaataacaaaatcaaataaagttggatgacgaaggtgggagaggaaagtgggtttaaggggtaaagtggaactatattaaaagagtcaatggagagcacccttggaaataacacaaaaattaaagaactaaatataatttatacagcacataactaaactataaatcttcaaattaaaagaaaataggtacatacaaaatatcacatacagagaaatattaataccatgaaaatattaaaataaaagcataaaattaattcatttatttaccctattagtattttttgaacacctatgtgccaggtattgtgctgaatgccagtaagatatagttcctgcatcttggagttttcgtggaggagacagagattaatcaaacaatcacacaaatgtaaaattgcaaccataaaaattactctgaaatacaatgaaaattactataagagagggatttgatgtgagtcagagaagtttcccctaagaaagcaacactgaagctgagatctaaagggtaaacagcagttaactgagtggagaacaaaggttttcctgcagggggaacaatctgctccccgaggccagagtggggccttgggagttgtgcctgaaaccacattgtgaggaagtgaggggaagcattgtgcagataatgctgaaataagtagtggaagatgcttcctaagagaatgagaaatccaagactactaagcagaagaatgatttgaccagatttcacatttgtaaatatcactatggttacaatgtatagaatggattttaaggaattcaaattggatacaggtgagtcaattagaaagcaacatgcttgctaaggcaagaaatttgattacttaaactagatatgggagttttggaaataagtagataaatttgtcatatatttgagataataaatcaccatgacttgatggtagacttagttggagatgccctcactaatgcaccatctaatgcttcaagtctaataattattcaattcctccagagccaccaatccaatggttctaccatatttatgctgtcattcactttactgatatccttcttaccttacctcttttcccactttatattccatgatcaataccttgctccctcgtaatgattgtactcactcttccaaacaacaatcctgataaatcctactctctgccttctacatcttgataccacacagctatatgtggctagataaaacaatcacactgacaatcatcctatactttctgaatccatcactcttctactttttcagatcttttctttctccctcatccttaccatgtaatgaactcattttgcatgtcaagggctaaaagttgaatattttaaaagttctcattttcccactactatataaaccaacaaatatctttagtctgcattcacaaataacataacaaatgagctcttcatatttctatccgtggtgaattaagatgactagaaattttgtggcaccatcccgttgaaaacgtggggacatattctttctccttgaacctgggtgggctctttgactgctttgaccaataaaatacagtgaaagtaaaacttccagttttgatgtccagatgttaaaagccttgaagcttccatttctacatcttggaaccaacgtgtgtgggtgctgagtcagtatcgaagaattctgcttattctgcttgcattagtccattttcatgctgctgataaagacatatccaagaccgggtaatttatgaataaaaagagtttcatggaatcacagttccatgtggatggggaggcctcacaatcatggcagaaggtgaaaagtatgcattacatgggagcagacaagagacaatgagagctgagtgaaaggggaagccccttgtaaagtcatcagctctcatgagacttattcacgaccataagaacagtatgggggagccaccccatcattcaattatctctcaccaggtccctccacaacacatgggaattatgggagctacaattcaagatgagatttgggaaaggacacagccaaaccacctcattctgcctctggcacctcccaaatctcatgtcctcacatttcaaaaccaatcatgccttcccaatagtccccaaaagtcttaactcacttcagcattaactcaaaagttggcagtccaaagtctcacctgagacagggcaagtctcttccacatataaacctgtaaaatcaaaagcaatttagttattttctagataagataggagtacaggcattgggtaaatgcagccgttccaaatggtaaaatttacccaaaacaaagggactaaaggctccaaacaagtccgaaatccagtgggacagtcaaatcttaaagctccaaaatgatctcctttgactctatgtctcacatccaggtcatactcatgcaagtggtgggttcccatggtctcaggcagctccacccctgtggttttgcaggggagagccttcctcccggttgctttcacaggctggcattgtatgcagcttttccaggcacacagtgcaagctgtcggtggatctaccattccggggtctggaggacagcagccctcttctcatagctccactaggcagtaccctagtggggactctgtgttgggggcttcaaccccacatttccattccccactgccttagcagaggttctccatgaagacctcacccctgcagcaaacttctgtctggagatccaggcatttccatacattctctgaaatctaggtggaggttcccatacctcgattctggacttccgtgaatccacaggctcaacaccacatggaagctgccaaagcttgaggcttgcaccctctgaagccatggcctgagctgtaccttgaccccttttagctgtggctggagcagctgggacacagagcaccaagtccctaggctgtacacaggcaaacagcagaggggccctgggcccagcctatgaaaccattttttcctcctaggcctctgggtgtgtgatggaaggggctgccacaaagatctctgacatggcctgaagacttagcgattaacatttggctccttgttacttatgcaaatttctgcagccagcttgaatttctcctcagaaaatggatttttcttttctatcacagtgtcatgctacaaattttctgaacgtttatgctctgttttcctgttaaaactgagtgcttttaacacacccaagtcactcttgaatgatttgctgcttagaaatttcttctgccagataccctaactcatctccctcaagttcaaagttccacaaatctctagggcagggacaaaatgctgccagtctctctcgatagcaagagacacctttactccagttcccattgagttcctcatctccatctgagaccatctcagcctggatttcattgtctatatcattatttgacattttagtcaaagccattcaacaagtctctaggaagttccaaactttcccacattttcctgtcgttttctgagccctccaaactgtttcaacccctgcctgttacccagttccaaagtcgcttccacatttttgggttatctttacaacagcaccccactctaccagtaccaatgtactgtattagtctgttttcatgctgctgataaagacatacctgagactgagtgatttatgaagaaaaagacacttaatggactcacatttccaggtggatggggaggcctcacaatcatggtggaaggcaaaaggcacatctctacatgatggcagacaagacagaatgagagctaagtgaaaggggaacccccttataaaatcatcagctcttgtgagacttattcaagaccacgagaacagtatgggggaaatactcctgtgattcagttatctcccgttggatccctcccacaagacacggaaattatgggagctacaattcaagatgagatttgggtggggacacatccaaaccatattgctgctgaatagatcatgtagacaggctctcaaactacacggagagcaagagaggcccaccttaccacaacatttcatccaatccactaataaaacaggcacatcactgaagccaccttcaactctccagactacccagctgccagctgaataccacagatggctacagttaataccacatggagcagaatcatgtagctaagccctgcttgcgctaatacaagtccacaattttttttaagtttgttgttttaagctgctaagttttgaggtggtttgtggtacgtggaataagatgtcactctaatataatataaacttaaactatgtggcattggctttggaatcagacaatggatagaagccagaaggatttcacaaagactgttagtgaaaagtgaacagacttcaaggaaaatgatagcaaaacctgtaaaagcattctgggaactgacagtaaacactgaatggtccttaaggagactgaaaacttgaaagagcttaagaagtctactggaaagggctttaaggataatgagaaaaaatcatcagtggaggctgaggaaaacgcaccaaagtcatattctgatgggagaattagaaaacgcttgcctggaatgatataaaaaataggaaaaataccgaaaaagtttgtggatctggctggggagatttttggtgtcaactaaagaaaaaaattaagcttttaagaaattaaagttagatttatttaggggtctgagaacaagagactgaggattacagcctaggagaagtcttccagagaggttctgtcagactgctctggtgaaggtctttagcccacagtttatatgcaggctgtacatatacaccatggaatactatgccgccattaaaaaatgatatcatgtcttttgctggaacatggatggaccttctattatccttagcaaactaatgcaggaacagaaaaccaaatacagcatactctcagttataagtgggagctaaatgatgagaactcatgaacacaaagaataaaacagacactggggtctacttgagggtggagggtgagaaaaggaagagaagcagaaaagataactattgggtactaggtttaatacctgggtgatgaaatgatctgtacaataaccccctgtgacaccagtctacctatgtaacaaatgcccctaaacttaaaataaaagttaaaaaaaaagaaaattaaaatctccttatcatctacctggtaatatgaaaaacacaaatctttcattcattcctttcaactgatgaggaaaatgaggcatcgggagttagtaaaagtccacattgagatatgagacccaccactggctggacgcagtggctcacacctgtaatcccagcactttgggaggccgatgctggtggatcacctaaggtcaggagttcgggaccaggctggccaacatggtgaaacccccatctctactaaaaatacaaaaattagctgggtgtggtggcaggcacctgtaataccagctactagggaggctgaggcaggagaatcgcttgaacccaggaggtggagtttacagtgagccaaaatcacgccattgcactccagcctgggcaacaagagcaagactctgtcggggaaaaaaaagaaaaaaaaaaaccaccgccatcattttgcaagtgttaccactattgtgtgttaatattgtagaagtattcctaattatgatttctttgtattcctaattgtaatagctttgtatttgaaaaattattgattcatactctatatgttattattttgtatgtgatgacaacagaatatattatcatgctccttttgtgaatctcattcataatataaagtataaatttgtgattttgctttaatttgaaatattaacttcaaatatgttatcacaatttgatacaaactattgacagtaaatctgtggattaagtaatgtcttagtaggtattgggaaaatttgaaactagtaacatggaggactattgtcattgtttatttcaaagccagttaaaattctgcaaagcagtgtacataaaaataatttcaagaaatttataaaataccgagattatggtgtataaacaactttagattctttgtttaagaaattctgccagtttgtaatatatgcttcattcaaagtagctaagggctgtacctggctaatagtaggcacctaatatttgttgaaaaggaatactgagtagctgggacctcctgagtagctgggaccacacacatttaacctgtatttataaaattactgtttagagaataacatttgatggaatcatgcttttactttctgcttacgactcaattgtttgtactgacattaacatcccaaatccttagcatggcctacaaggccctgagcaatgtggcacctgctgaagcctgctgcctcatttaataactctttgtctctttcccagatccagccactctaacattttttagctcctggaccaagacaagctcttcccagaacctgacctttgtacctgttctttattcctggagtatttttcccctgacaaattacttatcatctatcataattcaggttaaatggcactaactcagggaaggcttccctaactgcctcccttctccaaccaaattaggaacaattatatggccacatagtatcgaatcaagtttataattttaaaataattgggagattttgttgtttaacacttgttttcactataagactgtaattacatgcaagtaagaaccatgcctgtttgttcactcctgccacagtcagaatagtgcctggaatatgcagtaagggctgaacaagcactaaataaatgaacaagtgaataaatggatattgtctcatttttagaacagagtactgaatggatcatgaacactatctggtatgtcacgtaggtaatttacaagggctacaatttcagctcagatttaccttttcctggatacaggtcttgataggtctcttgatgtcatttcacttcagattcttctttagaaaacttggacaatagcatttgctgtcttgtccaaattgttactaagaatcaagagagatatctgacatgaaatgacattggaaaacattaaacacgattgaaataatgctagccaatatggttattattagaaaccaattacattttcaacttaaaaatagtaatacttattgcagactcaaatgtgcttattctaaaacaagtaaatgtttgcctatggtctgagattctaatccacggagttcattctaatccacattcaacactatcatgtaccagtgggcctcataacccacctagccctgtgatttttcaggttcacttttctaaacttgtgaattaaatatttattttcttagttcagaagaggaaaaaaactcttgtaattgttgcccatttcaggagaaatcttgcatatgaaaacaagagataaatatacacaactgagggctgtggtttaaacaaaatcttgagaatgttttttgaccttacacatttgtgctttagtataacaaaatgatatagacaaaggtaacttttaatagaaccagtcactaaattaaaaaaatgacaaattcttctgcttagctaagcaacagagaaggtaaaatactaattcaattcatcaatttaagcaatactcattaagagccaagtatgtgctcactgaataagctgctaaggtttggtggttacagagtgtgcggtgaaatgatgtctacatcacagtccaacattcacagagtttaaaagcctaccaagaatcaagacagacacaaatacctaacatagacatttgtatatgataagagagccagagtacaatttaggagaagaaattgtatggaaggaaggttcatttccattagaccagaaaagacagcacatttgaaggcctgaataagaaatattctggataagatattgtggctgctaccagaatggctcttgatgatctctacctcttggtatttatacccttatataatctctttcctatagtgtaagctggtcccaggtacttgtttctattgaatagaatagaacaaaagaaatgagatgccacttctgagattagattataagatactgtgaatttcttcttgtgccctctccctctctctctttctcttgccctctcatttgaatgaagccaactggcatgctgtcagtggcccagtgtaagtcctgttacaagaaattgatgattacctgtagccaaccctaagtgaagaactgaggtcctcagtcctacaaatggagagaaactgaatctagctaagaaccatgtgagtgagctgggaagaagatccaccctcagttgaaatttaagatgacatattgagcagacatactgagacacactgaaagtaagagagcaggaggaaacaaaaccagggtcatacaaagaacacaactgattttgagattctcacataagtattacaccttcagtgagcacgtgtactagaaatttaaaaaataaataaaataaaccttcaaagtgagctagcaaataaatttccctatggtctcagctctgagtggagagagaaaatgttccctgtggagtttatagccagaatccagctctcaaacaggtttcagcctgaactcacacaatctgtgtggcttccaaatttgcaagctgagaatttaattcaaagtggtctcaggttgatagcagtccaaaatgctaggtaggaaaaaaaatcctctctggacaaataaatcatcaaagcaagctcataagagcaggtttcaaaggtcatgagcttctaacacacacacaaaaatcacacacacaaaatgggggtagcagcaacatgggtagcgtattcaaacttgaaaagactttaaatatttgtattattagatgtagattatgaaacacatattttaatgtggttaatttttttaaggaatcaaaactatgagtaaagaccaagaaaattgtgctggatggccacttccaccatggctcccctcctatttaagtctgggtactgtgtcacccgaagtcttcaggcacattgttccaggtctgggtttgcctatgaaagaaactcatgagagctggaaatgaggagtgaagaggaggtcttcaaataaagcaggcttaaggattagacatagcaggtttgacagatgtgatggcttgcagaatcctttatgagctcccactgtccatctggataagatttacagacctttcagaaattcctataagcttgggttctgtgcccacactctagactgtcaggctaagatctctgatataaaacagacctcttctgattttgtctagctgcttttctaatatctattcaccaagctcttccaataatagcataaggccctaattaatattaaacttttatcattataatacataggatgtcttctgttttcctgatcaaattctgactactattaaaatataaagaattgtccagaaatatataaaaaaagaatcacacattgatcttctttaaatgaaaatataacaattgtatggactaggatgattacagttgttcagttctgactgttatttgaagaaaaaagcaataagaagcctcagcaacttaacagaaggagctgccatttactaggagaaaagattgtggatgagagtgtagcaaaggtcagaattctgtgaagcttgagatgtttattataatgaattatcttttatactcactacaatttcctaacaattttggggtttatatttttgaaagagatatacctttaattttctttctttgtactattgttaggtaactttgatgtgcagattatactacagtgaaagttgccaatgacaaggcaaagtcacttacatcagacccaaagcaaagtggagccgggtcatgaaaaaggggatcttgtgtgtctgtccacgataagcactatcacaaggactttctataaactcacaagaaatttctgcccacccagcacactctgtttgtccagctcatcctgtaggtgtctctataataggacctatcataaaaaattcctcaagactgcagcatttcagataagccaccctcacaagaacacttgcctagcaatggctgtttctgccagtaagttaacaccagctcctgcatcagaccctgtgaccaatgatgtttgtttcaaaacagcttgcatggacttctttttgtctttacatattttccttacctcaacctcttgggatgcacctatgattgatcatagcacaaatatctcagattataatccttgtttatttccaaataaatttatttctttggagatccactttttctgttattatacattgacattgttattatgaaattggttgggtgatgtgtcttattttcttgtctccagaagaatttctgtaacagtgcaattaaacgttctttgcatgtttgctagaactcacctgtaaaattgtctgagcaaccaaagcctggtttttgtgtttagtttttcttttgtgattggggaggggggtttatcgtactgattcaaggtgtgaaggtaacatcattttgattttatacatcttcttcagtccatttaagcatgttacatagcgttgtttgttcttttcatgatattctttacagtagtctcctaaatgttccctctgcttctgccatgagcccctacaatctatttcaactcagaagctatagagtttgtttaaaacatgtaacatattatgccacctttcttactgtaaaacatcccatggtttctcgtagtatttatagtaaaagtgaaatttttatgatggcttgagaaacttttcccattagatgcccaagtgctggtctggtctgatcttctcatcttcccttgggtgattctgtggcagtcacactagcctccttgctgctccacaaaaactccagcatgatcctacttcaggatatttgccattgttactgcatctgcctggaaccttttctcccatataaacatagagattgctcttgcctgtccttcaagtctattcttaaatgtcccattctctgtgaagctttcctgcccaccctatttaaattacagacttcactcccaattccccatctactttaagagtcttcatttatcattccttgacaaactgtaaatatacatgttcacttttttatcgtctgtctccaaatactggaatgttaagttctgtaatgtcagatatttctgtttggttcactggtgtattcttaaagcatgttacatactaggtatactcaatgaatatttgttgaataaatatcacattgggcttattccagaaattcaagcttgtttcaatagttagagcaatctacaaatgtaattccttacattaactaattaaaggagctaaatcacatcaccaccacaataatgcagaaaaccacatttgatacaactcaatattcatgtctgcctaacaaacatctcatgatactaggaaaagaggaagggatatattattttcatgtataaagcactaaccattgtagcatgccaatatactcaaaattcaatgaaattcctatcaaaatcttagcattcctcttagccctcaacaaagcatttctaaaatgtgtatagaagaccaaagggccaaaagagtcaacttctgaagaagcgcaaaaagaaagttgaggaaatcttaaaacatgttattgagcttaaagttgcaaaaataaactcatgtgccataattcatgagtagaaaaatagactagtggaataacataaaaataaaaacaatgcttacataaaatgttgtaactgatttggatgtcattagaaatcagtaagtaaatagatggacaatgtaatgaaagatgctaggcaaataatgtggtagggagaataatggccctcaaagatgcccatgcctaaccctggaacctgtgaatatgttacactgaatgcaataaaggcttatcagatgtgattaaggatgcaaaccgagatggagagatcttcctgggttacccagatgggcccagtctaatcacatgagttcttaaaaatggagaacctttcttagctgagtccagagagagatgtgacaatgaaagaatggtcagagaaatgtgacattgccagctttaaaaagagagaggagaggcaatgagaaaaggaatgctgatgttctctagaagatagaaaaggccaggatatggattctaccctagccaccataaagaaacatgcctgtcgacaacttgattttagttcactaaaattcatgcctgatttctgacttgtgtacactgtaagatgacaagtttgtgttattttaggtcacttagtttgcagaaatttgttacagcagtaatagaacaagtggttatccatatgaggcaaattagattggatacctatctccaatagaaatcaattcaaggtgaattccaggaaaatacttaaaacatttagattaaaaataaatgagaatttttgttacttttggtaggtcatagaaccaagaaaaacaaacattaaggaggaaaaatgaacatatgactacatcaaaatataaagcttctctatttggaagatatcataaggtgacaaatcataaactgtaatatttacaacatatatataagtgaataaatatacatttagaatatatatgaactcccaaaaatcaacaggaaaaataagacatagaacaagcaaaatgcataaacaaaagaaggcaaaacaaaaataatgactcataattatatgaaaagaagctcatcttcatagatgagcagataaatgcaaattaaaaccaccctgagatgctttttacatccatgagcctgataaaagttagagtctaaaagtaataattaacaaagatgggaagtaacagaaaatcttgtccattactggttaaagtataaactgatacagctactttatagaatattacattatagaataaagttgtgagtatgtatatgcagtgactcagcatattcattgctagtatgtactcaagagaaacttacaggagtggactaggaagtaaatacaaaatgattacaacattgtttgttatatcaaaaaataaaaaagacacccaattttccagcaaaaaaaataagtaaaaataaatcctggtgtattctaacaatggaataatatatagccattaaaataaatcaactattactgtacatatgaatgtaagtatcagcaaaacatattgtttagtgaaaaactaagaagctgaagaagaatatatacaatatggttacatttatatgaagtcccaaaacttgcaaaataaagaaatgtatttagaaatagattcacatgtgagaaaactagaagaaaattaatgaaaggataagagggatagcagtaattctgagtagttgagggaatttcaattggaaaaaaataatatcatattctttaagtcaggtagtgggtattagcatttgttttaccatcgttctttattcttatagctacactatatattttcaatgtatttaatatattttttgcataattaaatattatgcaataaaaatgagaaaacaaaaaagtagaaaatgataaattacaataaagaaatggagaaaaaattataatctagttgagtaatggtatattacatagctattttcttaagtagatgtatgtacatgatgtatgcacgattgtacatacatgttcttaattatatataaatatatatgtacatatttttaatataaaatactaaacaaagtacaccaaaatattagctcctatgttagtgagataatgttttgtttttttgtattttaagttttacatagtaggtgtatttttctgttttcatactgctataaagaactgcccaagactgggtaatttataaaggaaagaagtttaattggctcacagttcagcacagcttgggaggcctcaggaaatctacaatcatggcggaagacaaagaggaagcaagccagcttcttcgcaaggcagcatgaagaagtgccgagcaaaggggaaagaatcccttataaaaccatcaaatctcgtgagaactcactatcacaagaacagcacaggggaaactgcccccatgattcaattacctccacctggtctctcccttgacctgtggggattatgggggctatggggattacaattcaagacgagattcaggtggggatacaaagcctaaccatatcagtaggcatgtattgaattttaaactcagagaaaaatactagtgtttttataggattcttactaaagaaaaaccagaaagtaataaaccatctacgctaagacataaaattcagttgtttagttacaagatagaatgtggccttgtaagaaagcaaattaacttctaacatacaaagccttagagaagattcaagtgactgacggatcttaaacagagctattattacaacttgaactgcagtaaaatatcctcagcaacatagatgtgtatgtttcactagtcagagcaatacaaatttaacgaaactccattggtggtgtttttaatcagacaatttctgaagatgtcctggcttattcacagatgcaagccaaatctctagaagagtaccataataagaaaaaaaagaatacaggcaattgagagctgttccaaagtttagggagtttttgtaaggaattaataaataaaaatgttcttgaaagagagaaattaatatgcagttcatactgccagaattgcaggcaatttatcaaagtcccctaatcctccaaaatcgctatttttttttttgacacacactttacagtacagaagaaaatgtctccggcaataaatcacaaagttaaaattacctagtctacaattaactacacagtgatggtaaatcattttctaccaaaagaaagaaatgtcttgtctattcaggttctgctctacttaaaagttttccttgttggcgagcaagtggttagaaaatcatattttatacgtacattcagcttaactatcattcagctcaggaagatgactcagggccttatccataccttcaagtttgctcttagcaagtaattgtttcagtatctatatcaaaaatggcttaagcctgcaacatgtttctgaatgattaacaaggtgatagtcagttcttcattgaatcctggatgctttatttttcttaataagaggaattcatatggatcagctagaaaaaaattaagaggaaaatcacatggaaagttatatattatatatctattatatataatattatatatctattatatattatatattgtatatctattacatatatattatatatgtattatatatattatatatctattatatatataatattatatattatatatcatttccaaattccccagcgttcatatttgtcagtgcaagtaaagagccttactgctgatgaggtttgaggtatgaccatttggccagaatttatgaactctacatgtcgcttgatgtgtgcctcagggtatactttttttttttttttgagacggagtcttgctctgtcgcccaggctggagtgcagcggtgcgatctcagctcaccgcaagctccgtctcccgggttcatgccattctcctgcctgagcctcctgagtagctgggactacaggcgcccgccactatgccctgctaattttttgtatttttagtacagacggggtttcaccgtgttagccaggatggtctcgatctcctgacctcgtgatccacccgcctcggcctcccaaagtgctggaattacaggtgtgagccaccacgcccggccagggtacacttttaagcagagacactactttgaaggtcataaaaaatataataagagataaggctaatttcctttaataataataaaatcctttaataaaaatataaaggaataatataataattttatttaataaaatataataagagataaggctaatttcctttaataaaatatagtaactacataccaacagaattccaaaaaaagaaatggagaggaagggagcatgggtcattaatcttgtcaaaaatataaaattatatacgaggaattcctagaaactgttttccttgtctgcggccattgtgctgctgctacacaactaccgcaagcagcccttcacgccctcctcccagtacaaagctaattgacttgtgagaaatgttaagcttggaagagtcagcatcgctgcacttattttttattctactctgacattagaataatccttgagtgggggaaaggttaaaaacccccctggataagtgttactaattaatgatgattgttttaaacaatgtttggataatttttccttgtcccttgacataaacttgataaataactgagaagtgagaaggagattagtgggttgattaaattccattcaggtacttaaagttagctccaaaaatttagctatttgtaaattgtcatgcattgttaatgtataagagatgtagatttcatttatctttggtggagcgagatgaagcagtgaatcattgaagactgaaagaaagaaaaaggtcttttcccttttctttaagaagcatcattagttaaaaacatgttagttgataccagagaactatatttaaagggacagcaataagcaaattgattactctggtgattattggagtgacattgccttttagttgtactttcacaaaaattcacaatatttgccaaagtcaagttatccattacactattaatttgtcattcttttgtttatatagtcaatctctatctcaattggatctatctcaactgcttctaaacaagccaccatagtctctcccatttcaacaatctcttccaagtaccacttcatttcttcttttcatatttttgaaaacttttgaaaaactacctattttcctcctccatttcttgttcattccattctagtggacatggaatctgttcctcctccaaaacggaatttggtaacccttaaattactaaacccaaaacaacatgttgtctttatctttacctctctgtggcatttaatgataagaccactactttcttctcttttacccttctttcttgaattcagtcaaacaacgtacttacatttttcgtcttattctccatcttagaaaccacctcagctttctccattcagctataaaattgtgcttttcctcaaagattaatctgcctctcctctcactctatactatctctgttagctaattttatttgtgcacattgcttatactgggcattatatacacatatgcatgtgtgtacatgtgcatacacacactgtatgtggacatgtatatatatatatgtgtgtgtgtatatatatagtatatatataaattacaataacataaaggtggcattttaaattagtggaaattaccctgatttgatcactacacattctatacatgtaaagaaaatatcactctgtatcccaagaatatgtacaattatggtttgtcaaatgaaaaagttcatacattgaaaaattttagataaatatcaaactttctctgaaactgtaactgtaaaatgtaaaaaacagtaattgctatattgcttatttctgagtagaagaatatgagacatttccctaatcattatgtgtaattacaattacatagaagaatatgagacatttccctaatcattatgtgtaattacaattacatatatatatgtaattgtaattacacataatgattagggaaatgtctcatattctatatatatagacagaaagagagaaaatatatgagggagagaaggaatctttccatctcctttgagttccacggtgttgagagtcaggacaactgcaattgcttcatcatgcctgcttgcaattatagggcttttgaaccatttgttccctccttagatatcctcatttttttcagattcttgcttagaagtcactcctccgtggacctcctctgacatattaaacattgcagtccattataagctgcaagaggacagggatttttgcctgttttattccctactgtatcaccaggggctacagcaatatctgacaaacagtgggcatgtaatgaatatatgttaagtgaagtaataaattcaatcaaatcacatcacctgtttaaagcacttcattggcttcacattgcacttagaataaagagaaattctttttatacaatataagttcctgcagaatgcagacactttctacttctccagcctcttttcgactcctctcctactagcttctgtatttaagccacattagacctttcttcagttttttatatagactttgtcgcatcacacctcagagattctgtacatgttcttcctcctgcctagaaaggatcgtccctccactttcgccaactaatccctgctcaacttttcatctcagcaggaggcccattctctttggcaatcctctggcctccagcccatttattatatgctcacatgtcaacatgtacttcgtacagcatgtaacacaattgcacttttatattttaacaaattatatttcccatattgaactgtaagtctcctgaaagcaggaattttgttcttgctcatcatcaactttttcaacatccagtgcaccatttagaacttagatgtagtcaatacaggtttgtggaatgaaagaggaaaagaaagaattaatattcctttaaattaggatggcaaagatcgtatatagaaaattggctaagttgtggtccattcatgtttgctcccaattaaggagcacagctatgaaaaggaaggcttcaaattaataaccaatagatttttttaaaaagaaaactggccaggtactgtggcttatgtctgtaatatcagcatgttgggaggccaaggcaggattacttgagcccagaaattccagaccagcctgagaatttggcaaaactctgtctctacaaaaaatacaaaaattagccaagtttggtggcatgtgcctgtagtaccagctacttgggaggctgaggtggaagaatagcttgagtctgggaggtcaaggctgcaatgagctgtgattgcaccactgcactcaagcctgggtggtagagtaagaccctgtctcaaaaaaaaaaagaaaaatcactaagcaaaataagacatgtgaaggatcatgtcaaaggtaagaaaaattaggggaacattaaaagctttcttcccaagccactaaatcaacttgactaacaaaattaccacttgatttagcattagaaaattacattacatatcaaacataaacccattaatcaaatactaaagaaatttctgagttaaatggtataatgttagcttatgccagagctgaccttgaaagattgttcaaatatggctcagtgtgattgaaagttctgtgtgaatatgtttttggaaagatccaacagcaacaccttagtgtatgtttttgaaataaaatgtatctgagtagcagcaaagttattctcaaatttccattttatagctggagatgtcataccgtgacgtatatgataggacccaatatggatcaatcccttttagaagtcaatcaggaagaggggagcagttaaaacagttgcttggtttacaaacattagaacaattttcttattcacaccatctgattattgtattttattttttccccaacgtttagactacacaatgagttaagaatgataaaaataagctcaccaatatactatgtacatatttaccaaaatctgtgcatgcttatacatataaacacagctgataatttattagttaggctcatttgtaatttttgtcactatagaccagttttttatttaaattgaagattagtatacattttaaatgattagtcaaaataaaaaatctaaaatgtgctctaaatacctcttaggtcagaaaaaaaaagtcaaaagctagagtatagagaaattaagaaacgccctaaatttctaatctgacaaaaattcatacaagatttaaatattttaatggaaaatagaacagaactaattattgaagaaattatagaaaggaaacaaaataaacagattatatggaggatttttagaagataagtaaataaattaatatactaggaaaaaacaagggaaatatacttgataaataaatacaggtaagagttcttttgaaataatgataaaatagaaaatctctgtcaaaactaaaaggaaagatgcataaatatataaataaatgataaaaaatgttgcatacatatatgactttttcagaatcaaaaaatttaaatttctgtaataaaatttaaatgtttataaatttaaaaaactagaagaaagaatgttgactgttcacaatacaaataaatgacaaatatttgaggtgatggatatgctaattatccttatttgatcattgggcattgtatacatgtatcaaaatatcactctgtatcccatgaatatgtacaattatttgtctcaaaaacaaacaaaaaaaaagataatgggagaatgttgaaaactcagagagaagagcaactctcacagatagggatccagataacattagcagctgatttctcggcagaaaccttgaaggccagcaggcagtggattatatatttaaaataatgaagaaacctgtcaattgagaaatatatagctggaaaacttatccttcaaaaatgaaggagaaattaagacatttccggatttttttttaaaactgaaaaaaatccatttatccctgaatttgacattcaggaagtgttaagtccttcaggttgaaataaatgaactctaggcaataactatgtaagtaaataagcaagctgtatgaatatacaaagctctctggtaaaggtaaatacataaacaaacataaaaacagtcctattgtaattttggtttgtaactctgctttttattttctacataatttaaaaggcaaatgcataaaatgtaattgtaaatctgttagctggtatacaatgaataaagatataatttgtcacatcaataacataaaaagagtagagctatatatatagcagtagaattttggtatgtgattgaacttaagttgaaataaattcaaattaaaatgttataactctaggatgttatatgtaattctcatagtaaccaaaaatgaaatatatatagaatataaacaaaaggaaatgagactagaaacaaaatgtgtcactacaaaaaaatcaactaaagataaaaaagaaataattgagaaaatgattggcaaaaatcagtaactctgacgtattaaaactttccatgctacataaatctgaaaactctatttcacataaaactggagctgaaagaaacaaatatttacctataaagttaaaagttatatagggaacaaacactaattttttttagaaaaaattataaaaagtaaaaatatgccttatactaccgtaatttcatgttttacagctctgggaaaatagaaaataaaatgttctgttagcatgaatccctctgtgcccccaaaaaaccctatggattgcatcattattacctaaaaagtctattctcaaatgcagcagagtgatattttttacaaggtagatattaattttagatatggaataatattgatgatttcaattttataacactgggttaagatgaaagaatgagaagataaaggtccctcagcaatataactcacaaacatgttcagaagcagtaagaagttacattaattatcttttgaaagtcgataatctacatctttaatgtatgcatatagcatagctaatgtactatcgctgggtccatttattcaatgaataattgccgctatgtgtcagacatttttctaggcctaggaatggatacataagtgaacaaagcaaagattctggttcttgtagagtttccattaaaagacaatttagtaaaacttttcttcccccaaattataaaatctgtaagatgatttaacaacatgtgtaaaagtcattgtgggccaggcacggtggctcataccaggtgtggtgactcatagcactctgtcacccaggctggagtgcagtggcacaatctctgctcactgcaacctctgcctcctgggtacaagcgattctcctgcctcagctttctgagtagcaaggactacaggtgcacaccatcacgcctggctaatttttgtactattagtacagacggagtttcaccatgttggccaggctggtctcaaactcctgacctcaaatgatccgcccacctcggcctcccaaagtgctggaattacagatgtgagccacaatgcccggccttattttctacaactttggtaactttagcatataccccaaatctgtaagacataatattataattcaaatgcaactcatggcttctctttgtactctttctctagcttttgaattatttattctaataccagttttaattctgacacaaaatcatgggagttctaatcaaaatccaaccttttatcataaaaactatgaagaaattatgagtagaatttaaaaaggaaaataggcctattaattagatttgtctttgtagcatttaactctataataaataatattttatgcctatgagtccccaacaaagcctccagcttctatttagatacaaactgtaaaagtcactactggatccacaagcaagactatggtaaataaatttctccacctaaccagcttcttttacatgatgttacatgtttcttttgttttttcattttggcaaatattgattgtcatcttcgtgtttgtctatgtcctaagtgctgggatacagaatctgaaaagatggacacaggacctgccttcaagttcacccccttttttttttttttttgagatgcagttttgctcttgtcacccaggctggagtgtaatggtgagatctctgctcactgcaacctccacctccagggttcaagtgattctcctgcctcagcctcccaagtagctgggattacaggtcccagccaccacgcctagctaatttttgtatttttagtagagacagcgtttcatcatgttggtcaggctggtctcgaactcctaacctcaggtagtcgacccacctcggcctcccacagtgctgagattacaggcatgagccaccacgccctgctaggagttcacgctttagttggggaaaatatacaataagcaagccagtttttaaaatgagaactgcaattagagttaaatgctacaaagacaaactcacaggaagatgggatgtagaatgataaggctctcagaatagtaagagaaactattgcttcttacgatgtttgtctttctttgtatcggtgctcagctgagtctgcagtgcttcagaggcagctttcattttataaaaatctatgatttctccttccagttgttttttctcttcctcgagcttccttatctcctcctgttgaatcattttaagatgctcgaacttgtcctgcagctgtgaaaccaatgtgcagttgtgacaccaaagcagtgtggctgaacacctaaaagaatacgctttttttctgattatcaaacaaacccaaatcatcacagtagagcacgatcttaataacaatctcaaaaactcaggagtaaacactcagatatggaatttttcttttctttcttttttccttttataagatggagtctcactctgttgcccaggctggagtgcactggtgcgatctcagctcactgcaacctccatctcccagttcaagtgattctcctgcctcagcctcttgagtagctgggactataggcatgcaccaccactacaggcgtgtgccaccacacctggctaatttttgtatttttagtagagatggggttttgccatgatggccaggctggtctcgaactcctgacctcaggtgatcctcccgctttggcctcccaaagacttttttttttttttttaatatagagacaagttctcagtacgttgcccaggctggtctcaaactcctgagctcaagtgatcctcccacctcagcttcccaaagtgctgggactgactggatgcagtggctcatgcttgtaaactcagcactttgggaggccaaggtgggaggatcgcttgagcccaggagttcaagaccagactgggtgatataacacaatagtcaacttcaacaggagagagaatctgtaaacttgaatatagatcttccgaaattatccagtcagaggacagagaaaaaaagaataaaagagagaaaagaaggctgggtgtggtggctcaagcctgtaatcccaacactttgggaggccgaggcaggcagattaagaggtcaggagttcaagaccagcctgtccaacatgacaaagccccatctctactaaaaatacaaaaattagccgggtgtggtggcacacacctgtagtcccagctacttaggaggctgaggcaggagaatcgcttgaacccaggaggcggaggttggagtgcaatgtgagccgagaccacacattacactccagcctgggtgacagagcatgactctgtctcaaaaagaaaaaaaaaagagacagagaaaagaaagccaacaagacaccattaagcaaaccattgtcaggttatgggagtttgagaaggaaagtagagaaaggagaataaagcttatttaaagaatggctgacaactgcctaaatcatgggaaagatttagacatctaaatccatgaagcttaaagattcctaaagaggttcaaaccaaatagatactcaccaagtcacaatataatcaaatagtcaaaagttaaagaaactttgcaggtcaggacagaatcgaataatacattcaaagtgctgaaagaaaaaaactgccagcaactaatactatgtctgacaaagctgtccttcagaaaggaaaaagaaataacgtgtttcctcgacaaacaaagctgagggcattcaggaccactaggtctaccttaaaaaaatgcttaacggagtttttcaagtaaaaatgaatgaagttgggagcggtagctcatgcctgtaatcccattttgggaggctgaggtgggtggatcacctgaggtcgggaggtcaagaccagcctggccaacatggcaaaaccccacctccagtaaaaatacaaaaaattagccaggtatgaaggccactgagatcgtgccactgcactccagcctgggtgacaagagtcaaactacatttcaaaaacaaaaaacaaaacaaacaaaaaaaacaaaacttgaggcctggccttctgctcctctccaacctccccttctctgggcccaagccaccttggctgaggagggggcgaggaggtgtgagcccctgccaggaaccccctgcccggaccaagtgctcggcccccaggcctgcgttcagtgaggcctcccgtggcgtcagcatgttcgtgtggaggaatgtggaaggtcactcttcggccgtgttctcctggtactccatccccttcctgacccctccctgcagccacacgaggcccagcaacctgccagtcactcagagtctctggcctccaaccagagaaaacaacctgccaagttggcagccgttgctcatgagcgtccaccaagtgggacagggagtgttgaccctgggcggccccctggagccacctgccctgaaagcccagggcccgcaaccccacacactttgggggtggtggaacctggtaaaagctcacctcccaccatggaggaggagccctgggcccctcaggggagtccctgctggacagtgagacagagaatgaccatgatgatgctttcctctccatcatgtctcctgacacccagttgcctctaccactcagatgatgtcaggcccagtccctcagtgccctgcgcaaggaaaaggactcatcttctgagaaggatggacgcagccccaacaaatcagacaaggaccacatccggtggcccatgagtggcgctcatgatcttcagcaggcggcaccaggccctggcggggcgcaccagggtcaccccaaccaggataaccggaccgtcagccagatgctgagcgagcggtggtacaccctggggcccaatgagatgcagaaatacaacctggccttccaggtgaaggtggcccacttgcaacaaggaccgaaagaagtccagctcagaggccaagcccacaagccaggggctagcaggagtgtaacaagggctcgtgggagcggagcatatcagagacgggcactgccactgcccctggggtgtcctctgaactcctgtcagttgcagcccaaacactccagagctcggataccaaggagcagcttctatggggcagaacggctgcacacagtcagggaacctggctcagcctggcccaagccttctcccacagcggggtacacagcctggacggcagggaaatagaccgtcaggcactacgggaactgacacaggtggtgtctggcactgcatcatactctggcccaaagccttctactcagcatggagctccaggccactttgcagcccctggtgagggaggtgacccgtgggcagccctgctgccgcccacgtgagctgctcattcccagcacatggccagcgaggtcatagcgagtgacgaggagcacacggtcatccatgaggaggagggggtgatgatgtcattgctgatgatggctttagcaccaccgacaccgatctcaagttcaaggagtgggtgaccgactgagagtggggacaactctggggaggagccagagggcaacaagggctttggtgggaaggtatttgcacctgtcattccttcctcctttactcctgccgccccttgctggatcctgagcccccagggtcccccgatccacctgcagcttttggcagtctatggtcacaccctgtcctcctcctacacatactcggatgcttcctcctcaaccttggcacccacctccttcttactgggcccaggagccttcaaagcccaggagtctggtcaacgcagcagagcgggccccctacggccccaacccctggggatgggggcccagggacgccttccaaggtggcctgtttcctcccaatggatcctgccaccttctggtgcaagagacctgaaagtgtgggtgacctggagctaccaggctcctcagtcatcagggtccctcccaacactaaggctttcctaggcaggagctgggctgagccacccggggggcagagcctgaagagaaactgactgggctttcggggtcggggcagagggaaccccacggacatggatcccacactggaggaccccaccgcgcccaaatgcaagatgagaagatgctccagctgcagtccaaagcccaacacccccaagtgtgccatgtgtgatggggacagcttcccctttgcctgtacaggtggagaagccgaggacaggctcagggaaccggagaccgagaaggcgctgtcctcttcactgcacgtaccctggaccagtgccggccctgatcatgcagctcttccaggcccactgcttcttcctgtccactaggccacagccgccctccaggcccactatgcacacatcttcccctccaaggtttgttctgcccctgccctgactcccagccctgtgggggtcctgaccgcacctcacctggctcagactcttgacgctgccctggctgccccaccactgcttctgcccgagagtcacgtgaggctgagagtaggggcaggggcagcagtggtgccagttggggggcggtccagtgggaggagcctcagcctcgcaggctgctccgtgggactgatgactgcatgatcttctgggcacctcacggatcttcaactgcaggtgaaacggatgctggtggtgggtgcagggccgctgggagctgctgcatggttcccagaggctggactgaggcaggtgccaactgaagctgctggggcagcatgggcaggatgttctgcacacaaaccttggagaagaagatgtgtgcatagcaggtccactgctgctgcccctgccctgactcccagccctgcctgaccccacctcaacctgctcaggctctggcacaaccctggctgccctgccactgcctctgccccagagttggggccttgacagcctggttggaaggggacaccccagccctgcctcaacacctgggggtctccataactaccacaggcaggtgggcaaccccaaagatcccaggactcacagtaccccctgagaacatggacagtatgtgggggtagcaatggagggcaggatggttatcttctcccaggtgaagccatttaatcctttcagtttgggacggagtaaggccttcctctttttttttttttttttttttttttttttgagaccgagtcttgctctgtcgcccaggctggagtgcagtggtgcgatcttggctcactgcaacctcttcccgccgggttcacgccattctcctgcctcagccttccgggtagctaggattacaggtggacgctaccacgtccggctaatttttgtatttttagtacagacggggcttcatcatcttggccaggctgatttcgatctcctgacatcgtgatctgcctgcctccccctcccaaagtgctgggattacaggcgtgagccaccacgcctggccaaggcctgctcctcttatctataccccctacccctgcagctgtgccgggggaaagctgggcagtttccctcctccgagcccctgtacataccatgaattgtgggaccttcagagcttttcacttttcggaaaatagctcctgctggggctacaagatggagtgtgaagagggccttgggccacagggaggcgcctgtggactagggggagttcatgcaccccttctttccccagaggggctggactcaggtgagtatgggggtgggggctcctgcacttcgacacaggcagcgggagggttttctccccattccctctgcactcccaacttgagctatactttttaagaaagtgattcaccctgcctttgcccccttccccagaacagaacacgttgatcgtgggcgatatttttcattgtgccaaaaagttgccatgaccgtcattaaacctgtttaacaccaaataataaggaaaataaaataaaaaattcgggcttggcgcagaaactcactccaaataaattacctatcaaaatatttacataatggtggaaatattccaaaattcaatattttgggatttatacacaaaagataaacaaattagaggccaagaggctgccggaagggaaaaacggggcctggaatggccgacgtgaggaatgagctgggcctaaagaggccactggcaggcaggagctggacctgccgaagtggccgaaaggcaggagctttggactggggaggccgcagtgaggcgagagctagctgggcgtggagagtctgctgtgaggccgaggccgaggccgggcccgtgcaggccttcgagaggcaggaggccgggcctgcaaaggccgactggagatcaagttctgcgcctgaagaggctgccaaaagtcaaaagcggggcctgggaaggccgccgagagccatgagctgggctgggccgaaagaggccactgggaggcaggaggagctgggcctggagaggctgactcgaggaagttttgcacctggagaggccgtcgagaggacggagctgggcccagggaggccgacttgctgctcttccaggcccacttccaggccgacttgaggacgacttgggcctgcagaggccgccgggaggctggagctaagcctggagagactgacttcgggacgatttgggcctgcagaggccgccgggaggcccaagctgggcctagaggagcccaccgaccggaggccatttggggcctgcagatgtcatcggagggccaggagctgagcctggagaggccaccgcgaggcctgagctgggcctggggagcttggcttagggaagttgtgggcctaccagggccgctgggagctgggcaggagctgagtccaaagacgttgttgggacctggagtcgggccagagtccggcctggagatgcagccgggaggaagagctgggcccggagggggcgccgggaggctgcaagtgggtctgagaggccaacttgaggaggcctggcctctgcctcccgcattgcccagctgttcctcctggctgcatctcccacctcccagcaaacaagctcttttggctcagctcccgcctgcgtttgtagaccccgaagtttctgcaaccaagctcttcagacccacatcccttctcccagtgactgaacagtcccagctccggctggagaagggcgtctgcagaccccgctgttgcctcccaggggagtctccaggcccagctctcgccccaccgcgacctcccaggcccaagtccctgcctacctcccagcagcccgagtgcgatcctgttcctccctcacggtggcctgttgaggcaggggatcacgctgacctctgtccgcgtgggaggggccggtgtgaggcaagggctcacattgacctctctcagcgtgggaggggccggtgtgagacaaggggctcacgctgacctctgtccgcgtgggaggggccggtgtgaggcaagggctcacactgacctctctcagcgtgggaggagccagtgtgaggcaggggctcacgcctctgggcagggtgccagaggcatgagttgggcatcaacaggccaccgtgagggaggagctgggccgcacgcgggctgctgggaggcaggcagggacttggccccgggaggccgccgtgggggcaagagctgggcctggagaggcccctgggaggcaagggaggggcctgcagaggctgttctccaaccagtgctagaactgtacaggccaccaggaggcaggaggtgggccctcagagcttggctggagaaagttcggggcctacaaaggcggttgggagctgggcaggagttgagccaaaagagcttgcttacttgctgggaggcagggccgggagagcctgacttcaggacaacttgggcctgcggcggtcgccgggaggcccaaccttggcgtggaggagcccaccgaccggagaccatttggggcctggagatgccatcggagggcaggagctcatcctggagaggccaccgtgaggcctgacctgggcctggggagcttggcttgaggaagctgtgggccgaccaaggccgccaggagatgggtaggcactgagtccaaagaggttgttgagaggcaggaatcgggcctggagacccaaccaggaagaagagctgggcccggagagaacgcccggagggtgcaagtgggtctggagaggccgacttgaggaggttctgggcccggagaggccgccggaagggaaaaactgggcctggaaaggctgttgtcaggaatgagccccatgggcctgaagaggccactggcaggcgggagctgggcctgccgaagcggccgagaggcaggagctttggactcgggaggccgcagtgaagcaacagctagctgggcgtggagagtccgctgtgaggcagaggctgggcctgtgcaggccttcgggaggcaggaggctgggccttgtcgaggcctgcagaggccaccgaaagtcaaaagcggggcttgggaaggccgccgggaggcatgagctgggctgggccgaaagaggccactgggaggcaggaggagctgggcctggagaggctgccgaaaggcaggagcttcgcctgaggatgccacagtgagacaccatctgggtctggagggtccactgtgaggcagaggctgacctgtagagtccgacagtagacagaagttgggcaaaagcctgatttgaggaagttttgggcttcaagagtcagccacgaggcaggcactaggcctggaaatggactcacagtcatgagttgggcctaaatgggccactgtgagggaggagctgtgcctgttgaggctgctggcaggcaggcagaaatttggcctggggcagctgccatgaggcaagagctgggcctggaaaaagcccctgggaggcaagagcagggcctgcagaggctgttctcaagtcaaagctgggcctgttgatgccaccgggaagcagaaggtgggcctggagagtttgacttgaggaagttttgggcctacattggccgccatgagctggacaggaactgggccaaaaaaggctgttgtgaggcagcagttgtgcctgtagacccagccaagaggaagaggtgggcctggagaagcccccatgaggcagaggttgggcctgtagacgctgacaggaggcaggagctgggcctggacaggtcaacttgaggagattttgggccttcataggccaccaggaggcagcagttgggactagagagtctgacttgagtaagttttgggcccggagatgacgtcctgggacaggagttgggcgtggagaggccaccgtgaggcataagctggatgtagagaggccagtgtgaggcaagacctgggcctgtctaggctgctgggagacaggcaggaatctggccagggaaggttgccatgagacaaaagttgggcctggaaaggcccttgtgaagcatgagcttggcctaaagaggccactgggtggcaggagctaggtgtgtagaagctgctgaaaggttgggagcttggcttggggggtccacagtgaggtagatgctgggcgtgaagaatctgctgtgaggcagactttgggactgtagaggctgacgggaggcagaggctgggcctggaggggccaccaagatgcaggagctgggcctggagaggctgcaaagaagcatgagctgggcctggtgaggtcgacttgagaaagttcagggcctggagagaaggctgggaggcaggagctgggtctaaagaggccattgtaacgatggagctgtgcctgtggaggctgttgtgaggcagtagcctcatctgcggaggctgccgtgacatagggtatgggcctaaataggccattgtgagtcatgagcttggtctgtagaggctgactggagaaagttctgggcctggagaggctgccgggaggtaggagctgggccaaaagatgtaagcacatttgcatttattaggcactttatttccattattacactgtaatatataataaaataattatagaactcaccataatgtagaattagtgggcgtgttaagcttgttttcctgcaactgaatggtcccacctgagcgtgatgggagaaagtgacagatcaataggtattagattctcataaggacagcgcaacctcgatccctcacatgcacggttcacaacagggtgcgttctcctatgagcatctaatgctgctgctcatctgagaaggtggagctcaggtgggaatgtgagcaaaggggagtggctctaaatacagacgaagcttccctcactccctcactcgacaccgctcacctcctgctgtgtggctccttgcggctccatggctcaggggttggggacccctgctcaagtgcatccaaagcgacccttcccacaccagtcttcacagtggtcaagggcagcaaccacttagctcccaaggcatgtgcctcagctggcatttcgtcacaatcaacagtaagtggtagcttgagtcactgtgaggtcacctactggaaatcaccagcaccccatttcccactggcaaagagctcagcactgccccctgggaaaccaaacctatgcccaaatcccatctgtgtgggtctacctcctgggacccttcctaacatattagtcagagtccaatcaggaagcataaaccactcaaaagtttaaagtggtaaaatttaatacagagaattattcattataacaggtgaacagcataatgagagattggctagcacagagtaaagagaactctagagaatatgggactagcccaggccaggcatggtggctcatgcctgaaattccagccattacagaagctaatgcaggaggattgcttaaggccaggagctagagaccggtctggacgacacagtgagaccctgtctctatccaaaagaagaaaaaagttagctgggggtggtggtgcacacttgtagtcccagctactcagaatgctgaagtttgagcctgggaggtcaaggctgcagtgaggcatgattatgccactacagtccagccggatgacagagcaagaccctgtctcaaagaacaaaaccacaacaaccatttacagacagaaaagaaatagagctaataagctgaggaaagatgttgaaatgtgacaagtaaagtaatatgaggtcttttgtctatttaaaataatcaaacaaaaaatggcttacgaaattataataccctgtgctggcaaaggtgcagtgaaatgggcactttcttatactatgaggggtggttaaattgtgtataagccttccagggtaaagcctgtcaattttttaaaataatggagacagggtctcaccatactgccatactgcctcctccaactcttggcctcaagcaatcctcctctcttagcctcccaaagtgctaagattatagctgggaggcacccaaaaccctgtcaatttacatcaagggtaaggagaatgtccattcaccatgactcacagtaatcttacttctggggagacaattcaatctaagcaaaaggtcatctgtacacacacagtaaaaatctgggagtaactgaagacagagttggtaagtgaaataagaaacagttataagaaattaaactatggtatcaataggcacctggtaaaaggtcagttgatgttagctgctacttttttgttgttttgagacagggtctcactctgtcacccaggctggagtgcagaggcctgatcatgactcactgcagtctcagcctccctgggctcaagtgatcctcccacctcagcctcccaagtagctgggactacaggaacatgccaccacactaggctaattcatgtatttttctgtagggatggtgactccccctttgtttccaaggcctatcgcaaactcttggcctcgagccatcctcctgcctcagcctcccaaagtgttgtgattaccagtgtgagccaccacacctggccagctgctacttttatcaatattattcttattccactcaattaaaaattattattttcaaggctatgcaacagtatgtatcctacagcgtaattgtaaaaacatacacagtcgtcatccctcagtatacagaattagttccagccccccatctctgcatataccaaaatccatgcttactcacgtttcgctgtcacccctctagaatccacgtatacgaaaattccaaatgttagttgggcatagtggcaagcacctgtagtctcagccacgtgggaggttgaggtgggaggatcgcttcagcctggaaggttgaggctgcagtcagctgcgatagcactactacactccagccttggacaacagagggagaccctgtctcagaaaaaaaaacaaaataaaacaggttagaaattgtaatgaggtctgctgggcaaaattccatataagcaatgtataaattaataaagcaaatcgtgataaattagtacgattgactttctggagtttctgacaataaaagtaaggaaaatgcagaacacaaagacagagagtaaaaagagaaattaggaaagcattctacatgttgaataggaagacactggccatgttcgtgcagcggcagtatgtcgtgacatgacataccttggagagaagttaacagatgaggaagttgataaaaatcatcagagaagcaaaatactggtagcgacactcaagtaaaccatgaaatttccataacttatgtcagcaaagtgggaatattgtacagtgtgtgttgaagttcctatacaacattgtttatctgccttttgtttgtttgtaaggaatgtacatactaaaagttcttcttgctgtcaaaagaatatgcgtgaataagtcattttaacttattcttctgtttttcttttatcttcctgccatcatcccacagccttactttagaaatttcttttttagaaaattgaacaagtgctccctgtggtggcacatacctcgaggatgggaggcaggggtggaagggtcacttgaggccattagtttgacaccagcctggccaacaaagtgagaccccgtgtctacaaaacaatttaaaaattagccaagtatcgtcatgtatacctacagtcccagctatctgaacttactgagaatgttcagggcctggagagaaggctgggaggcaggagctgggtctaaagaggccattgtaacgatggagctgtgcctgtggaggctgttgtgaggcagtaggctcatctgcggaggctgccgtgacgtagggtatgggcctaaataggccattgtgagtcatgagcttggtctgtagaggctgactggagaaagttctgggcctggagaggctgccgggaggtaggagctgggccaaaagatgtaagcacatttgcatttattaggcactttatttgcattattacactgtaatatataataaaataattatagaactcaccataatgtagaatcagtgggcgtgttaagcttgttttcctgcaactggatggtcccacctgagcgtgatgggagaaagtgacagatcaataggtattagattctcataaggacagcgcaacctagatccctcacatgcacggttcacaacagggtgcgttctcctatgagaatctaacgctgctgctcatctgagaaggtggagctcaggcgggaatgtgagcaaaggggagtggctgtaaatacagacgaagcttccctcactccctcactcgacaccgctcacctcctgctgtgtggctccttgcggctccatggctcaggggttggggacccctgctcaagtgcatccaaagcgacccttcccacaccagtcttcacagtggtcaagggcagcaaccacttagctcccaaggcatgtgcctcagctggcatttcgtcacaatcaacagtaagtggtagcttgagtcactgtgaggtcacctactggaaatcaccagcatcccatttcccactggcaaagagctcagcactgcccccgggaaaccaaacctatgcccaaatcccatctgtgtgggtgtatctcctgggacccttcctaacatattagtcagagtccaatcaggaagcataaaccactcaaaagtttaaagtggtaaaatttaatacagagaattattcattataacaggtgaacagcataatgagagattggctagcacaaagtaaacagaactctagagaatataggactagcccaggccaggcatggtggctcaggcctgaaattccagcaatttgagaagctaatgcaggaggattgcttaaggccaggagctagagaccggtctggacgacacagtgagaccctgtctctatccaaaagaagaaaaaagttagctgggggtggtagtgcacacttgtagtcccagctactcggaatgcggaagtttgagcctgggaggtcaaggctgcagtgaggcatgattatgccactacagtccagcctggtgacagagcaagaccctgtctcaaagaacaaaacaacaacaaccatttacagacagaaaagaaatagagctaataagctgaggaaagatgttgaaatgtgacaagtaaagtaatatgagttcttttgtctatgtaaaataatcaaacaaaaaatgacttactaaattataataccctgtgctggcaaaggtgcagtgaaatgggcaccttcttatactatgaggggtgtttaaattgtgtataagccttcccgggtaaagcctgtcaattttttaaaataatggagacagggtctcaccatactgccatactgcctcctccaactcttggcctcaagcaatcctcctctcttagcctcccaaagtgctaagattatagctgggaggcacccaaaaccctgtcaatttacatcaagggtaaggagaatgtccattcaccatgactcacagtaatcttacttctggggagacaattcaatctaagcaaaaggtcatctgtacacacacagtaaaaatctgggagtaactgaagacagagttggtaagtgaaataagaaacagttataagaaattaaactatggtatcaataggcacctggtaaaaggtcagttgatgttagctgctacttttttgttgttttgagacagggtctcactctgtcacccaggctggagtgcagaggcctgatcatgactcactgcagtctcagcctccctgggctcaagtgatcctcccacctcagcctcccaagtagctgggactacaggaacatgccaccacactaggctaattcatgtatttttctgtagggatggtgactccccctttgtttccaaggcctatcgcaaactcttggcctcaagccatcctcctgcctcagcctcccaaagtgttgcgattaccagtgtgagccaccacacctggccagctgctacttttatcaatattattcttattccactcaattaaaaattattattttcaaggctatgcaacagtatgtatcccacagcataattgtaaaaacatatagtcgtcgtccctcagtatacagaattagttccagccccccatctctgcatataccaaaatccatgcttactcacgtttcgctgtcacccctctggaatccacgtatacgaaaattccaaatgttagttgggcatagtggcaagcacctgtagtctcagccacgtgggaggttgaggtgggaggatcgcttcagcctggaaggttgaggctgcagtcagctgcgatagcactactacactccagccttggacaacagagggagaccctgtctcagaaaaaaaaacaaaataaaacaggttagaaattgtaatgaggtctgctgggcaaaattccatataagcaaagtataaattaataaagcaaatcgtgataaattagtacgattggctttctggagtttctgacaataaaagtaaggaaaatgcagaacacaaagacagagagtaaaaagagaaattaggaaagcattctacatgttgaataggaagacactggccatgttcgtgcagcggcagtatgtcgtgacatgacataccttggagagaagttaacagatgaggaagttgataaaaatcatcagagaagcaaaatactggtagcgacactcaagtaaaccatgaaatttccataacttatgtcagcaaagtgggaatattgtacagtgtgtgttgaagttcctatacaacattgtttatctgccttttgtttgtttgtaaggaatgtacatactaaaagttcttcttgctgtcaaaagaatatgtgtgaataagtcattttaacttattcttctgtttttcttttatcttcctgccatcatcccacagccttactttagaaattttttttttagaaaattgaacaagtgctccctgtggtggcacatgcctcgaggatgggaggcaggggtggaagggtcacttgaggccattagtttgacaccagcctggccaacaaagtgagaccccgtgtctacaaaacaatttaaaaattagccaagtatcatcatgtatacctacagtcccagctacctgaacttactgagaaagttcagagcctggagagaaggctgggaggcaggagctgggtctaaagaggccattgtaacgatggagctgtgcctgtggaggctgttgtgaggcagtaggctcatctgcggaggctgccgtgacgtagggtatgggcctaaataggccattgtgagtcatgagcttggtctgtagaggctgactggagaaagttctcggcctggagaggctgccgggaggtaggagctgggccaaaagatgtaagcacatttgcatttattaggcactttatttccattattacactgtaatatataataaaataatcatagaactcaccataatgtagaatcagtgggcgtgttaagcttgttttcctgcaactggatgttcccacctgagcgtgatgggagaaagtaacagatcaataggtattagattctcataaggacagcgcaaccttgatccctcacatgcacggttcacaacagggtgcgttctcctatgagaatctaacgctgctgctcatctgagaaggtggagctcaggcgggaatgtgagcaaaggggagtggctgtaaatacagacgaagcttccctcactccctcactcgacaccgctcacctcctgctgtgtggctccttgcggctccatggctcaggggttggggacccctgctcaagtgcatccaaagcgacccttcccacaccagtcttcacagtggtcaagggcagcaaccacttagctcccaaggcatgtgcctcagctggcatttcgtcacaatcaacagtaagtggtagcttgagtcactgtgaggtcacctactggaaatcaccagcatcccatttcccactggcaaagagctcagcactgccccctgggaaaccaaacctatgcccaaatcccatctgtgtgggtctacctcctgggacccttcctaacatattagtcagagtccaatcaggaagcataaaccactcaaaagtttaaagtggtaaaatttaatacagagaattattcattataacaggtgaacagcataatgagagattggctagcacaaagtaaacagaactctagagaatatgggactagcccaggccaggcatggtggctcatgcctgaaattccagtaatttcagaagctaatgcaggaggattgcttaaggccaggagctagagaccggtctggacgacacagtgagaccctgtctctatccaaaagaagaaaaaagttagctgggggtggtggtgcacacttgtagtcccagctactcggaatgctgaagtttgagcctgggaggtcaaggctgcagtgaggcatgattatgccactacagtccagcctggtgacagagcaagatcctgtctcaaagaccaaaacagcaacaaccatttacagacagaaaagaaatagagctaataagctgaggaaagatgttgaaatgtgacaagtaaagtaatatgagttcttttgtctatgtaaaataatcaaacaaaaaatgacttactaaattataataccctgtgctggcaaaggtgcagtgaaatgggcactttcttatactatgaggggtggttaaattgtgtataagccttccagggtaaagcctgtcaattttttaaaataatggagacagggtctcaccatactgccatactgcctcctccaactcttggcctcaagcaatcctcctctcttagcctcccaaagtgctaagattatagctgggaggcacccaaaaccctgtcaatttacatcaagggtaaggagaatgtccattcaccatgactcacagtaatcttacttctggggagacaattcagtctaaacaaaaggtcatctgtacacacacagtaaaaatctgggagtaactgaagacagagttggtaagtgaaataagaaacagttataagaaattaaactatggtatcaataggcacctggtacaaaaggtcagttgatgttggctgctacttttttgttgttttgagacagggtctcactctgtcacccaggctggagtgcagaggcctgatcatgactcactgcagtctcagcctccctgggctcaagtgatcctcccacctcagcctcccaagtagctgggactacaggaacatgccaccacactaggctaattcatgtatttttctgtagggatggtgactccccctttgtttccaaggcctatcgcaaactcttggcctcgagccatcctcctgcctcagcctcccaaagtgttgtgattaccagtgtgagccaccacacctggccagctgctacttttatcaatattattcttattccactcaattaaaaattattattttcaaggctatgcaacagtatgtatcctacagcgtaattgtaaaaacatatacagtcgtcgtccctcagtatacagaattagttccagccccccatctctgcatataccaaaatccatgcttactcacgttttgctgtcacccctctggaatccacgtatacgaaaattccaaatattagttgggcatagtggcaagcacctgtagtctcagccacgtgggaggttgaggtgggaggatcgcttcagcctggaaggttgaggctgcagtcagctgcgatagcactactacactccagccttggacaacagagggagaccctgtctcagaaaaaaaaaaataaataaataaaacaggttagaaactgtgatgaggtctgctgggcaaaattccatataagcaaagtataaattaataaagcaaatcgtgataaattagtacgattggctttctggagtttctgacaataaaagtaaggaaaatgcagaacacaaagacagagagtaaaaagagaaattaggaaagcattctacatgttgaataggaagacactggccatgttcgtgcagcggcagtatgtcgtgacatgacataccttggagagaagttaacagatgaggaagttgataaaaatcatcagagaagcaaaatactggtagcgacactcaagtaaaccatgaaatttccataacttatgtcagcaaagtgggaatattgtacagtgtgtgttgaagttcctatacaacattgtttatctgccttttgtttgtttgtaaggaatgtatatactaaaagttcttcttgctgtcaaaagaatatgcgtgaataagtcattttaacttattcttctgtttttcttttatcttcctgccatcatcccacagccttactttagaaattttttttttagaaaattgaacaagtgctccttgtggtggcacatgcctcgaggatgggaggcaggggtggaagggtcacttgaggccattagtttgacaccagcctggccaacaaagtgagaccccgtgtctacaaaacaatttaaaaattagccaagtatcgtcatgtatacctacagtcccagctacctgaacttactgagaatgttcagggcctggagagaaggctgggaggcaggagctgggtctaaagaggccattgtaacgatggagctgtgcctgtggaggctgttgtgaggcagtagcctcatctgcggaggctgccgtgacgtagggtatgggcctaaataggccattgtgagtcatgagcttggtctgtagaggctgactggagaaagttctgggcctggagaggctgccgggaggtaggagctgggccaaaagatgtaagcacatttgcatttattaggcactttatttccattattacactgtgatatataataaaataattatagaactcaccataatgtagaatcagtgggcgtgttaagcttgttttcctgcaactggatgttcccacctgagcgtgatgggagaaagtgacagatcaataggtattagactctcataaggacagcgcaacctagatccctcacatgcacggttcacaacagggtgcgttctcctatgagaatctaacgctgctgctcatctgagaaggtggagctcaggtgggaatgtgagcaaaggggagtggctgtaaatacagacgaagcttccctcactccctcactcgacaccgctcacctcctgctgtgtggctccttgcggctccatggctcaggggttggggacccctgctcaagtgcatccaaaacgacccttcccacaccagtcttcacagtggtcaagggcagcaaccacttagctcccaaggcatgtgcctcagctggcatttcgtcacaatcaacagtaagtggtagcttgagtcactgtgaggtcacctactggaaatcaccagcatcccatttcccactggcaaagagctcagcactgccccctgggaaaccaaacctatgcccaaatcccatctgtgtgggtctacctcctgggacccttcctaacatataaccttcataacaaacttgagaggctgaggtgagacaatcgatttagcccaggagtttgagatcagcctggacgacgtaactaaatctcatctctacaaggaagaggtgggaggatcacttgagcccaggaatttgtggccagcctgggcaacaaaagaagaccccatctggccaacatggccaacctggccaccacggtgaaactctgactctacaaaaatgatctgggcatgggtgacatgcatgtgtagtcctagctacttgggaggttgagatgggaggattgcttgatctcagaaggccaaagctatagtgagctatgatcacatcactgcactccagcctggatggcacagggagattctgtctcaaaaaaaagaaaagaaatatatatttaatctctgtccctggttcctggcacagagcttctaaagctcttacaaagacctcagtgatagatgtgacaggagcatcttttgttttaatatttgatcttggtcccaggtttctaacacaagagcctctaagaactttgggatctccagcatggtaagaatgcatttggggatgttgttgagatgactgggtgactgcaagctcctaaatttcttcaagaggagggctgattaccatgcaaccacatggtaagaggcttggaactttcagcctcatgcactgaactccagggggaagaggggctggagactgacttaatcaccaacagccaaaggttttatcaatcatgcttgcataataaagcctccataaacaccctgaaaggggtttgcagagctttcagggttgctggacacaggagatgctgggagggtcgcatgttcaacagagggcatgggagctctgtgcccctccgaacttaacttgccctgggtatctttcttttttttgagacaggatcaggctcttttgtccaagctggagtgcagtggcacaatctcagcttactgtaacctaagcctccccagtccccagctcaaggtatcctctcatctcagcttccctagtagttggaactctaggtgcacaacaccacaccagttattattattattttttaattttttatagagacaggttttcaccatgttgcccaggctggtctcaaactcctgagtttaagcgatcctcccaccttggcctcccaaagtgctgagattacaggcatgagccactgcatccagcatgcacgtctctttcattgactgtttctgagatgtatccttcacaatgaaccagtaataggaaatgaactggccagatgtggtggctcacatctgtaatcccagcactttcagaggctgaggtgggaggatcacttgagaccaggaatttgtggccagcctggccaacacaacaagaccccatctatacaaaaaataaaagaaactagccagatgtggtggtgcaggcatgtagtctcagctactagggaggctgaggtgggagaaccactggaacccagacaatcaaggctgcaatgagctatgactgcaccattgcacaccagcctgggcaacaaaataagaccctctctctcagaaaaaaagaaaataaactgtttttctgagttccgtaaactgttctagcaaattattaaacccaagaagacagttacgggaacccccgattggtaacaggttggtcaaaagtatggtgacaacttaggacttgccattgtcatctgaagtgaggatggcctcgtgggactgagcccctaacttgtggggtctgtgctaactccaggtagtgtcagaataaagtcatgggatacccagttaatatccagagcactgaagaatctggtgtagaaactccatacatacattcagtcggaagtgtgtgagtagagacaaacatgggcttttctgtcacctacctgcttaactgcataggagaggcaatatgtggtgctcatgaacaaagcaaacattaaagtcagaccagacccaacatttgactcagtcttaatatccaggtgagcctgcgcaaatcattcattattcctaaggttttcatcactccattcataaaatggggataactgtggcacctatatgtgattctgtgagaattaacgaaatattatgcttggggttattgtgatcattatacctgttccaaactatttgacaaggacagtgatggatgaagacatcaaaaaatcagaaactgcaatgaggtctctcaggcaaaattccatacaagcaaattactgtgtctacaaagcattcctgccacacttaattcaccattccctgaacaaaatatgccatcttcgttgttcaggtctgtacagtgctggtttcccttcccgggcagtttgcgctatcccatcccggcccattccccatccctccacctcccccttccctccccactctcatacaactcttcctcatctttcaggacttggcttcaatgtcaccttaactggaagcttctctcactctccagaagagcttcccattgcacctgatgcatgggaaacataatttgatcatttttaagttacagtccaaatctttttgtacctgaataacatgttgcccagtcagtctctcttcctggattcacaagtctttcatggtagatccagctggaagtgacaaaaagacatcttttgacataaagggatgacacagacagacataagttcttaaatgtcttaaatgtcatgtgaaaattaaacagaattcaaagacttgtggggagcacttaggaagttactgggaatgtcatgaagggttaatttgtattttattttattttttgagacagtctcattctgtcacctaggctggagtgcagtggtgcaatcaggctcactgcagccttgaccacctgggctcaagtaatctcacttaatttttatttggtttaagaaagtcttggttgagggtggtggcttatgcctgtaatctcagcactttgggaggctgagagaggtatattacttgaggccaggagtttgagatcagactgggcaatatattaagaccctgcctctaccaaaaaacagagtgaatgtgtggaagacaatttttccacagactgggaatgagggaataatttcaggatgattcaagtgcattacatatattgtgcactttatttctattattactacatagtaatatataatgaaatgattctacaactcactataacgtagactcagtgggatctctgagcttgttttcctgcaactagactgtccacctggggtgatgggagacagtaacagaatatcaggcattagattctcataaggagtacacaacctagatccctcgcatgcacacttcacaacagagtttgtgctcctatgacaacctaatgctgctgctgatctgacaggacatggagctcaggtggtcgtgcaagcgatgggaggggctagaaatacagatgaagtttcccttcactcgcctgctgctcacctccagctctgtggccctgtggttggagaccgctgctcaagtgcatttgaaaggaaccatcccacgccattcttcagagtcatctttactgctgcagtggtcaacttgtagcacccccaagctcgcaggacatatgcttcaactggcatttcacaatcaacagtatgtggcagcttgagtcattgtgagctcacttcctggaaatcaccagcatcccatatcccattgcaaggagctcagcactgctccttggataaccaaacctattcccaaatcccatctgtgtgcgtctatctcctggtacccttcctagcatcaattctgtatttgtaggagtccaatcaggagacacaaaccactcaaaagtttaaactagaatgagcaagatggctcacacctgtaatcccagaactctgggaggccaaggtgggtggactgctttgagctcaggagtttgagaacagtctgggaaacatggtgaaacctcgtctctacaaaaaacacaaaaatcagctgggtgtggtggcacttacctgtaatcccagctactcgggaggctgaggcaggagaattgcttgagcctggcaggtggaggctgcagtgagcagaggttgtgccactgtactccagcctgggtgacagtgtgagacccggtatcaaaaagaaaaaacgtatatatatatatatatgtaaatttaatataaaaagtattaattttggccaggcaaaatggctcatgcctgtaatcccagcactttgggaggccaaggcagacagatcacctgaggtcaggagttcgaaaccagcctgaccagcacagagaaaccccatctctactaaaaatacaaaattagctgggcatggtggcacatgcctgtaatcccaactactcgggaggctgaggcaggagaattgcttgaacccagaaggtggaggttgcgctgagccgagatagcaccattgcactccagcctgggcaacaagagtgaaactccatctcaaaaaaaaaaaaaaaggtattaatttttacagaggatcagcacaatgagggacacactagcacaaagtaaagacaactctagagaatacggaactagcagaggccaggcattgtggctcatgcctgtaatcccagcaatttgggaagcctaggcaggaggatcgcttgaggccaggagttggagaccaatcagtgctaaatagtgagactctgtgtctaccaaaaaaaagagacattagccaggtgtggtggtggtgcacacccgtagttccagctacttgggagtctggggtgggagaaatcccttgagcctgggaagtctacactacagtgagccaagattgtgccactgcactccagcctgggcgacagagtgagaccctgtcttagaaagaaaaaagaaaagaaagtgttaatccccctatgggaatctcctcttctcctgccctctctggaacctcacttgtcagttcttcctcccactttcctgtatctttaacctatcccccacttttagctccttcccatcatcatttaaattactcaaacttcttctgttttaaaaacctctccctaaactcagggagaggtcttctgcacacacattgagccatctgctcttcctggtgccttctctacagcagcctgagccatgtctctaatctatgaatctcatcatgttactcccccatttacatcacttctccttgcctcagggattaagtccaaactccttaacagcccctgctctgccctgccttgcaaggcagcctcactgcttgcccctctccatttcatctgctatggagtccaactgagcctcatctgccccttgaacgcacactctttctcctctgggagtctctgaagtgggtaatatcctctgcttataatatgcttccccttaaacctctactctcttcctagctagctttgactcctctgtcacttgtccgctttggcatcacctcctcatagaagacttctatgactcccgagattctcaggagcatggcaggtgaagtgctcctcccatgaatggatggagattagggagtgtgtgttattcatgcttaattcaccagtgcttagctgagtacctggcataaaatagttactgtggtggccaaagtaataacccccaccgccaccaattgctcatgtcctatgttacacagcacaattacataggaagggggaattaagagtgcagataaaattaatgttgctcatcagctgaccttaaaacaagattatcctggagtatctaggagagcccatgtaattacaagcattctttaaaactggaagagggaggcagaaggttaagaaccagagacggtgggcacaatggctcatgcctgtaataccaatactttgggaggccagggtaggaaaatcccttgagtgcaggagttcaaggtcagccatggcaacatactgaggtcccatctctacaacaaaataaaaacaaaattcactgagtgtcacgatgcttacctgtagtcccagctactgggaaggctgacatggtaggattgcttgagcctgggagtttgaggctataatgagccatgataggaccactgaactccatcctgagtgacagggcaaggtcctgtttctgaagaaaaaaaggacattggaatcaggaccctctccatcctgaggtgcctacaaggcatctctctctgcaaacgagtaaacatcaccctccaactccttacagagtggagcaacaggaaaactccttcacctcatttctgtgctgcttgggaggcctggacagcccaataaccagctcctcgctgatgaagcaatcaggaaatggctcgagttgagctaaggagaatttggatccttcctttggttctcagtaggcagggtagggggccaggcatggtggctcatacctgtaatccttgcactgtggggggccaaggtgagaggattgcttgaggccaggagctcaagaccagcctggacaacatagcaagacctgggtggcatacacctgtggtccctactacttggtaggatgaggtgggaggattgatcacttgatcccaggagtttcaggctgcagtgagccatgatcacaccactgcacttcagcctgggtgacagagccagaccatgtcacaaaaagttagaaaaaaaaaagagggagagagactatacacaggcaccaccacatttggctaatttttaaatattctgtagagacaaggtcttgctaggttgcccaggctagtctaaaactcctggcatcaggctgggcatggtggctcatgcttgtaatcgcagcactttgggaagctaaggcaggcaaatcacctgaagtctggagttcgagaccagcctggccaacacggtgaaactctgactctatcaaaaatacaaaaattagctgggcagtagtggcgtgtacctgtagtctcacctactcgggaggctgaggcaggagaatcacttgaacctgggaggtggaggttgcagtggaccccatcactgcactccaccctgggtgacagagcgagactgtcaaaaacaacaacaacaataacaaaaacaaaaacaacaacaacaaaaaaaactcctggcatcaagacatcttcctgtcttagcctcccaaagccctgggattatactgtttcctataattgaagacacttgttcttatactgctttaaggtataaaggaagaaaaaaaaaacagataatggcaaatgttggtgaaggccgggcatggtggcagcctgtaattccagaacttagggaggctgaggtgggcagatcacttgaggccaggagtatgagaccagcctgggcaacatggtaaaatcccaccactacagaaaaatctaaaaattagccaggcatggtggcgtacacctgtaattttcagctacccaggaggctgagatgagagaatcacttgtgcctgggaggtcacggctgcagtgaactgtgatggcatcattgcactgcggcctgagagacagagcaagcccctatctagaaaaaaaaaatgtcagtgaagatgtggaggaattggaacccacatacattactggtgggaacataaaattgtgtaaccattttgtttgggtatttcttttcttgtcattttaattggatttttaaaaaatcaagacggggtttcactatcttgcccaggctggtcttgaattcacgggctcaagccatcctcctagctgagcctcctgagtagctgggattacaggtgtgagccattgcacccaactggtatagccacgttagaaaacagtctggcagtttctcaaaaggctaaatgtacagtcatcctataatgcaacaatttcactcctaggcatatatcccagaaaaataaaaatatatgtccacacaaaaacttgtacaacaatcttcatagcagcattattcataatgaccaatacatggaatacatggaaacaacccaaatatccaccaactgatgaacagataaacaaaatgcagtgtgtctctaccatggaatactgccatagaaggaatgaaatattgatacacactatgacataaaggaactttgaaaacactgtgctaagagggaagaaaagccacaaaagatcacatattgtacaattctatttgtccagattaggcaaatctatagtgacaaaaaaattaatcaatggttgcctaaggctgggggcaaaggtaggtggggagagtaggaggtagtggctaaggggtatggatttctctatagggtaatgaaaggttctaaaagtgactgtggtgatcgatgcacagctctgtgaatattctaaaacctactgaattgcagatttcaataaataaagtgaatggtatgtgaatattttaataaagctattatttaaaataataataatagggggctgggcacaggtggtcatgcctgcctgtaatcccagcactttgggaggctgaggcaggaggatcacttgaggtcaggagttttgagcccagtcggagcaacatggcaagatctcgtctctatgataaaaaattacctggacatggtggcacatgtctgtagtcccagctacttgggagactgaagtgagagaaccacttgagcccaggagtttgaggctacagtgaaccatgatcatgtcactgtactgtagcctaagcaacagagcaagatgccatctctgaaaaggaaagaaaacaaatgcaagtttttatcactttgtgagtgtagccaagttggaggagaaatagacaataataaaagagcactgaataatgacggtgagtggctggttaggctcagttgctagctaaatggcttctaaaaaattcaataaagttacagctctggggacagtcatgtagtcaaagaatgaaggcgaaattcattacaattgcccatggtctttatttacatgccttctagtgaaaaattcctaagtgcctaaacagcaagtctgcaatgatagcagctgtttattaaagactacaaaaaagaaatggaggccgggcgtggttgttcacatctgtactccttgaattttgggaggctgaggcaggcagattgcctgaggtcaggagctccagaggagcctggccaacatggtgaaatcccatctctactaaaaatacaaaaattagctgggtatggtggcgggcacctgtaatcccagctactcgggaggctgaggcaggagaattgcttgaacccagaaggtgaaggttgcagtgagccaaaatcgcaccattgcactccagcctgggtgacaagagaaagactcttatcttaaaaaaaaaaagaaaaaaaagaaatggcatcttcttcaagaattacatcgtgtttcatgataaagaagctctaattttgcatttgttcaagtattgatgagatttacccaatatgacacccatcttggataaaatgcaaacaacacaatttcattttctcattaacaaaaccgattaagtagtctaatataaattgcgatcttattaaaaactgatcagattaaaaaaattatggaattatggagccaataagatgttacaacctgttccaaggggaattccaaaatccacacatatctgagaccatcaagtatgatgaaatatatttgattactatattgaaaaataaactgattacatagccaacaattggacaggggtctcctcatccacagccacacaaacccgatcatgcagctatgtggttacaaggcctacatagcctagaagggactggtctgacttgagatttcatttgtatttgtattttgagacagggtcccactctgtcacccaggatggagtgcagtggtataatcatagctcactgcaaccttgaccaactgggctcaagagatgctcctgcctcagctgcccccatacctgggaatacaggcaagtaccaccatgtcaggcatttttttcatttttgtagagagagaagacttgctatgttgcccaagctggcctcaaactcctagaatcaagagatctgcccatctcagccacatgagtaactggggccataggtacataccatcatgcctggctatatttattttattttattaaatttattttttttatttttgtagagaggaggtcttgctgtgttgcccaggctgctctcaaactcatggccttaaaacatactcccatctctgcctctcaaactgttggaactataggtgtgagccactgtacctggcctgacttgggatttcttttatctagcatcctttacttggtaggattgggaaaagcagtagtgttttttaaaattacttaataattcaatcagaatcaaactcaaccttgaccactgccttctctcacagctcacatccagtctgtcaggaaatcctactgactgacttcaacatgtatccaggctctaaccatctctcaccaccaccatgaaccccgtcaggatcactatcatctcccaccgggatgttgccacagcttggctcccatgcttctacccaaatcttcccatagtctttctcaactcggcagccaggtcgtgcttttaaatcaggagacggatcatgtcgcctctctgctcagaagccctcggtggttcccattttagtcagagtaaaagccaaagccccagcaatagcgtcccagggcttacacgatctgtaccgatcccagcccagcaactccctggccacctcgctgacttcgctccctctatctctttgctccactggcctccttccagagcctcagacacaccagagagtttcctcctaatgcctttatcctgttgactcagcctacaatgctcttccctcagcaccttggccagctccatcacctgcttcaaacttttgctcaatattcacttatgaggccaaccctgaccactctacttaacactgccatctgtccccattcccaccatgctcatttctttctttctttttgaaacaaggtcttgctttattgcccaggctggagtacactggtgcaatcacagctcacagcaacttcaacctcccaggcttaaacaatcctcccgcctcagccaccctaggaactgagactacagctgcatgccacaacacatggctttttttttttttttttgagatggagtctcggtcgcccaggctgaagtgtaagggtgcgatcttggctcactgcaatgtctgccttttgggttcaagtgattctctgcctcccaagtagctgggattacaggcacccaccaccacacctggctaatgtttgtatttttagtagagatggggtttcaccatcttggctaggctggtcttgaacttctgacctcgtgatccaccctcctcggcctcccaaagtgctgggattacaggcgtgagccactgcgcctggcctttaaaaaaatttttttttagacatgaggtctcattatgttgtccaggctggtcttaagctcctgggcttaagcgatcctcccacctcagcctcctaaagttctgggattacaggcgtgagcaaccgtaacatgaggtcccagcttcatgttcattttttgttgttgctacaacaaagtaccctacatttagtggcatcaaacaccacaaatctaccatcttacagttctgggggccagaagcccaactaggtctattaaggttaaagtcaaggtgtcagagaggctgcattccttctgggggaggctctagaaagaatgtgctcctttgccttttccagcttctagaagccacccccattccttgacttacctcgtgactccatattcaaggccagaagtgcagcatcttcaaatctccctctctgacctcttcttccattaccacatcactttctctaattctgactctcctacctcattctcttataaagatccttgtgattggtgggtatgggggctcccatctgtaatcccaacattttgggaggccaaagaggaaggattgcttgaggccaagagttagagatcagcctggggaaaaaaaggaagatcctgcctttacaaaattaaaatcagctggacatggtgatgcatgcctgtagttccagctactggagaggctaaggtgggaggattgctttagcctaggaggtcaaggctgcagtgagctatgatcacatcactgcactccagcctcagtggcagagtgagactctgtctccgatataagaaaagaaatatacatttggtctctgcccctggttcctggcataaagcttccaaagctcttataaagcccttcgtgacagaggtaataggagcattttctgttttgatatttagtcttagtcccaggttcctgacacaagggcctctaaggtctttcagatctgcagcatggtaagaatgcatgtgggatgctgttgagctaacagggtggctgcaagctccgagactgcttcaggaggagggctagctgccagagaaagcaaccacattttttttttaaaacggagtttggctcttgtagcccaggctggagtgcaatggcacaatctcagctcactacaacctccacctcccgggttcaagcaattctcctgcctcggcctcccgagtagctggaattatagggatgtgccacaacgcctagctaactgttgttatttttagtagaaatggggtttcaccatgttggtcaggctggtctcaaactcttgacctcaagtggtccatgtgcctcagccttccaaactgctaggattacaggagtgagccaccgcacctggccccaaccacattttttgaggcttggaactttcagcctcacctgctgaactccaggaggcaaaaggaactggagattgacttaactaccaatggccaatgattttatcaatcatgcctccataaacacccaaacagcagggtttggagagcttctgtgttgctaaacacaaggaggtcctgggagggtagtgtgcccaacagagggcatggaagctctgtgcccctccccacttaccttgtcctgtgcatctctttcattggctgttcctgagatggagccattacattgagccagtaatagaaaataaggtggccagatgcgctggctcatgcccgtaatcccagcactttgggaggcagaggtgggcggaatcacttgagcctaggaatttgagaccaacctgggcaacataagaagaccccatctatacaaaaaataaaagaaattagccaaatgtggtggtgggaaccctgtaattccagctacttgagaggctgaagcaggagaatcacttgagctctggacgttgaggcttcaatgagctatgattgcaccactgcacaccagcttggacaacagagcgaggccctgtctcttaaaaagaaaagaaaaaaaaacttgtttttctaagttctgtgagttgttctagtaaataattaaactcaacaagagggtcatgggaaaccctgatttctaactggttggtcaaaatacaggtgacaacctaggacttgcaactggcatctgaagtgagggtggtcttgtgggactgagcccctaacctgtgggttctgtgctaactctaggtagtgtcagaatggaattgtgggatacgcggttggtatccagagagttggagaactggtgtagaaactctgcacacacatttggtcagaagtctgtgagtagagagaaacgtgttgcaggaagtcagggaccccaaacggagggactggctgaagccacagcagaagaacataaattgtgaagatttcatggacatttattagttccccaaattaatacttctataatttcttaggcctgtcattactgcaatctctgaacataaattgtgaagatttcatggacacttatcacttccccaatcaatacccttgtgattttctatgcctgtctttaatctcttaatccggtcatcttcgtaagctgaggatgaatgtccccgcaggaccctgtgataattgcgttaactgcacaagttgtttaaacaatatgaaacctgggcaccttgaaaaaagaacaggataacagcaatttcagggaacaagggagataaccttaaactctggctgccagtgggccgggttgaacagagccatatttctcttctttcaaaagcaaataggagaagtattgctgaattctttttctcagcaaagaacatccctgagaaagagaatgcatccctaaggggaggcctctgaaatggccgctttggggacggctgtcttttacagtcatagataagggatgaaataagccctgggttcgcgtggcgctcccagccttatcaggacaaggaaattcccgcctaataaatgttggtcagatgggttgtctgctctcaaaccctttctcctgataagatgttatcaatgacaatgcgcgcccgaaacttcattagcaattttaatttcgccccggtcctgtggtcctgtgatcttgccctgcctccatttgccttgtgatattttattaccttgtgaagcatgtgatctctgtgatccacaccctattcgtacactccctcaccttttgaaaatcactaataaaaacttgttggttttgcggcttggggggcatcacggaacctgccgacgtgtgatgtctcccctggacatccagctttaaaatttctctcttttgtactctttccctttatttctcagactggctgacactcagggaaaatagaaaagaacctacatgaaatatcaggggtgaatttcccccgatatcacactggctcttctctcacctgtctacctgcttaacttaataggagaggcaatgcatggtgctcatgaacaaggcaagcattaaagtcagaccagactaacatttgactcagtcctaatattcaggtgagcttgggcaaatcgctcattaaccccaagtcttcatcattttgtgcatataatggggataactgtggcacccacctgtttttgtgagaatcaatgaaatattatgcttgatgttattgtgatcatgatactatctgacaagggcagtgatgcatgataacatcaaaaaattagaaactgtaatgaggtctcttgggcaaaattccatacaagcaaattactgtctctacaaagcatttctgccacacttaattcaccattccctgaacaaaatgtgccatcttcattgttcaggtctgtatagtgctggtttccctgcctgggcagctcactccatcccatcccagcccaatccccatccctccacctcccccttccctccccactctcatacaactcttccttatcttacaggacttggcttcaatgtcaccttaactggaagcttctctccctctccagaagagcttccgattgcacttgatgcatgcactattatttgatcatttttgagttacagtccaagtctttttgtacctgaataacatgttgcccagtcagtttctcttcctggattcagaagtctttcatggtaggtccagctagaagtgacaaaaagacatttaaaaaaaaaaaaagagggatgacacagacagacatcagcacttaaaagttttaaacgatatgtgaaaaacaaaatttaagggcttctaggagaaatgtaggagggaaggtgttactgggaaatatgatagaaggttaatttttattttattttatttttagagaaagggtcttgctctatcacctaggctggactgcagtggtgcaatcacagttaactgcagcctcaacctccagggcttgagcaatattcccatctaatttttattttgtttaagaaatgcagtcttgctcttagcaaagctaaagtgcaatggtgtgatcatagcttactgcagcctcaaccttctagactcaagtgatcctccagtcttagcctccccagtagctcggactacaggtgtgcactgcaacgtgtagctcatttttttttttaatttttagtagagacaaagtgtcactatgttgaccaggttggtggtgatctcctacactcaggcagttctctcacctcagccttccaaaatgctgggattacaggtgtgagctgccacacctggctgagggggttaatttttaattatataaagagctcaaagcaaatattagaaggagcctaaatgcctccagcagttgactggtactggtaaattgtgatacatccatataataaaatattatgcaaccataaaaaggattaagatagatcaataggtattggcacaaatgtccacgaaatatgaaaatatgaagtgatgttcaatcaccatgtacgtatcttgaaggatatggcccattttctcaactgcaattatttcctgagataagattatgggtctaaagagtgaaggacatttttcacttatttaaaagtatttatcatttttataatttaataaaagattaaacagatcattgaattagtaaaagacaaagtaactctataaataaatggaaaagacacagataccccaggcatggtggctcatgcttataataccagtactttgggagggggtggtggggggattgcttgaggccaggagttccagaccagcctaagaaacaaagcaagacctcctctctagtaaaaataaaaaaataaaaataattggccaggcatagtggcatgtgcctatagtcccaactactgaggtggaaggatcacctgagcctaggaggtcaaggctgcagtgagttgagactgtgccactacactgaagcctaggagacagagcgagacttcatctcaaaaaaaaaaaaaggacaataaagaaataaagctaataagctaacataaggaaagataaaatatgtgacaaataggctgggcacatggctcacagctgtaatcaagcactttgggaggccaaggcgggtagatcacgagatcaggagttcgagaccagcctgatcaacatggtgaaaccacgtttctactaaaaatacaaaaattaaccaggcatggtggcatatgcctgtaatcccagctactcaggaggctgaggcaggagaatcgcttgaacctgggaggcacaggttgcagtgagctgagatcacaccactgcactccagcctggtcgacagagcgagactgtgtctcaaaaatgaaaaaagaatgggtgacaaagtaataataggaggtctttcatttatcacacagaaaataacttgttaaattataatacctgtgtgggcgaaggtgcagtgaaatggccattttcttgtagtattagtggtgtttaaaatgtatataagccttccagcataaagcttggaaattttttttaaatcatacagacagtgactcattatactgcctcctccaactcctggcctcaagcaatcctcccacctcagcctcccaaagtgctggaattacaggctgacagccaccatgcctgaaagctttgcaatttacatcgagggtaataagaatgctcatgccctgtgactcacagtaatctcacttctggaaatttcacctttggatataattcaacctaaacaaaaggtcatatgcacaaacacagtgaaaatctgcgagtaatttttttctctttttttaaaaaaatatggaatgcttcacaaatttgcatgtcattctttcacagaggccgtgccaatctctctattgttccaactaaagtatgtgtgctactgaggcaagcatgagtaatttaagatagagtggttaagtgacataaggaagaattatggagaatttaaaaatctatgctatttataggcacctagtaacagctcagtaaatattagctgctactattattatttttatggtaatttcactcaattaaaaactgtcattaaaaattaccattgtcatggaacataatgtctcctactgtgtaattgtagaaacagatacaatttgtcccttggtatatggggggattagttccagctctcccatttctgtgtataccaaaatccacgcatactcaagttttcgaagtcagtcctgtggaatccacatataacacaaatgggaaaattagtgaggtgtggtgacaagcacctgtagtcccagctacttgtgaggctgaggcaggaggattgcttgagcccaggaggttgaggctgcagtgagccataattgcaccactgcactccagtctgggcaacacagtgagacagaaggttgactttttaatagaatttttctgttcacttgaagatatggtcaggattgtggcatatgaaaattcttcataaaataactatctaatccaattaatgctggaattgggaacagcagaagtgtcatctcagagctactcacaatgaaaggtgatgtctggggctcaggtgtgttgaggtccccatgcctggactatgggtgctgagtgggatttacttgtccatccattttctatattccagcactgggaaactagggacagtacttgttctcaagggaatcttcagcttaggtggctctgtaaaagagaaattacatcattgaaaaatcgtcgcaggtcaggtgaggtggctcatacctataatcccagcccactgggagactaaggcaggaggattccgtgaggccaggagttcaagaccagcctgagcaacacagtgaaacctcatctctacaaaaaattagaaaatgaactgggtgcggtaaaacattcgtatagtcccagctactctggaggctgaaataggaggatcgcttgagcccaggaagtggaagctgcagtgagctctgatctcaccactgcactctagccttggtgacagagtgagaccctgtctcaagacacacacaaacacacacacacacacacacacacacacacacacacacacacccaatctcactctgtccagccttgactaatcaaaagggccttctggttacagaagaggtatgctcttttgtaggacagggagagaccagcaagcttgttcacagacttttcctcatcctctgcttagttttccaagaaccctcacagtggaaatggagtctctgggaaaatgacctaaatctttgggttaccaggggagaaatatgcctcctttgtcaattaataaatggaacatcagccttaaaatccagggagttctgctagaatgaatcactccctaagaccctgaccaatgcatggaacatgaaaaactgaagtttaactgggcgcggtggatcacgcctgtaatcccagcactttgggaggctgaggcgggcggatcacctgaggtcaaaagttctagatcagcctggccaacatggtgaaaccccgtctctactaaaaatacaaaaattagttgggcatggtggtggacacctgtaatcccagctacttgggaggctgaggcaggaaaatcgcttgaacccggaaggcggaggttgcagttacttctagaagaatttccattagccctttgaaatccttcaacattcatgaaggccaaagagttttcacctaatttaatctgatgggtatgtgaccagagtctttctagggaatagagactcccaaacagttcgactgggaagtgaggagagaatttattactcaaaaccaaagggaaatgaaaagaggccaacatagaatgtcattattctttcttggcggggaatggattccagagtcattctgtgacctttacatgacctccttattagcatctaaaagcttccagtgtaggatgcagccagctaggttctcttctaatgtaataaaatttgcttcggcaaatcttatgcagagccaactccaggctccagaaacaataggctataaattactggatctcccatttgatacaatgaagtatgagcacggtcctgaatgactcctctacatactactctgggtggcttgaagtgaatttgatacaagaactggagcgagggcaaagcagagctagatctaggattaatgtgcttgggcccagctcctcactactcacctatgagtctagttccagaacccaagtagaggatggggaaacaaggctcctgactttttttccctaatatctgcatctctttcacatttcttatctccttgcaaagaaactaaacagtctcaactgaaataactaaatgattaaaccctatacagagaatctccaaagactgacaaaatatcattcaagactgttacacagacaaccttgaggatgacttgatgtaccagtgatctacaatatttgggatcattccaaattcccatcaaggatctgcctatatcaacaaaggagccaaggaccaaccattcaaatgggccctgctgccaagcctttttttttttttttaacaatgccatctcttcatattgttccatttaacaaaactgcagcccttcatctatccttaagtcccttggccaatggtacagagccagagtatgctactccctagcaggaaatcaacaggatgacctactaaacaccattcagaagatgctaagacccatgaattgcaacaggaaagaaaagacagagaattagtcagacaggtacatgctgtgccaaaaatgcactacagcccccacccaattctgcctaatcctagctgggctgacaccaacctgatgagacaggcctataagatctcaaactaaaacagaaactcctgaactgggttcttttgagcccaggaagcagcagtaaatcattaaagaacagataagttcttaaggtgagggagagtttcagataaatggaatgctggtagaacacagggcccaaaggagcaaaagttaacctaagcccaggtagaaccttgtttactagagtattaggcatgggtttgggcaactattctaaccagagaaactggcttcagtgagggcaagttggcaatccaaggtatagcatgcatagggctggcaaaattcagggtgactgaagcaaaagcttcagaaccagaaagaccacatctgggggtagagcacaaaactctcaagagatgaatctttgtaagagtgaggcagaactatatagcagttttaggagatctgttggtgcccagcaagagctccaaacgggctatatgcagggatgcaggctgtagtctcaggagaggaggttcacaaaagtcattcagtccaagacctcaaactgtgttctctactaaaaggaatcaaggttccctagagaaacggctgactccatgtatggtgcagtatattgatcctggaacatcttttttgccagaaagcaaggaagccatcaaagtccaacaggatcacgtcaaaaagacatgaaagtcaacttgaagagataattattaacctagatgagacaatgtaagcatccaaaacaataaagactgcaatggcctgaaatacatcaaatgcaaacaataaactatgagttcataatggtattcagaaaaaaaaactactggtcattagagggaaggttactaggtcactaacttactactctgaaaagtgacttaagatgagaggtagggtggagaattagctatttattcagtctttcctgtacaaacataaatttttagggagattgaagcagatgaaacaaatctggaaaaatggaggtaactgcttaatctgcgggttgggtgcatggaggttcaacatatttcttttgtgtatatttgaaccccctacaaaaaaagcacaagacagaatgtgagccaagcagcttagggtttaggcaaggcttctgcctacaagagacaccaggatatgaggggtagttttagccctattgggctgagccaactggaggtatatagggaagtgctaaattgcagaggtatcatgttgcccagcacttgatcaaatcctagatcctaggtctgcttggtggcatgcttcctaggtagtggatctgaggctacctatagaacttcctttgcagtcatagttcactcagaaactacaaaagtgcttgctcttgaaaatggagtctttgtccatttcatgcttctataaaagaataccacagactgcataatttataaaaaggaaaaaaggaaggaaagaaaaaaggaaggaaggagggaaggagggaaaaagggaaggagggaaggaaaggaaggaagggaaagaaggaaaggaaggaagggaaagagagaaagagggaaggaggaagggagggaaggagggagggagggagagagggagggaggggaagggaagaaaagggaagagaagggaaaggaggaagaaaaggaaaggaaaggaataaattttatttcttaacagttctggatgttaggaagtccaaggttgaggggcctgcatctggtaagggtcttcttgctgcatcatcccactacagaaggcagaaggaaaagagagtgcaagaaagcaagagggcaaaaggggctgaactctgttttataataagcccactctgtgattactaatctattagcacaataacaacattaactcattcatgaaggctattttattaggccccacatcccaactgttgcattgaggattgagtttccagcacataaactttgggggacacatttaaaccatagcagagcacttaggttaattcaactaagaggagctgggaaaatcaaaggcatgagaaagacagcaaaagctagcagagagaaatgcataggttaaggaaaaaagtcacagtgaatcctgtagtgcaggctactttatcaaaagcacctaaaaaagatctcattaactcccccagctcacctccacccacatctaaagagccacacacagcaccaccaaaggcagcacaatgagaacagcattctcctcaacagacaagctgggagtatctagacacctgacctcaatagctccagaacagccctaaaacatttcctccctaaccaccactcaagtcaccagcttggaaagtattaagaaaacccaaatcctgacacaccactatgaaacaacttaaaacagcaaagaacaacccatttaaacagcaatgccagctgttggggaaaaaaggaacaatgagtagaggagaaacagaccactcggggtccaccaagacccagtctctcagcttcagcacttttaaatgcagaatccatacccctctggggcctgtggagctccacaaggcatgtcgtcctcaaagataaatgagcaggcaagctggctagaaaaccactaagggtatttattctttaaagaatctttacagggtcaaagaagaatgggtcttaactggctatgtgaactccccacagattctgaggatgatgtcagtatccctttccagatgtgtttaacactttgcagtcacttgtattcctgccactgagtgccagtgctttgctaatttgaactgattccagctcacgctgaccccagctccctggatgttaccattagccaagactgtcacccatactgtaccctttcaaagagtcctaaaaacagctcttcacctactcttccaagacaagtaaaaatgtctgccaaagaaatggggaaaaaagattcagagagtgaaaacaattaatatactaacaagagagcaaaaagcaaagggggaggagaaactaggaaaatcatatatgggctctcacctatttccaaagctgggctaatgtccttttgcttgtgtctgaataaggcaccaattttaagctgctaatgaaaaaaaaagaaaaagagaaagaagcaggcccaggctgggcgcagtggctcatgcctgtaatcccagcactttgggaggccgaggcgggtggatcacccaaggtcaggagttctagaccagcctggtcaacatggtgaaacaccatctctactaaaaatacaaaaaattagccaggcatggtggcgcatgcctgtaaatccagctactaaggaggctgaggcaggagaattgcttgaacctggaaggcagagaatgtggtgacctgagatcacgtcattgccctcaagccacggcaatgagaacaaaattcggtaaaaacaaaacaaaacaaaacaaaatcaccataaaataactcagacttaattaaatacaaccctagtggtgaatgactaaagatggattactcataacagagataacggtccaataagaatccaggaatcttaccttttaataacaaaaaaatcctttccttctaaagtaacatcctctcaaggccaggaattccattagtagaaagccttcctaaaaaacaaaattcctggccaggcatgggttcacgtctgtaatctcagcactctgggaggccgaggcgggaagatcacttgatatcaggagtcgaggcgggaagatcacttgacgtcaggagttcgagactggcccggccaacatggtgaaaccgcatctccactaaaaatacaaaaattagcctggtgtggtggtgggcacctgtaatcccagtgacttgggaggctaaggcaggagaatttcttgaacccaggaggcagaggttgcagtgaccagcaaggttgcgccattgcaccccagcctgggcgataagagtgaaaactccatctcaaaaaaaaaaaaaaaaaattcctttgggaaggccttctacataaaaatcttcaacatgagactggaaaaaagggtatgggatcatcaccggacctttggcttttacagctcgagctataagaacaaaaagaaaaagggatatcatttaaacacagtatgtagaaaagaataattattgaatctgtactggtctttaacttttacactttgatctttaattctgttattgtgattgagtccaaagaaaaacagtatgagtaaaataaaaagaacaccaaaaatgctaatattctgtttaccgaagtctgtagtgatatatcccattaaatccaagtgcagtgacacacccataatcccaagcactttgggaggctgaggcgggtgaatctcctgaagtcaggagttcaaggccagcctggccaacatggtgaaaccccaactctactacaaatacaaaaattaggcaggcgtggtggcagaggcctgtaatcccagctacttaggaggctgaggcagggagaattgcttgaacccaggaggtgagcttgccatgagctgagatcataccactgcactccagcgtgggtgacagaacaaaacttcaacctccaaaaaaaaaaaaacagctagcaggtgacatttgctatagggagactagggatatgatcttgctgcaatccttccattttagtaaatctaaacagtgtgaatccattctgtttcgtccccactccactccagagccaaaacaagaaaatcaattatatttctagttctttaaaaacatatctaactaaatcatctaattaaaagataatatgcatggttccatactctaaaagaaaacttatgtcctgcatatcatggacatttgatgaatgcttattcagttgactggtgtagacttcaataataacctgttcaatgcattatgccagatgaatcttgcatctcaaaagtagaacaaatattgttctttcagttttgtctacccataaatgcaatatttactaataaaaagaaaatgagtttattgttctagagagtatgagaattttgacaacatgaattctcctgtcctaggacataattaatacttagaggcatactatttcatgtggaagctaccattaaatcaatgttaagtgttaattacctcacataatcttctaatctgacttgactgaagacgtacctgacaaagttgatttatcaagttgtaaatcttcacctgttgaattcataagttcatgtctgaaaggtgagaataaatacttaatattcactaggcaatttcagcaaagtaatatccactagtacatatttaacatttcatcatgaactgcgggtgtgaagagaaaagacaggctgggcacagtggctcacacctgtaatcccagcagtttgggaggccgaggcaggcagatcatgaagtcaggagttcgagaccagcctggccaacatggtaaaaccccgtctgtactaaaagtacaataattagctgggcatggtggcaggcacctgtaatcccagcgactcaggaggctgaggcaggagaattgcctgaacccaggaggtggaggttgcagaaaccattatcacgccactgcattccagcctgggcaagagagcaagattctgtctccatcaatcaatcaataaaaatataaggaggaagcatttactgtgtatttatatgtctggtattatgtgaagcactttactatcttatcaaatcttcgggacaggtcttcagttctcatgaccacaaaagaggatactaaagctcagacaggagaagagacgtggccagcctgtgtccccagggcctatggtcttaccactaggttacagtgtttccagatatcacatgttgtgagatttttgctttaaaatgaaccaaaaaaaaaccaaaggtgaaaaaggcataagctattaaaaagtgggagaaacactaagagaaccttaagcatgtaactaaaaatattatggaaatgttattgaattcattagcaaatttagtgctaggttttcattgaggagtaggttatattactcatgatgaagaaaaatgttccttttaagtatattaacataaataccatcaatattgtttatcatgtttaaatgttcacttaaagcaattcagttaaaattctgcatatcatacaattttatagtttgctagtaggttacaagtaaatagtcacccaaataaaaacatcatgttttccactggttgttgctcttttttaggtgagtatttgatgtataccaacagagagaggataataacaaatcgctaatttctttcatcactatataaaggtggcttcaggatagaatagtatcagggcaatgatgaatttgaaatctaacatcaattcagtgatgcatcaagataaaagcagagacaacaggggcaccttggtgagtactgaacattttatttatttacttatttattttgagatggagttttgctctttttgcccaggctagagtgcaatggtgccaacctcgcctcactgcaacctctgcctcctgggttcaagcgattctcctgccttggcctcccgaatagctgggattacagacatgcgccaccacacccgtctaattttgtatttttagtagagacggggtttctccatgttggtcaggctggtctcgaactcccgacctagatatctgcctgccttggcctcccaaagtgctgggattacaggtgtgagccaccgcgcccagatgaattccaaatttaacaaagcagactaagagaaacaattcatttaaaaaaataatatttggccaggcatggtggctcacacctataatcccagcactttgggaggctgaggtgagtggatcaggaggtcagcagttcaagaccagcctagccaagatcatgaaaccccgtctctactaaaaatacaaaaatcagccaggcgtggtggctggtgcctgtaatcctagctgctcgggaggctgaggcagagaactgcttgaacccgggaggcggaggttgcagtgagccgagatcgtgccactgcactccagcctgggcgacagagtgaggctccgtctcaaaaaaaataaataaataattcaatgaaattcctaagatccagggctttgcaataaatatgtaaataaatttccaatctccatactgaaagtttaaaagaaatgctaactaataactaaagaaatacaacttttcctcagctttgcagcaatctagaaacaaagtgtgtagacactacaaagcaccttacaaggagaaacatgtaaggatggcatgactcgccggcagccctgggcttgtccacggtacccccatgatgaacagtaactccactgtgtaaacgcccatgaacataagattacaagacttttccagtttagacataccatattttctttcagacaattcttcagtttgtttacgtagatcagcgatacgatgattccatttctctgaaaaccaagcaaaagttgcttctcaataacacatccctatgtcagagcagcactaacgtataatgactgatgtcatatattttacattctaacagtccatatcattttactgctttcaagaaaaaatttccccttcttggtggttcttagaattggtttaatgggagactattagagaagctgaaaagcaggagggcagaaaagttcaatcaaattaaacacaataacagggaggtcacaatgaggcggtctccaggggtcttttagcaaacttcctaaaacatgtctcagctgtgtgaaaatagactttacagcagccgggtgcagtggtgcaggcctgtaatcccagcactttggcagcagaggcaggtggatcactttgagctcagggcaacatagccaaaacccccctccccagccccacccccaccccgtccctaccaaaaatacaaaacagcagggcatggtggcgggcgcctgtagtcccagctactcaggaggctgaggcaggagaatcacctgaacccaggaggcagacattgcagtgagccaagatcacaccactgccagcctggatgacagagcaagactccacctcaaaaaaaacaaaaacaaaaacacaaggttaagagggacccccgaccttacagatgcaagtttaagagggacccctaagcaaaaaatgccaaccctttttctcccaatcattgaaacaccaggagggtgtaacagttttgcagcctagctgtagcaggctgatgcccccaagatgcccatatcctaatcccgggaactggtgaacatgaccttatatggcaaaaggagctttgcagatataatgaagttaagggtctttggcttttggggttgatgtactcactcggatccttgtaagagcagagcaggtgatggagagggtgggaggtgtagtgacagaagcaggaaactccagtcattcgagacgggcagcacaggctgaggagtgcaggccacctctacggccaggaaacagattctcccgcagagcctcggaagctaccgaccctgctcccaccttgactcagtaggacttactgtagaattctggccttcagacctgtaagggaatacattttggttgttttaagtcactaagtgtgtggtaatttgttgcagcagccacaggaaactagtattgtagtgaagcctcaaaacccccctgaaggggctgggctcagtggctcatgcctgtaatcccagcactttgggaggccgagatgggtggatcacttgaggtcaggagttcgagaccagcccagccaacatggtgaaatgccatctatacaaaaaatacaaaaactagccgggcatggtggcacatgcctgtaatctcagctactcaggaggctgagacaggagaattgtttgaacccaggggggcggaggttgcagtgaactgagattccaccactgcactccagcctgggtgacagagcgacgctccacctcgaaaacaaaacaaaacaaaaaaaccccacctgaaggtttccagttctgccagcactctcccacccaacccccagaaacagacattccattgctgtgggccatggacaggcagaaggaagcacctcctcatggcagaggcctacccaggagaaacccaagggaaggcactgctgggctggcccctctctgccaaggccatattcttttttttttttttgaggccagtttcactctgtctcccagactggagtgcaggggcacagtctcggctcacttcgacctctgcctccccagttcaagtgattctcctgcctcagtctcctgagtagctgggatgacaggagtggagcatgcctagctaatctttgtatttctagtagagatgcggttttgccacgttgccagtccacctgtctcagccccgcaaagtgctggtattacaggagtgagccactgcacccagcatttgccaagacctttgatggcaggctttttccaggtgatcagtccttgtctggtctggctctgccccactctccttctcacctagttggaatccctagctacttttcagtagaggagagtgtgtaccccaatcccagcttggttcagatctgcatttaactcatggaacctggctgctccccaggtcctgaagaaaaaaacggtctctctgtgggtatgataaaggatgggcctgtccccaggaccctgtgagagggaagcccaatgtcccaccaggttggcagggctggggaagggaaagtgttatggcagccccaagaaaaaaaagaggcagcagagggagcaggacagcgctcacatggaactcatgccactgcctgaggggggggaggagtgcacgccagtgacgtcagggggcagagaggcgcagttccagggtggctttccccctcacttcctgccatgttactctgatcgcctccaggtgagcctgcccactttgtgcccaggggcctgtagaaaaccacagctccccatggttatggccccaggagtggggcagagcagggaggagtcctggacagaggagaggcaggggcaggagggagtgggcctcaaactccaggagggggcccttctcatgggtcctgctttctggcttctccttccttacccctgggctgatcacttggggaagaactgagacaaagtttctcgccctcaggcccaaagggtttaattactgggcccttagggaggtgtgagccccctgaaaggatgcaaggttttgttttgttttgttttttgagacagagtttcgctcctgtcgcccaggctggagtgcagtggcgtgatctcaccacactacaacctgcgcctcccaggttcaagtgattctcctgcctcagcctctggagtagctgggattacaggtggctgccaccacgcctggctaattttttgtatttttagtagagacagggtttcgccatgttgggcaggctggtcttgaactcctgacctcaggtgatccgactggctccgcctcccaaagttctgggatcacatgagccactgtgcttggccacgatgaaaggttttgtgtggagagcatgtacatgcctttctgggaaaacagtccacagcgcttattctcagcagacttcacggtgaaaaaaggttagaactcttgctacagagctgtggaagcagccaggtgaggggcctgccaagggcactctgggcactacctgggcactctcgagcccatcatcccctaggcaggctgcactgcttggtatttgcagagctgagggggtggggcatgtggggactgtgaaatcgccctgagatgacccacagtcctcagctgggaagtgagcgctgcatctcctgcagcgtcctccatccctagagccatggggccaggagaaccggcccttgcagcaagtgaaaagcctattattgattccctccctagccatgtagacagtgaaccaagacactcatatcaggtaaatgccttgttctctgttaccaaggtaaccagtaggcattcccagatacagcgaaggtcctcacaccaagatatgcacctggccacctgaggaaagagaaaggactatctgaggggatggggctgagctgggtgtggagtggtccttgtgggtcttggagagtgggagggggagcagcatgagccaggcctcgaggcagaaggacaaccaggagacagcctggaaaaagtgctggacccacaagggctctaggctggccagaggggaggtgggataggctgtaaagtcctgaggtctgaagattggccctggcaggaagaaaccaggtaaggtggggtgttacctacaccctcggggccagatgcaggccagagccagccaattaccaggcccttagggaggtgtgagccccttgaaacgatgcaaggttttttgtttttgttttggagacggagtttcgctcttgtcacacaggctggcacctttgcccagagcaggcaccaagacttctggctctgggtgtgacctcagtctgggtaaaagccccagcccccaccagcaccacctatcccctagactacttcaggtgctgagcccaagccaggggcaggaagctaaactgatacctagggtaatcccaacaaagtccctggttccccgcagctatggggctgacggggaattacagcccaaaccccagatgctggctctcaaactaacactgagccctcagtgcccacagggagatacaatcagcgcactttccagatggggaaatgggatcagagaagtgcaacagccttgcccaatgccccagaccagggctccaggcccagagtgttcttttgtcactgtgttcagagggcagcagctgctgtgatgtacccacctgagcctggcagctttctccaactttggaagcccaggagcatggcccctgtccacagatgcacctggcatgaggcgtgcccagagggacagaggcagatgagttgcgtctcctccactggattgtgagggcctagaaggagacaagggtctgcttgagaaggcagtgaacagcgagcagcctgaggcagtgcccctctggatggatgcgcagtgcctggatggaacctggctcagacagagctcagttctgcaggtccctgaggcatggagagttcacagctaccaagtgtaggagtctggattcaaagccaacggcgtgactccaaagtccctgccctagcccctggaccacccttgcaggcccatcagatgcccaggccagcagcacagccggccaagaccagggaaacttggggagcctcagagcacccccaggtattccaacctaaccctggtgccccgcctctcaccacccttcttcctgcttttacctcaacccctacacaaagcctgggccacttaatgtggcatcaaacagacgcctcaataaatcagtctaatctcgaaaaaaaaaaggcttaacagatatacaattgcacgttagaatgctaaagaccataaacatataacaacttaaagtacatataaattcaatatatatccaatcattgtaactatgacacagtagaatattaaaatactattttcaaaatgtatacaagcttaatgttctatgtattcaaactgtttattcaaaatacaaatcatcaacataaattgccactaatattcagtcccttcacaggacatgattcactgggagttaataaattagcagccggcaggcagtgacacaccgcaaaaatgaaaaccaagaggtgaaatagttctgaaataaaggttttaaagctaacagaaatcactgaattactaagtcattagcactaattttgagccaactaactaattaatatgagatgatacaatgtcctatactttggtaaatacagactatgtttaaacaatgtctgtaacgtgacttgtaaaatgctcctggctttacaaagatgtgattaagatgtagtaacacatgctaaaccatttccccctgcagagcatgtggtaactttcatcagtcacattgagagtccagaagataaaggaaaaggtcatggatttcgctgagaacttaccagagttgaactccctcattttccgttccccagcattggcgggttctgggactggtggctgtggtggctcgttggtctttgtctcttagaaggtggggaataatcatcatcttgaaaaagaaaaaatggtcattactgaaggaaccatcttaggttacagccacctctgggtcaattcccaacattcaaaagctgagcagggctttaaagctatcttattaataattatttctgtattgcgaacttcagcatacttttttctagttacatttgaaatgttattcttttgggatgtgctcaagtgagtactgctttttcctctgccttgcttcattactttttagtttccttcatttgaatcatcattgtaagtctccccttctcctcaaataactttcaaattgctgccaagaactatgttctatcttaaggcttttgagaaaaaactttcaatgaagatagccgcctaaagttatacaaatatagaagaaacgggataaaataaagcttagattggaaaaaatatttaagattctacaaaattcacgcgtaaacaagggaagctgagtaattgtatgttcaaatacttgcaaaacatgtaggcttaaagaaatagagctggccaggcatggtggttcacgcctataattccaacagtttgggaggccgaggcaggcagataacttgaggtcaggaattcaagaccagcctggccaacagagtgaaaccctctctctactaaaaatacaaaaattaggccaggagtgatggctcatgcctgtgatcccagcactttgagaggccgaggtgggtagatcacctgaggtcaggagtttgagaccagcctaaccaacatagggaaaccccgtctctactaaaactacaacattagccaggtgtggtggcacatgcctgtaatcccagctactcgggaggctgaggcaggagaatcccttgaacccaaaaggcaaagattgtggtgagccgagattgtgccattgcactccagcctgggcaaaaacagcgaaactccgtctcaaaaaaaaaaaaaaagaaaaaattagccaggcgtgaagttgcggtgagctgagactgcaccattgcactccagcctgggtagcagagcaagaccctgtctcaaaaaaaaaaaaaaaagagagagagagagaaagaaagaaagagggctacattatttatgaaacaggtactgttaactcagtcaccagaaagcctgtgtataaatgagcagtgagatattcaagcacagcacacacacacttctcaggacagctgtcgtgagtgttccatgctcatttccttctggatacatcagcaactcactctgctatgatcctgcaatacatctcatgttagaattagagacatctgggccaggcacagtggctgacgcctgtaatcctaacactttgggaagccgaggcaggcagatcacctaaggtcaggagttcgagaccagcctggccaacatggtgaaatgctgtctctaccaaaaatacaaaaaattagctgggcatggtggcgcgcgcctgtaatcccagctactcgggagcctgaggcaggagaatcgcttgaacccgggaggtggaggttgcagtgagccgagatcttgccactgcactccagcatgggggacggagcaaggctctgtcaaaaaaaaaaaaaaaaaaaacagaaaaagaaaaagaaaaaagaattagagacatctggatcaaatcagctgccagtctcgcaaagtgtcgggtaacatcctattaagcttgctgcttacacatcatctataaaatactgaaaatatcattttaagaaatcttttttttattttgagacagagttttgctcattgcccaggctggagtgcaatggtgcgatctcagctcactgcaatctctgccccctgggttcaagcaattctccttcctcagcctcctgagtagctgggattacaggcatgcaccaccacgcctggctaattttgtattttcagttgagacagggtttctccatattggtcaggctggtctcgaactcctgacctcaggtgatccactgaccttggcctcccaaagtgctgggattacaggtgtgagccaccatgcctagccaagaaacccttattttaaaacaagccaggcgcggtggctcatgcctataatcccagcactttgggaagccaaagcgggtggatcacttgacgtcagtagtttgagaccagcctgggcaacatgttgtaaccccatctctactaaaaatatattttaaaaattagctgggcatggtggtgggcacctgtaatcccagcttctcaggaggctgaggcaggagaaccacttgaacctgggaggtggaggttgcagtgagcggagatcacgccactgcactctagcctgggtgacaatagaaagactccatctcaaaaacaaaacaaaacaaaacaaaacaaaaaaccactaaaaaaaagactccatttcaaaaacaaaactaaaaccaaaaacacaacacaaatgtagtacacaaatgaaaataattactgtgttaaacacagtttcatagaaaataaaagaccaatcaaatacaataagctgcctttttagatgggtatgttattcttctttcacagctaaagaaacaggctcagagaatgttatttgattggaccgtgttgcatttctggacagtgcagctgagatcagactttgtgtgtaactccactagcctaccagggtgcctctcataaagctaagaaatgtaaatttggcctaatatacaaagttgccagggcagcactgggtcaattctacatacagtacttctatgttcatcaagggaaaccttaagggaaagtgaaaatgcttctagaaggcgactggacaccagcgcctttgcttgttgcctttgggctcttcttctaaggccaacagtgacctgaaattattgactggcttttcaatcaagtggacaaaatggtaccaaggtcggcaacatcagacaaatttacttgagggccttatctatgcgctttgaaagacaaaactgcttttgtaaaggacactgtatttcagaaaaacataatcatattaacaaataataacactgtaaaatgctgatgtgttgaatgctactttagaaaaacatgctcaaatctagggaaaaaatttgatacaaaactacgtatcaattatctagctagctatctatctagagacatgctttcattctattgctcaggatgggaagcagtgggattatcatagctcactgcagccttgagctcctggcctcaagtgatcctcctgcctcagtctcctaactagctagggccacaggtggacacagttatgcctgggtttttgtttgtttgttttgtagagacagggtgtcactacattgcccaggctggtgtcaaactttggagtctcgctgtgtcgcccaggctggggtgcagtggtgtgatcttggcccagtgcaacctctgcctcccgggttcaagtaattctcctttatcagcctcccaggtagctgggactacaggcatgcgccaccacggccagctaatttttgtattttttgtagagactgggtttcaccatggccaggctggtctccaactcctgacctcaggtgatccacccgcctcggcctcccaaagtgttgggattacaggtgtcagccactgagcctggcggagcactttatgttattaagtagcctaacccaggtgggtcgctgtccctcacgcctgtaatcccgacaactctgatggccaaggtgagaagattgcttcaactcaggagttcgaaactggcccgggcaacatagcgaggcaccccccgaccccatctctagaaaaaaatacaaaaattaggccaggtgtccaccgcgcccggctaatttttgtatcttttgtagagacggggtttcgtcatgttgcccaggctggtctcgaactcctgagcccaagccatccatcctcccgcctcggcctcccaaagtgctgggattacagtagggcccagccagcctcatgttttatttagcagtccctccctgttgcacacctggatagttttttaaatttttttagacagggtttacctcaatctcgcaggctggaatgctgtggtgggatcatagctcactggagccttgaacctttgggttcaagtagctggggggctgaggtaggactacagagatggggttgcgccatgttgctaggctgctcttggcctgaagggtcctcccgcctcggccgcgccagacatagttttctatttttgaccaacataaacactgtgctgggtctgaatttttcagctacccttcttcagccggcaacacacagaacctggcggggaggtcactcttaccagtccccactctgatgagaaaactgcccagctccaggcaccatggcgccccagtgatgtagccgaacacccgcgcctctaacgtcgccaacggcccacctctatggtgtcggcgaagacccgcccttgtgacgtcacggaaggcgcacccttgtgacgtcacaggggactaccactcacgcagagccaatcagaactcgcggtgggggctgctggttcttccaggagcgcgcatgagcggacgctgcctactggtggccgggcgggatgtaaccggctgctgagctggcagttctgtgtcgctaggcttctgcccggccgccgccgcacataagccacgaggaggagctttacgacttcccggtcttcggcgccgggcgcagcaagggccagactctgcgctagcaggcgctgcgcgccaaccggccggcacctgtcgcagaaggtgcaaccgatcgcactgtcgcgcagaagctcctcaatggccagcgccagctgcagccccggccgcccactcgcctcatctgagcctgggtacgtgcgctccacaacgcctcccccagccagggcccggggatccccgggagcgtccccggctacctggcgccgctcatcctgggtagggtcggccccctgaggctgcccggcatgagggagttgcacccctgagcttgacctctgacggtcctttgtaatagcattaagtctttgaaacttgtagcggggtagaaggggctaggaaatgaagaaaacatctttttaaaaatataagcagtcggctgggcgaggtggcccacacctgtaatcccagcactttgggaggtcgaggcgggtggatcacgaggacaggagttcaagaccagcctggccagcatggtttcactgaaaccccgtctctactaaaaacacaaaaattagtcgggcgtggtggcaggtgcctgtaatcccagctactcgggaggctgaggcagagaattgtttgaacccgggatgcggaggttgcagtgagcggagatcgcgccactgcactccagcctgggcaacagaccaagactccgtctaaacaaacaaatatatgtgtgtatatatatgcgatcgagcccgggaggttgagattacagtgagctgagattatataagcgatcgagcactggaggttgatgttacaatgcgctgagattgcgccattgcactccagcctgtgtaacagagggagactctgtctctaaaaaattatatgcaagtgagagcttttcttccagcactcatgctcagactgaagaaagtaattgggccaggcccggtggctcacgcctttaatcccagcattttgggaggcggaggcggaagtgggtggatcacttgagctcaggaattccagactagtttgggcaacatggtggaaccctttctctacaaaaatacaaaaaattagctggacatggtggcacgcgcttgtagtctccgcaacttgccgggcttaggcgggagaatcgctcagctgcagcctcgacctccaggggcaatccatttcagcctcccaaagtgctgagattacaggaatgagccatcgtgcctggctttacactatattttaacactttttttgaaaatggaaacttttacaggcaattcacttccttcaaactaatgataaggaagtgatgctgttctgttctgttttgttttttgtttttgtgggttttttttcttttttgagatggggtcttgcccaggttggagtgaggtggtgcaaacaaggctcactgcagccttgaccttcgggctcaaggaatccttccccgtcagcctccccggtagctaggactacaggtgcatgctaccacgcttggctaattctttttttgaaatggagtctcactctgtctcccaggctggagtgcagtggtgcaatctcggctcactgcaggctggtctcaacctctgacttcggatggtccacccacttctgcatcccaaagtgctgggattacaagtgtgacccaccgcgcctggcgattttgctcattttagatactagaactttttaatttaaaatttttttttcctgagatggagtcttactttgtctccaggctggagtgtagtcgcgtaatctcggctcactgcaacctccacctcctgagttcaagcgattctcctgcctcagcctgccagagttgctgggactacaggtgtgcaccaccacacccaggagttcaaggctgcagtgagccatgatcgtaccactgcactccagcctgggcaacacagcgagaccctgactccacaaataaataaatcaacgtcatatgatctgtaccagggtataggcaggtgctatgatccccacttttcatcctcaactctaagttgagtcatacatcaacctctagtaaaaagtggcatgctctcagtcaaaggggtaagcccaaaccacgtggagagaatcttatctcttttgagagctaatataaaaagaattcctcctaggcataaaaatattatgacaccagttacttaggctaaacatgcctattatgctaagtgagttattaacaataaatactttaactctgtgccatgttaattatcataatctgatttataatttgttttaaccttaggttatatataccttgaagccatttatattttggtatacttgtaataattactatacactggactatgtatattggactaaacacggagagtcaaaaaagagtatgtggtcagagtagaaatcatgccctagcttccttcgtgtctacctcctaccttgagtagaagtggtagaaaaagtaattacctaagattttttggattctggtttgtggagaagcacccttatatttaggctgatgggcggcaaaattagaaagtattttttgtgatttagaattttatacagagatgttcattgtgattaattattctttgtattagcagatttttgctttttatagctgcatgatttcttgtttattattcattcattattgtctattaataaagaaaaactttatttcactgaagcagtgatatataatccaacttggatttttaaataatgactgactttttttctttgggaatacattactgttaaaaatgtaattattagatacattacttttaatgaatataagtggtataattagaaggctgaaaagaatccttggaaacgtgagtttaatttgatagctaagaaactgaggacaagatacttattctttgtagcatattttctaatgtcatttcattgtctcaccaagaaatacttgcataaagcaagttcaattacagtatctgttgaatatttaaggttgagtaaagtgggtgagtttaacagatattttcccttatttcttttaggcaaatctggattgggaaagttgacattaatcaactcattattcctcacagatttgtattctccagagtatccaggtccttctcagagaattaaaaagcctgtacaggtctagatattggtatttttaattgatgataagctggaataatattaatacacacaaagcacgtgttgtaactttcattatgcttccttagaggtaagatgcaaatttgcccttagccagtgtaagatggtaaatatgacttcataaaatcaaaaaaacagaagaagtacagttaatcgaaagattatcttgactagaactttccaaatttgtcctaaggattctcctagagatgacactgtgacatagtaaccaattcccctggagttgtgctatgtagtatgatagtcatttgccacatgtttaaatcaattaaaattaattaaattaaaatgcaatttctcatttgctccagatacatttcaagtgctcaacagccacatgtggcaagtggctgccattttgtgcagcacatatatgaagattttcatcattgtagaaaattgcattggacagtgtagagaaaacatgattcatagaaaaactattgttatttaaatacagtgttctatattagtcagtgggataataccatatcatagttgaatggcaatagcaattctgtaagactcccaagctatatgtgatctaatttactgcttctcagtctttgctatgcattccaatcctgggtatcctgttaaatttatttcttctagtagttctgagatgggctgcctttctacatttctaacaagatcccaggtgatgctgatgctgctggatggtagatcacactttataaagcaaggggctagactctagatatgcactttttattaaatagtacagcagcctgtagccacatgtggctattaatctttgaaatgtgggtagtctgaattgtgatgttctgcaaacataaaatatgccacagatttctaagactgagcatggaaaagaaaatctccataattttttatattgattgtatactgcagtgataatattttggatgtatcaggttaaataaaattgactgatttcacctttttcctattttaaaagtggctactaagaaaattttaaattacttacatgaccgacatggtatttttatttggcagcgctgctctaagctgttgatgaaaaatattgttggtgagctctgcttaggtaatatataggacatgagcagagaggaggcacgtgaacagttctggcctggagtaggcttcattgaggctgtgatgcttttagctggatttgaagaagtggtagtgatcatcccagtgcacaggataggtggacagtctatgtattctgagcagtaactcatatatctcatactgcaagaccccaaaggagtaattttgtgaagtaaatatcttatttctcctttttaatgtttctattttaggaattttttttttttttagtaaccttcatagggcttgagatttaaaattacctgcaaaattctactctaaaaacttgatcctacatgcttattttgtgataaatattggaaattttaaacctaagcaagaaaatgaactttgaactttcttaatttgggtatctattatgaataccttcacttaagtatttatgaatttagatatgaaaggtaaaactaaccactatccaaattaatatacagttcatttccagaaccctagtttcttccatgtgctcacttgcattcagtattacaacccccaaagataaacaccttactgactgccttctccataaatttgcctgttcttgaatgttatatacgtatacttttttgtatctgttttctttcagtgaagattatgtctgtattatttactcatgttgggtgtagttgtttttttcatcgtcgtataatactccattgtgtgaatgtatcagtatatcctttattatttatttaaactgacttaaatgttttttgacactttggttatatttaagaagttgacttctctaatttccttgtcatgtttatttttaaatatctttctctttaaaagttgggatactataataaatattcagcaagtattttgtgtttaaatataaaatcttgttatttggattttaatactttatatatagtatttatatatataaacataaacaaaactaaagactctatgaaagaatcaaatggattttctataactgaaaatttcaatgactaaaattaagatattaccagataggtttaacagcaaattccataaagttggtaagaaaacaagaatactcaaaaaatggaaagaagtagaaaataaaaacactgagaagcatagaatgcaaatttagaaaagagcttaagagacatatcagacatggtaaaaggtttaacacacatataatcaaactttcctagctctgttcacggaaagggcctgggagctgcaacacctcaacagcaacaagcacacctgctacctagaacttggtttctaaaaaccatcctcctctaaaaggaaacagagctctttgaagaaacggtaatttcaaagctagagcacagaaagtataagatgagcccagaatatctttttgtacaagaaagtaaggcaatgctcaaagaatgatggagacatgcccaaaaaaagcagagaagccaacttgaaaagattccaacaggccaaatatggggcgatttgaacatcagaataaaatggtgacagtcacagaattataacccagtgaagaaaggaattcatgacatcatattaatataaataataattgaatattgaaattcgttaaaggaaatgagatatttatgtagtcttaaggtatcttctcacaaattatgtattacttacaaaggggaaaagtgcaccttgacgtgagaatcttggcagaactactttaatcaagaggtttagttgagcattatcagtaacagagtaaatcaaaatcataagccacttgatagatacaatgagaaaataaagcatcacttctgtgacaccctataaaaaatgaatctaataatgaggaaacatgagaaaaaaccaaactgagggatattctacaaataaattgtcctgtaatcttcaaaaatttcaaggttataaaagtcaagaaaaacagacaatcttttccaaactcaagggaactaaagaggcatgaaatctaaatgcttaattctggatttcatctttttgatataaagaacagtattgagactattgataaaatttgagtggggtctgaagattcattggtagtagtaagctcaatttaatttcctcactttgatcattgtactctggtttttagaatgttctagtcaacaggtaatatgaattaaactaatcgagggtgacagggcattatatcagccacttatcaacaaacatttcagagaaaaatagttccttgtattgttattgcaattttctttgagattgccccctccgaaacagtaagaactttcaaaaacaaacaaagatatcaagccacagattcaaagtgctataaactccacgcatgattagttctcactcataggtgggaattgaacaatgagaacacatggacacaggaaggggaacatcacacaccagggcctgttgtggggtagggggaggggggagggataacattaggagatatacctaatgttaaataacgagttaatgggtgcagcacaccaacatggcacatgtatacatatgtaactaaactgcacattgtgcacatgtaccctaaaacttaaagtataataaaaaaaaatcatacctagatatatcacaataaaacttgacctcagagtttctagctctcaagaccaattcctcccatcctgccactaacagatttctccaaacatctctgcacctcagagtgcaaatacaatcaaacatttcactccattgataggaagcatccttcactatcttctaccaagggcttcctcctttggtgcttcaaaattttttatgaaaggaacatccattttattcaaagcacctccaaacctgcaatcctaagttccaggcaactcaatcccaaaaatccactgtagatgcccaaaggctggggtgttcggtcttcaacatttttgcctttgtggctcccagtcaagatagagctgcaccaagtccaattccattcctcatcacagatgattttttctactttaagatcagaactatacaagcttcttgctttgtgtcagcatgctgttgtacccatgggcaaattcttaggtaagacaaaaacacagtcccaagggcaggtagtaattttttcagaaaaaggtaaggcaatcatttatctcagtctgcccaggacagtcccaatttacacatgtatattctcccaatctgtaggctgtcttttcattttgttgattatttcacttaattttttattatttatttattttatagagacagatctcattatgttgcccagggtgatccttgatctcctggcctcaagtgatcctccaaccttggtctcccaaagtgctgggattacagatgtgaactaccacacccagtcaacgtgcagaaggttttcagtttgatgtagtctgatgtagtctcatgtatttatccttcttgttgttgcctgagcttttggtgtgatatccaaaaatatcattgccaagatcaatatcaagaaactttccccctatgtttcttacagaaattttatggtttcagatttttcatccattttgagtatatttgtgtgtatgatgtaagataagggtccagtctccccagtgttggatatccaattttcataacaccatttattgaagagattattctttctccactgtgttttcttgatgtccttgtcaaaaattagttgacttttatatgcttgggtttatttctgggctctattctgtttcattgctttacatctctgttttcatgccagtgccacagtgttttgattactatagctttgtaatataatttgaaatcagaatgtgtaatacctataactttgttttttgctctaaagatttatttatttatttatttttgccatttcaggtcttttgtggtttcatatgaatttcagaattgtttttcctatttctgtgaaaaatgccattgacattttgatagggattgtgttgaatctatatattgctttggatagtatggatgttttaacactattaattgtcccaatccatgaacatgaaatatctttccattcacttgtgtcttcttcaatttctttcatcaatgttttatagttttcattgtgcagatctttcacttacctggttaaatttattcctacaatttcattctttttgatactagggtaaattgaattattttcttgatttctataaattatttcttataatactcatacttgtcaggcctctgggcccaagcctgcatgtatacatccagatggcctgaaataactgaagaatcacaaaagaagtgaaaatggccagttcctgccttaactggtgacattaccttgtgaaattccttctcctggctcagaagctcccccgctgagcaccttgtgacccccgtccctgcccaccagagaacaaccccctttgactgtaattgtccactacccacccaaatcctataaaacagccccacccgtctcccttcactgactcctttttcagactcagcctgcctgcacccaggtgaaataaacagccttgttgctcacacaaagcctgttggtggactctcttcacacagatgcgcgagacaatactaacactaatattattttgattcgtcagatggaaaagtaaggcttgaagaggttagaaataacttttccaaggtcacagagctaattgccacaactataactcagctctagtatgtgaacaaagatttttttataccaaaccaaaattatttatttctactccactattctatcatggtgcattttaggtgctaatgggaaaatctgctctatgatggtgtccaatagacaattaaaattcaaatctggaaatgagatctggactgaagatttttttaaaaattagccctcatcacatgtagtcagctgtagaaatccttagcatggctgaaatttttcatattaagacaagactagaacttggccaggtgtggtggctcacacctgtaatcccagcactttgggaggctgaggtgggtgaatcacctgaggtctggagtttgagaccagctgaccaacatggtgaaacaccatctctactaaaaatacaaaaaattagccaggcgtggttgcacatgcctgtaatcctagctacttgggaagctgaggtaggagaattgcttgaacccaggaggtggaggttgcagcaagctgagatcgtgccattgcactgcagtctgggcaaaaaaagcaaaactctgaagaaagagagagagagggagagagggagagagaaaggaagagacgatgagagacagagagaaggagagagaaagtacaaaagaacgaatgaacgaacaaactagaaatcgagcaggaaccttggaggacctattgcttaaggtgtgggccaaagaaagtaagttagggcaagagactaaggtatgccagagacccaggacaaaacacagtgcagagtgatgtcacagagccaaatgggagtgcaagctatggcaagccctcccaagtatgtgtgggttaaatgtaattaaattcaaaatctctcaacccaaaaattttctccacaaaggaagtagagaaacaaaacagttcattattgaataagcattaaaccagaatgtgatgtgtgaatataatggaatggaatggaatggaatggaatggaatggaatggaatggaatggagtggagtggaatggacccgaatggaatggaacggaacggaatggaatggaacgcactcgaatggaatggaacggacatgaatggaatggaatggaacggacacgaatggaacggaacggaacggaatggacttgagtgggatggaatggaattgaatggactctaatggaatggacatgaatggaatggaatggactcaattggaatgcagttgaattgaaaggatccaaaaggaatgcaatggaatgcattggaatggaatgcaatggacttgaatgggatggaatggaatggaatggactctaatggaacggaatggaatggaaccgaatggaatggaatggacttgaatggaatagaatggaatggaatggactcgaaagaaatgaaatggaatggattcaaatggaatggaatggacacaaatggaaccaaatggaatggaatggactcgaatggaatacaatggaatttaatggaatggactctaatggaatggaatggactagaatggaatagaacggaataggctcgaatggtatggaatgcaatggaatggactcgaatggaatagaacagaatagactagaatggtatggaatgcaatgtaatggactcgaatggaacggaatggaatggacaagaattgaattgaatggactggaatggaatggaatggactccaatggaatgtggtgggatggattcaaatggaatggaatggaattgagtggatttgaattgaatggaatggaatggtatggaatggaatggaatggaatgaaatggactagaatggaatggaatggactcgaatggaatggaatggaatgtacttgaattgtatggaacggaattgaatggactcgaaaggaatggaatggaatggaatggaatggaatggaatggaatggactcgaatggaatggaatggaatgaactccaatggaatggaatggactcgaatagaatggaatggaatggaaaggactcgagtgggatggaatggagtggaatggactcgaatgggatggaatggaatggaatggactcgaatggaatggaaccgaaaggaatggaacggaacggaacggaacgcaatggaatcgacccgaatggaatggaatggaatggaatggaatggaatgcaatggaatcgaatgggatggaatgtattggaatggactcgaatggcatggacaggagtggacccgaatgaaatggaatggaatggaatggtctcgagtggaatgggatgggatgggatgggatgcgatgggatgggatgggatgggatgggatgggatgggatggatttgaatggaatagaatggaatggaatggaatggaatggaatggaatggaatagactcgaaaggattggaatggaatggactcgaatggaatggaatggacatgaatggaacggaatggaatggaatgaactcgaatggaatacaatggaatttaatggaatggactctaatggaatggacttgaatggaatagaatggaagagactcgaatggaatggaatacaatggaatttaatggaatggactctaatggaatggacttgaatggaatagaatggaagagactcgaatggaatggaatgcaatggaatggactcgaatggaatggaatggaattgactcagatggaatggaatggaatggactcgaaaggattggaatggaatacaatggaatggtctcgaatggaatggaatggaatggactcgaatggaatggactgcaatggaatggactcaaatggaatggaatggaactgactcgaatggaattgaatggaatggacccgaatggaatggaatggactgggctcaaatggaatggaatggaaaagaatggaatggaatagaatggactggaatgtaatgagtttggaatggacttgaatgcaatggaatggaatggaatggaatggaatggactcaaatggaatagcatggaatggaatggactcaaatgcattggaatggaatggactcgaatggaatggaatggactcgaatggaatggagttgaatggactcatatggaatggaatggcattgaatggactcgaatggaatagaattataacagaatggaatgaacccgaatggaatggaatggaatggaatggaatggaatggaatggaatggaatggaatgaaaggtgctcgaatagaatggaatggaatggaatagaatggactcaaatggaatggaatataatggaatgggaatgggaatgggaatggaagggatgggatgggatgggatgtaatggaatggaatgcaatggaatggacacctatggaatgcagttgaattgaatggacccgaaagcaatggaatggaatgcaatgtactcgaatggaatggactcgaatggaatggaatgaactcgaatggaatggaatggaatggactcgaatggaatggaatggaatgcacccaaatggaattaaatgtaatggaatggacttgaatgaaatggcaagaatggactcgaatggaatggaatggaatggaatcgaatggaatcgaatggaatgacatggaatggattcgaatggaaagacatggaatggactcgattggaatgggttgggatggaatgatctagaatgtaatggaatggaatggactcaaatggaatagaatggaatagaatggactcgaatataatggaatgaaattggctcgaatggaatggaatggacttgaatggaatggaatggaatcgaatggaatggaatggaatggaatggaatggaatggaatggaatggaatggaatggactcgaatggaatggaaaggaatggactcaaatggaatagaatttaatggaattacaaaccacagtgatataacacacatgcatgaagatttctaacatgccatcctaaattaagtcactgtatcagtcagagtccaagtataggaaacagtcactacccatgcaaacctgaagagaccttcatacaagggagctgaggcagccgcagcctgcagctctgtcttctagtcttgcaggcattcatttagttagtggaagcatatctcctcccagagcccaggctgcaagagtctgaaatggagcttttagctttccagcctctgtatcaaaagggcacaccagaaagaggctagaatgaatggttgggcactaacaaatattttcacaacctaagcccatactcgcagttgtttgctgaacagacaatcaataaatcaaacagcccttccatgtagaaattaagaaggaaacacaacaccaaaactcattattaaatagcattttgtatttgaaaactcattattaaatagcaaataaattgcactaaaatacaaaattgtagaatttgtattctgggaagccacagtaacaaatccctgtgacagaacccacgaagtagaggtctcctgtgggaatgatgaccgaggccctcgccgctgctccacctgcccctccagggatgccctgcttttccagttgcccctactctgatgtgcatcatggcaggaaaaagtgggctgctgctttcctttaatgctttttgtcccactttattttttacttttgcctagtatatcttttcattcttttattttcaacttttgtaaatctctgttttaggtgggcttcttacgtacaacttggagttgggtttcactttttgattcaatctgaaatcttttacttttaccaaccttcaggttatgtgtataaagttatgtgtttacatgtatagatacaatgtttggtcttacttttatgacatgtttttgtagctttttgaaaaagtttgtgttctctctgtagttcttctgaaatttagaaatgtttgcactattttgtactaggggttacttttggaattttaactctatgtaattccctctccttcggaatcctcatacaacacatcttagcctgttagtttcctgttccacactgtgataaaactgtcattcatcttgctccttcttccttccatccctctcctctacaacttgattttagtgaataacatcttactgcctccctgtgattataggtgagacagtcaacaaacctctaaccaccgaccttttctcctctgccctccactcacactctgctccatcaccctcagccacacagctgacgctgtagagattcactgacatccagtctgatggacactgtttctccagccgaaactgctcatgagaacagtgtgtattccctgagttctcacatgatcaatagtgtttgtttgcagactggatacaaaagatggtttgactggacataaaattcatgggccatcctttcttcctggaggatcccataagtaaggattactccactatctgaagaatttggagaaatttgaagccaccctgatcttttccctccgtaagagatgacatgtttgtttacccattgggaggttcttgcttcatcttcagagtttaataattcctgtaggatatggcacactcataacctgttctcagtcaaccttccccagcataaaatttgccctctcacaatgtacacttccatctatttttacctgagcagaattttcctgaacattatctttaaatatttgttctgtccttttgttttgttttcctgtttgaagattccaatgataaatatgctggaacccctctccctgttctcttcagctgtaattttctttctagttccttttaaactcatgattacggtttcattcttattaattctctcattcgtatttttccatcaccttttttgtgtttcccaaaacatctgtcttctcctgggcccttccaatcgcaccttcacctctgtggtggttctcctggctgctgccatcctttcttctgccaacttgactttgtctcctgctgtctcacttggttgtacaggttgagcatccctaattccaaaatccagaatcctccaaactccggaactttttgagcatggacatgatgccacaagtggaaaattccatacttgacctcatgtgatgggttgaacaaaattattaaaaatactgtataaaattaccttcaggttatatgtataaggtgtatgtgaaacatacatgaatttcgtgtttaagcttgtatcccaagttatctcattatgtatacgtaaatattccaaaatctgaaaaaatccaaaatctaaaacacttccagttctaagcatttgggataagggatactcaacctcattaaaatctcttttctgttttgtggcattcctgcactgggatcttctgccacagaactgcttcatgagtttcctgtttttttcatttatgatgaactgtctggtcatgattccatcctgcttcacagacacatttcccacaatttccttagagaatatccatgcagtgatggtcaccttctctaacaggcatttcagagtgaggtgggacgttctagggcacctgttttgcagatgccctcagggtgggggaagggcagcttccagccttcccagttccagcactctctcccccagccgctacctgcatgtgaatccctgggagaccccacagcccatgtctctgagtaaaactggatccaggaagccctttgctttcagtggtcctccctggaacttctgcactctgcaagctggagttgaacatctgcgactcagcctctcagtgcacagggtatgtggggctcgacttctagacctggccctgacgagtgcttttgttagcctgagcccttctgctcagttccgcctatactatcgctgcccaggcttagctgcttttggtaagcctcatgcacattttagagtctgtgaattgcatctgcctcttatttctctgaaaatggagtttttcatcccttccttccaattctccttccagcctttcttgatttccagaatgagaaatcattaagtcatatactgagccacaaataacattataaatgtgacaattacatgataatctttggggggaaaacattctgtgatttctaacatatttacataaaaatatcttacactaaaacacaccagttgagggcactggccagagataagattaggttaaggccaagcaaagctgagaagaccattgttaaaatttcaatcctgttcctttatcttttcaaattaactgaatattgttattaaatttcttgttttagtgtcgaatagcaccttttccctgcctcactttagaatcaatttagagacaaaggattcaggccaactgaggtcatcagcattatcgctaataatagctggactggcggatgcgattcagattcacacaacaatggatttcctaatctgaatcctagactgagatgaagccagccagccgtaagcattgcttaataaccaaagcctccccagataggcttcttgccctacagcactgaagacatgaaagaaacagaccaaaatgtacaaatatcttttattcctcaaaggaaaaagaagagttacacatgcctgtttctcaccaataagaggggtcagggcagagtgagtctgggagagagagttctaccaccacggttcccaaagcatcgtctaggggcctgttaggggagcccgaggtctaaactatttccacagtttcactaagataagattttccttttccatcctcacattcgttagtgtgcagtgaagtgctccagaggccccagcatgctacattacagaagactgaactcaggagagatgaggaataatcccctccatcacaccagacaccaggagggtgtgccaaggtgtgagacatacagtccttactctttttttgttttgttttgttttgtgagacggagtttcacttttgtcccccaggctggagtgcaatggcccgatctcggctcactgcaacctctgcttcctgggttcaagcgattctccagcctcagcttcccgagcagctggcattacaggtgcatgccaccatgcccggctaattttctgtatgcctggctaagttctgtatttttagtagagacaggtttcaccatgttggccgggctggtctcaaactcctgatctcaggtgatccacccacctcggcctcccaaagtgctgggattataggcgtgagccactgcacccagcccagtccttacttttaaataaatggagaaatattttaaaaattgttttaatttctaatgtggcaaacattaatagatataactcacatgaccaaaatctctttggggtcctcagtaattttaaaaagtgaaaaggacccctgagacaacatttgggtttggaactgctgctccactaggggaagagataccagaacagagaatatgtgttccctgggagataaggccttcccgactacctcccctcctatcatcgaaataagttttctacatttctttaatatcatgttttaaaattccttttaaaagactgaaatcatcagcagaaggcacgggattagcttagcacagtcagtttagactagttacccacaggggactacagaatggacatcacgaggcatacataagcatagaggtgagaagggccgtgttcacagttgacaagattacatttcaggttaaactggtaactaagataacagggaaaaagacaattaacaaagaaactgtaatcgtccataagcctaattagccataaagcaaagtctgttgggaatttaatgaacatttgttaaaaacacaaatattataggaagttttttatacagtcatgggtcgcttaacaagggggatacaatctgatccgagaaatgcattgctaggtaatttcctcattgtgtgaacatcacagagtgtattacacaacacctacacagctaggctacagacctatacaacatattaatgcactgaacagcaactgtaacataatggcaactatctgtgtatctaaatatatctaaacataggaaacgtacagtaaaaaaaggaaacaatcttatgtggccactacactacacgcggtcggtcattgaccaaaacatcgttatgtagtgcatgactgcatatctcctcaaatctgacaattctaaacaagtaaagatgtggaagaattagataaacagaaagaaagtacatccttcaaatagagaatctgtatttttttcacacatcaatagaatatttacaaaaatcaattataaagaaggccacaaaggaaaacttaatcatttcaaagaattagagatcttaaaggccaaactctctggtggtaatataataaaactagaattcaataaagttaaataaaatcacagctatttgaaattcgaagtccacttctgaacacccttggatctgggagcaaattggcactgcatgtgtgcctgggctcctgaagggcctcacatacatggggaagggcagagaaagagaaacaacaacatccactacctctatttttaaagtcagccttactacaaaatacagaaagtattcttcactgggcagaccaaatcaactttgctcaatcttcgcctttgggttcctttaggtttataatgaactgtaagcatttactgagtgattattataaaggcaccatttgaagtacctgatgcccttttaatgctgtaatgcccctgtgaagtaggtcttactattatccctgctctagagatgagaaaactgaggcagggagagatgaagaagctggccccaaggccacaccactgaggagggaggggccagacctggagagcagggggatcccacaatctgtgcttgtgccttcctgctctgctgcttcccagctagcgtgtgtgctggacacagccctcagtgatctcaactttgattatctaattttaaaaagacttctcaagtttattgtcttttacaaaaaagggatgtaatctagcaagccaaagcagaaccaagcagactttgtagttttcatcaattttctggacgctccagccactttcctcaggtcctttagcaatgtgtggactgcccgcccaccgctgccccgaggtagggaagcaccacactacaacctcatgcaggctggattaaaacatgccctccacttcaggcttaggaaccagcgcccctcctacagctcacaagttgctcaagcagtggtctgtgagaagtgattctatttttggggttgtcccttttctctgcttttcttgggaaccattttgactctgtcaaatgttcactgacttctagcactggcagaaagaacgtctgcttttttatctgaaactgaactgttacacaacttataattttattttggtaaaagcattcttagttgctgtgtttagtcatactctacaaattatcttgttggtaggataaatatggtgagaattaaagaaaaatgaagatggtagtggacatttgcagactattatcaataccggcatttcaaacttccaatataattcggatacttgcctggaggacaaactttttttggcatgccgtataatgaggagccttatattcccagtgtgctcaaactgccctgacaccacctatccaccgtcgtcagcaatctatgttcaatgtttcttaaaaacatcagttacaaggtcaaatttaattcaactgaggtcagactctcaggggagctgaggagcacttccttcaatggaaatggccatttctgagtggtgacaacactgtcatttcttggaccttctttaacaaatctgttctcaggagcattaacatactttgctaatacattttaatctggcatttttatgggggtaattataggaaatgcctggaattaaatagcctacaaccaattcttggatcaacaactaggaaaactgaaaaatatatatgtaaatatatctttttctgtgtaagaaaagtcctgctaacttaggaaattagaggatatctttgtgtagaatctttttataaagtggaaataggccaggcatggtggctaacgcctgcaatcccagcactttgggaggccgaggcagccagatcacctgaggtcaggagttcaagaccagcctgacccatatggcaaaaccccctctctactaaaaatacaaaaattagccaggtgtggtggcaggtgcctgaaatcccagctactcgggaagctgaggcaggagaatcacttgaacccggggggcggagattgcagtgggccaagattacaccactgcactccagcctgggcgacaaagcgactctgtctcagaaaaatacaaaataaaaaaataaagtggaaataacttcctctgcttctaactatgcagtttgcttggaaaaaaaaaaaaaagtaacctgtaggtgtagtacaactatcagcacaaatgtaattatcttagagtatcttaatagttcctacttcaagtagaacttatgaaggagtttaactgtggtaaaaaaaaaaataattggagtaacttagaaaacatttatatatacaatagttggtttgtatgctcagtcactcattcattttaggaataacaagtgcctactacttgccaggtgcttgggatatagcagggcctactgaataaattattatacaacagtaaattagcattggattgtgttgcttaaaacaacactcaccagagcaaacaaaagcctgattagcaatatgatctgaaattttaaaaacagcccttttcaacagttccatctaatttgccaggtcattattttataatgtcatatgggattgctgggtcaaatagtatttctggttctagatccttgaggaatcaccacactgtcttccacaatggttgaacttatactcccaccaacagtgtaaaagcattcctatttctccatgtcctctccagcatctgttgtttcctgactttttaatgatagccattctaactggtgtgagatgatatctcattgtggtttttatttgcatttctctaatgaccagagatgagctttttttcatgtttgttggctgcataaatttcttcttttgagaagtgtctgttcatatcctttacccactttttgatggggttgtttttttcttgtaaatttgtttaagttctttgtagattctggatgttagccctttgtcagatggatagattgcaaaaattttctcccattctgtaggttgcctcttcgctctgatgatagtttcttttgctatgcagaagctctttagtttaattagatcccatttgtcaattttggcttttgttgccattgctttcggtgttttagacatcaagtctttgcccgtgcctatgtcctgaatggtattgcctagcttttcttgtagggtttttatggttttaggtcttatgtttaagtctttaatccatcttgagttaatttttgtataaaggtgtaaggaagtggtccagtttcagttttttgcatatggctagccagttttcccaacaccatttattaaatagggaaccctttccccattgcttgtttttctcaggtttgtgaaagatcagatggttgtagatgtgtggcgttatttctgaggcctctgttctgttccattggtctatatatctgttttggtgccagtatcatgctgttttggttactgtagccttgtaatatagtctgaagtcaggtagtatgatgaaaagattataaatcattctactataaagacacacgcacacgtatgtttattgcagcactgttcacaatagcaaagacttggaaccaacccaaatgcccatcagtgatagactggataaagaaaatgtggcacatatacaccatggaatactatgcagtcataaaaaaggatgagttcatgtcctttgcaaggacgtggatgaagctggaaaccattattctcagcaaactaacacgagaacagaaaaccaaacaccacatgttcttattcataagtgggagccgaacaatgagaacacatgggcacagggaggggaacatcacacaccagggcctgtcggggggtggggggctaggggacggatagcattaggagaaatacctaatgtagatgacgggttgatgggtgcagcaaaccaccatggcatgtgtatacctatgtaacaaacctgcacattgagcatatgtataccagaacttaaaagtataatttaaaaaattttttaaaaagtcatatgatgcatttaagaaagtcacttaatttacatcagaggaaaatcaaagtttatagacttaggaaataaagtcgtaatgaagaagctcttcacggctgtcaggacagctacgtttttggtctctgtccttgattccattgtgaccttcagcccatctctctgggccccattttcttgtctttacctcttgggtcataaatggatctccatgcagctgatatccctctgcctaaatcctcctcaaaagaaaatcaaaatagtggctaacacagagtacagactgttccaagagcttcctatgatggaactaatctaatctttataacagtgctctgaggtagatgctaaaatctaccagatactatggatgagatgatgaagtcatatgcttgagatccctgagtaaataaataagaaagagacagaattccaacagcggccgtgtggctgcagagcctctctccctccctgcctcaccctcgagtccccgcctgggagggctcagggtcactcactaagcatctttcccatgcgctgctgtgaggctgctgctattaacttgctactatggagtagtcattagtagaaattatgaaaaaatttgaaaaaaaatcttcatatagccagagattctagcctgagatgtctttccttatttgcttattattatttgtaaaaacagggtctccctatgttgcccaggctggcctcaaactcctgggctcaagttatcctcctgcctcggcctcccaaaatgctgggattgcaggcatgagtgaccgcacctggccacctttccacatttaagagatccctgggatactgcgaagcaggagtccatctccagacatgaggagcaggtgggctaaaggaaacaggactggggagtcttggaggggcagagcaatgcccagggacacagaaacttttgaataaagacaagagagaccgactcttcgcctacatctaaagcaaatgaaaacataaaaataaatgatggcaagaaactaaactaaaaatacactacccctgaaagtatgtgacactggatgtactatctaattggtctgccacaggtagagaatgaagtacttcagataagttaatttatcaaataactaaaattagatatataaactttacgattctgaaaacttttttcctacagatgtgtgtactttaggaaacacagcatatttaacatttttataaatttcagttgcacaccgtgcagctttcaggaagctttcacaccgtgcactgccctgcatgcacctcccaagcctcgggctgttcatgcctggctgtcagaagtcacctcctggctgccagaggggcgagggggcaggctgttcttctcagtgctataagcaagcccaggactccaagggaatgataacaaatgtgtaaaaaccacagtcacattaacctataggctcaggacccagttctacttcctccagacagcttttgggtactggtctccctctctgtgtttacagccgtcctgggtttgctgggcacctccgagttcatggaagtgcagctcctcactgcagttgggacacactccactttgacaaagggggtgttattttcagcagtgggtgaacagcagtgaacaaaccaagcccctgctcctggggctcaactgggatggggacgcagacaacttaaacacgtgaccactggcgtacctaagggccagggaatgctgctgacatgatgggggtggcgaggccaaggtcccagccaggtaggcttgagttggtattgctacaaccttgtgatcactggcaaacaagatttcatggtgggagtgtgactagaactggatttcaaagtttcttgaaagcactagttagaaaagacaaggtacattgatctgcacacaggaggtgctcagcgacgccagcactgatgggctcctcctgccttgagtgaagagcatctgcccctggacagtgaacaaaaggtggggccattttatgcctccaacaagacatctggctcaaactcaacttcaaagattagagtaaaaacgaaacttccattccaaactacttatctttattttggcaactggaacaatctgtaattgaacactaaattctattactaacttttatcctaagactgtgtagtaattattgattagtctccgtttaaagttgctgtttagatggaaaaaatgattttacataaaacattagttgaaagatacaggctgggcatggtggctcacacctgtaatcccaacactttgggaggccgaggcaggtggatcacttgaggtcaggagttcaagaccagcctggccaaaatggcgaaaccccatctctactaaaaatacaaaaaagaattagccaggcatcgtggtgcatgcctgcaatcccagctactcaggaggctgaggtaggagaatcactggaacccaggaagcagagggtgcagtgagcagagatcgtgccactgcactccaccctgggcaacagagtgagactccatctaaaaaaaaaaaagatacacattaagtttttcacacaaattcttaagggcagatattactaaatgccattagaaaaaaaggaaaccttttatcaagcattttttaaaaatgcttctacatttcttatttataggtattctaataatactgcgtgacattacggacaacttagcctaaattatggaaaatcaaattatttagtagaactgcaagacaatcctctcagttgttgtagtaagtgttgctataaacatttaaaacagcaaaaaaataccaaatacctgcacagtatgtatgataaatgcatatgataaagtaaaaaaaaaaatagcacacactgaaagaaagccaacagaagagggcactgggcatgggccagggagggcaagaattgggatggggacatggaggagcccaatccaaggcaagacacaggttcaggctttaccacagtcacaaaggctgcttcttgtttttgtttttagcagaaggtaagcatgagcaaattactttttagaggtaactttgctgaacttgtgaagaatggtgtgcaaggtccagagcgactgcaggagagggaaggtgggattcccacagagcaggagcacagataagccaagcaaggccctgcttggaaggcagcaatcaacagagatgcacagacctgtgagggtgccgggacagccatgcaacaatgcagcccttttgcttcctgagctcaccagttccctcgctccacctctgagaggtggtttggagaaacacagcccttctcaagagggctgcaaggtaagtttagttggtacatgagtgcacagcacattttaatttttatagttatgcatttattttatatgtactagacaaacgaccgacagaaaatttaccatttcacaggtattagtgtttaggatgaggctaaagtaggtatttctgtttaaaaaagtaaatttgaagaaaagctacccagcaaattatagtagtatgtggtacacagacaaaaaaaaaattatgcagtcgtccaaatgactgaaactgataaaatgctggtcctggtctatggattccccctctgacaaagcacagaatactcgcaccttctccagagtcagtgaccaaagatgagagagcagggcacccagcacagaaaccaccaggagccaatgacttcctcctgtgctccatcctactctctcactcacaccaggaattaaatccttttatgtagacagatggtcaagaattgctactataaagcaactcagtatggtctgaactatcagagagctacatggagaaatagctactgctaaacagacctctctgctgatgtttttcccagctacttaagtcctgaaaatttccacaaggctgagtcaaatctgcgtttcatcatctataagaaaggtacctatcgagaacaccctgctggccagtgtgtaaatatctaaaggaggactcagaaaacaccggggaagtccagcctgcacgtggtggctgggcttcagtgaagcatgcagcacaacaggagttgtaagtagtagttacatcagcagccctggaaattctgctcagaaccaaactgaacaaataacattatctaaggcttacaattatttaactccctaaattttctgtcctcccagtagcactttcaaatgcctaaaagcaattaaaagaaacatttttccaatgtctcacagaaccattagaaacacaaaattaatagcttcataaactatagcttctattttatccataatagaatgaaggtgcataaaccacatagtaattaatctttggacaaaagcaaacaataaatggaatatatggctaagatcctttctttttgagtgtggcccaagataaaaatttcttccaaaagggtaacattaatgcaataaggcttttgtggaattctattttgtacgaaattcctgttttctattagctacttcttcctctgtgacacaagcctcattccttgtgaaaaacacgaagcagaaaacattcgtgaaatcatcaggtaaagatcccatgaccgttctatcactgacacagtatgtaggtacatggtacaacccccaagggaccaccttgtggcatcctcagcaaccacagagccacagggcagatgagtgtttgctcccactgaggctctgcaacctctgccaccaatactggagaaatcctccaacctcactgttttctcctgaacttgttcccttctgtttttcgattaatacacagcaaacaggcacaccttcaagctgccaaaagcatcttaaacgttgtacacttacaatcttcaaaatatagttgttcaaaagagtcatcaaagtagtttttgaaatagaacacttactttgaccacataattgaaccttcggatatcttgaattgcacttgagaagtctaaccgattaaaggcttctcccaaggtgcaatagccatgcctctggaagagcaacacagaatttaaaattagtcaattagccaaaaagaattggcagttaatgtcaattaattgtgcgattaaaaaaatttttggcaaaggacaatttgtttttattttgaagactgattttagatttagatgagagtatagtaaaattgtagcaatgctaataatttaagctgtttatgtatacctgagacaccattaactgacattttttacaacctgctgaagtaatgacaaagacaaatatttattaaatatcttgctggtttgttttgttggggacaaactggggtgtggacgatgttaaagctaagatcataaaaaaactggattcattctaggctacgcaactaaaaatacataaatcatctgattaactgcattgtaaggatgtaggtgttacaaatatctagttgaaacacaggatttctctgcaggggaggcatgcactgcccgagtttgaagtgtaacatgggatttctctccagagcagccatgcactgcccaggctggaagtatgctcaaccacaagggtcagggctgggagaggcgcttcggtagcaagaaggtgcctctgaaaaccagcattgggatggagagggctgaaggcaagtgctggatgtgaccacgggcagctttcaggctgggagcacggatgccaagaacccaaaacaccaaaaaaactggtgcttagacccacaggtccaagaaccgaaggaagaaaatgaaacaatttattttcagtactgtaaacactgctgctattctcttagatgtttttcttccatgatatacccttatcctgtattggtttgtatagattagcacattaggtttcagaagtcattttaaactccatcttcatcctccatatttgaaatatttaaaatctacagattttcaggtcaaagttgtagagataagtaagctagaaaacaataatagaaaacatgagacgattggtctcaaattccaaacaggtgacttgagatgtcctagagaaagcagctggagccatagcacctttgtctctaacagccgatacactcagaggctcatgtgcttctgtgcgccaaccccaatcgccctgacgggtgcacaactcaactaaatatactcatttaaaacatccaaatatgttgactgagtgcctgctatgtggaaaacattttcctgggaactctggggaaaggaaacactcattttgatatagattataatctgaaatccatcacagctgatattccacacgatggtgtagcagacactttccaaggtcaccacccatctcacaaaaggaaattaaatctgattcacagagcagaccacaaagagcatgtctggacctagaaccacagcatgtaacctcggaagcagtgagacaccagccagcatggacaagcagcaggcacttgctctataccaggtgagggtgtggagacatgacgtggtgcagggacaccagcacccagtcctagttctggtccctctcagccttgttaggtcctggttcctaagattccagggaacatccccacagcctcacaataagatcctcctttcctgcatatgctagcttggatgggatcctctgttctgtaatcagtatggcaacagagcagatgaaatatttaatggtctttcatgagcactaaattttgttttttacaaactaggttagattctgtcaaataatcgtctaatggtgtattcgagtgtatattaaggatctgattcattctatacccactaaccataaccaaacagattaagttttctttctcagaatctaatccttcagtttcttggaagctggactagtttcagagcatctacaaacatttctggaatatttaacttaccctgaaataacagacgatagacagtaattccctaaattattttccccagttgttgcaaaataaagcaaatgcagagtttctaggactataaaaggaactcaacttcccggatcctagtaaagaaacaggaaacagcttgaagctctctggtttgttttatggctcatgaaaaagctttagcccaacttggcaaaagaaaggcagggaaagagttcatatggctctgcacaaacccaacccaattactaatttcatgttagccactctttatgtggaatgagagggctcacagatgccctgccctccaaaacacgccacagggaggacacattcccatcagcatcaggggttcatgctaacacagagaaaatgcgtatgactgcaggagtccatgcttggtttaaatagccctgctgttgactcagatatgtacaggtaggcaggaaccacacactgtacacatataccacatgccaccacacaccatacatcccacagaccaatgtgtgcataaatacatgcacaaccatacatacacaccatacatacaacacacatacaccatacacacaacacacaccaatgtgtgcacaaatacacagccacataccacatgcacatgcaagcacacacaatggagaatcactgcctcaaaagctcctcatatgctattatctgtcagaatgtgaaccatagatctgatattgcaaaagaaatgtgttttatgcaactttattaatacatttatttaatgtgactccatattcaacagaaacaatccaagatactctcttatttataatagaatacttacttcttttgtgctttctttatggacatagatccatttttcatgataaaaacctagaataaaaattacctttgtttttaaaatctggcaaatcatttcaaaatgaagattttaaaggaatttaaataattggacatattaacaaaattatctgacttactatattgacaagaaatgcttttacttggttgaatgcaaacagaattgctttgtttcttaaatcagtttaagatatgaacaatgatttcagacagtaccaagtcctagtaacttagaagaaaattagtattattaatgactgaagccatatgaagacataaatgattataaaatgcaattacattactacattcctatgtaccctaataaaaagttctattcttctgttgctgtgtatagtactccatagaaacaaatttttcagataaatcttaaaagtttcaagaatcacactaactgtattctccatgtgaccctatcttcttcataaagtagtccccccgtattcacagtttcatcttctacagtttcaattacccacagtcagctttggtttgaaaacattaagtggaaaattccagaaataaaccattcataagttttaaattgtgtgccattctgggtggtgtcatgaaatctcacaccgtcctgctctgtcctgcctgggatgcaaatcctccctttgtcaagcgagtcctacactacccgccccttggtcactcagtagccgtcttggttatcggatcacctgttgagatatcacagtgcttgtgtttaaagaacccttattgcacttcataatagccccaaagtgcaagagcagtgatggtggccatcttgctataactgtttcattttattattattctcgttaatctcttactgcacctaatttataaattaaactttattataagtgtgtatatacagaaaaaaaaacatagtatccataaggtttggtagtatccacagtttcaggcatccactggaggtctatcccctgaggtaaggaagcctactatacattaacatgtgtcttggtaactcacagatatgctgcatgatagaacgctatgccctctcacagataggtcccacctccagccttcccctgctgccatctaacatcctaaactccagctctgaatgtctgtctcctgctctgaatcttcagtgacttcgaaactcaagtcaggacacctctcagtttggcctcactgctcaagattgagctgaattcatgaccataattcaagcattcagattcatgggctgttttgtgggttttgctatctcttattttgtttttgcacatcttacccactgaaacgttgggctgcaaaaagtttgatcactaaatatgtaggcaatgctggatactgggctgttatttacatatttgtatcaccttttatttcataagatagcattgtcagagtaatttagtatttcaacataatcaacaagtaaaataaaattaatgagaatgatcttactttgagtatttgtgtcatttctaaaatggtcctttttcctttttttggatgcatattcatgctcttcattattgactatttctccatcttcactatttaagatactgaaataaagacatattctattaaaatattttttcagggagatcttcatttggcttttcttttgtaaaaggatacaaatacttcaaagtgacagactgtgggcttgaaatcacaggggtaatgtctaatacatttttgtttcattttgagaaataagatgtatcctggttctttgagaatattgtaccagaaagtgctgaacatgttttagaatctctgaagggtcttgatatgcttatccaaggtagtttcaaacatcaaaatggcttattaaaacagagatttttttaaaaaacaactattaaaactccagaaaaaagatggtaagaacatgatgatacccaatactgaccaatgacttgatgtgtcccttaccccatgctgagtaaccactcaacatttctgtttactccctatatgtttaagggtttaactgaagttaattattactgcactgaacatgtttttattaagcaccaaccacatacactgttaacacatttaactggaaccaggtgaagtgacatgtatatttttactatttaaatacgtttaattaaaagctgttctttgtgaaacaagaaaatcaaatcataaggcaataactaaacaatgggaacaccttttactttttaaaaaaatgtcttccttacagaaaaaaaaaacctgtaaatagtaatccacatcctcaaaactaaagatgtgtaaaatttttattttccacacactgataacagattttcagtgtaaagtgaggaaggaagctctgtggagacaagctggttggtggaggcatgcaagagtggtgctcaaatccaaggaactaaaattgcttatttgccggtcatcgttctttgacaagaaaattgtatacaagcccctttccactcaccactattcacttttagtaaaaaacagctgactttgccaaatgagtcactttctcactgtcagaacagacttaaacagcagtgccaacagttgtaaatcatcaagacaagcaaagcacatttgaaaaacatacaaacaactgaactttttgtggcagacattataacagcaatttatggaaatgtgttgatttatggaaatgtgtttgtattttatatttagtcttacaccagtttgttatcattgattgaaatactgaatgtagaagctttagaatctaaaagggttttctaacgaaaattacaaacatatcaaaggaaaagcacaaatacaatgttctccagaaatagtgtcgcagaaataaagacagaatatggaaggagacaggattgctgactaatctcatatgtacagggagaacgacactccatgcagcttagctccaacatgtgagcgtgggacagaaaagcaaggtgaacctaaagacatcccatggacacactgagctggaaccaactctgcccataggtggtggggccaggttcagatgcttgcagtaaccgcatcctcctgtgaatctgggtctacatggctgtggctccctgggggctacccacactgtggattccacaggtggaggtgaccttcttgggcactgctgggacacttcctgggcctgcctgggcagtggtagggctcagagaacttcagcgttagggccttggggagtctatgtcagacttgaggaccaagcctgggctcacaaatgacaactaggctactatttttacaaagtattttaaatggggaaaaagccattattttttggttgtgggttttacactgtcaggtaaacaaaaatgtacaagtagagaagaaagatgaatgcttctgaaatttaaatttgacacattaaaatgttaataaaggagtatttaatttataaatctttctattctgcatgtgtcaactacatttcatagcaatcaactacatgtcatagcaaacatgttctctttttataaccttcaagacaaacatcacctactctgacttaaaaacaagggaacctgtccaacaacttgattaaaaaatgtcaaacaacttcaacagacacttctccaaagaagagacacagcagccaacaagcccatgaaaagatgctccacatcacgaattgttaggtaaatgcaaattaacactacaatgagatactacctcacgctcattatgaggctactggcaaattaaaaaaaaaaaaagaaagtttaacaagtattgacatggatgtggggaaactggatccttcgtgcaatgttggtggaaatggaggatggtatagctactataggaaacagtatggaggttcttcaaaaaattaaacacagaattaccatatgatccagcaattccacttctgggtatatattcaaaagaactgaaagcagagaatgaaagatacttgtatacccacattcatagcagtattacttgcaacagataaacatggaagcaacccacatgtccatcagtggatgaatagataagcaaaatgtggtgtacactatacacaatatggaatattattcagtctgaaaaaggaaatgctgacacatgctacaatagggctgaaacttgaggacgttacgctgagataagacagtcacaaaaggacacatactgtctgatttgacttatgtgaggtactcagaaaagtcaaatcatacagacagaaaacagaaagccagttaccaggtctgggggtgctggagaatgaaaagttagcgtttaatggggacagagtttcagtgtgggaagatgtaaaagttctagagaaggatggtggtaatggttgcacaataatgtgaatgtacttaacaccactgaactgtacatttaaaaatggttaggaaggcaattttatgttatgtgtattttgctgcaattaaagataaacagtgtgcaagagaggagaggaagtagcagcttgtcttgttcatgctgtctgaggtgcatgtcggagggatggggtgggggcgggaagtgttaaaaacaaagaatagaacgttatacaacacaagcggaaaacacagggcacaaacgcacttgtataaaacacagagtttccataaacttaaaacatgtctgaatgatggagctaacagcccttaactccccacacccaggctgcaccacagcatatgtcacccccttgcttgcaaatgtgcccaaaaggcaatgacattccaagtttcctctgacaagcccaaggacagggcatgagttttccaagttcctttccattcaagaaaaggaagagaagagaatagagaagaatcaacaaaacaactccaaatagaagtaaacgagagccaagaacggaactatttctcataattaaaccccaatttctataaattacaatcctcattctagtgatgacctataataagatttgcattttcctctgatggtatttcccttaagagatggataacaaggtcttaatcttcatctcccagaccactctagggttctaagcacaggctttacagaaatgtgctgttatgggccatcatcttcaaatcatttccacacaagtctaggaaaataagacaggctaggataagcctccagtttttaaaattgctaatcaagggcatcagttcttaactatattgctgtaagatatgtcacaaaacttttgttaccagtaagaaaaatgaccaacatttgtgaatgatttaatttttaataattattaaagtactacactacacataataaaaaataatacatactcataaactcaacttccctgagttgccagtaggaagcaaccctgccgagcccttgattttggatttctggcctccagaattgtgaggacatacatttctgtggttttaagccaccgagtttgtggttatggaatcccagaaaatgaataaaattatctatcttttcaagctacttcagtttgatattgattatgaaaggtacatatatgctatcaaacagaagagactttagggagaaaaaatctcgcataaatgcaacaagttgccatgactctaagtgccaaggtcatataacatgcagactgtgataatttcaccaaaaccaaaacaaagtggaacaaatcctcagacacagttgctgataattcccaccctggcctcctctgacatttcctttcgatcaatttggctgcacctcttctgtcaagcaggagctggacgacattttggtcagctcctccccagaagggagctacaatctctgctctaacaatccccagttgttgtcttaagtcacactgtgttcatcaatggctacctactaaacttagctttttatctgtacattttccaatcaggtcgtattattttctcctggtaggcaaatgtttacgtttatccattttcctgatataaagctacttcgtatcagtgtgttattagtctctaattataagaagataatccagaagagaaagtccagtcaattttatataagttaaaaaaaagatgtgaaacctattttcagaattaacatttccttcctaaacatctaacacgacacacttacggactcttaacacacccttattacatgaaggagcagcagagcagagggcggcaagagcaccaaggccaggtggagccacagccaatgtgggcccatctcactccgcagggagaagcaactgcactgtgcacagagtgcaatctggcagaagggaaacgccgtcttaaagagcttcagatgcagcaaccttgaggaagggctgtgccagaaagtccaccagatgaggccgcaaacctatcaaagggcatcagacactctgtgcacagggtacacaaaacaatgcctcccacattctgtgacttcctgcgcgtgccacttggaccaccacactccctacctgcaccatcttacctggacagactaaatctcagccacctcatgactaggatattaacatggcttccagttctataaattcctcccccttaagaatgcatgtctgtaaaatcagaaatgatgaaaactggactcgtgagtggctttgtagtagggattacaggtccagaatagaataggttcagtaacatatttaagatatttaagggaaaaaatataagccaaagatttaacatctaaatagtgactatcaagggtaaaagtcacacatattttttatgagtacacacaaacacaggaagtacggtgaccaggagctgagggatgacccactaaagaataagctccggaaaccaaaatgactagaggcagatgcaaaggtgagctgcaggtggtctgtatttatctgtggagctgctggcacatgacggtgataaaagtgcagcatgccatggttaccagcttggacaatgcagacaaagaacaaccaccagagaagtggtaggggcgggcagaagatgtgcaggggccaactgggactggggtgtccatcagctaactgcagtatcaggtactatggggagccaaccaaagaaactaagtgtttgctataaaggcattaggataaaagtggaaaaaaaagaggaagaaagccctcttaaataccaaaagggtaaaagcaaataaaatagaacaaggtggttccctgttatctgtgatgtaaaaaatggacttggctcacctattaaatggaaaacagtcttggattggctcacaaagcaaaatcaaacaccatactgcatataagatatacagctataaaaggctgggaaaatatatagagaatttataggactcagaaaaaaagtaactgtcacaggaaactttatagcattaaatacctatatcaatacaaatttaaataataaaaataaattatttaaacatataactgaaaaagccagaaaaagaataagtgaaccaaaagaaaggggtgaattattacaaataaaagcagatattattaagtagaaaaagaatagaactaagaagtaaatccaaaagctggctctcaagagaaaataatcaaccaaaacaaaccactaggtatctgattagaaaaaaaaaaaaataagaaagttacaagtgctaacagaagaaaatttaaacattgtaaaagataaggaaaagaaagagatagagagaaaaacgtgtagattaaaagagactttaaaaacatatcaaattttaagaataaaacaacactaaactatagtgtctagggatatacacttggtgataaaactataaagattagggaaatgattaccataagagtttgggaagtggttatttttggggagaggaagtaggttataatagaaatgggacatgtggtgggcgcttctgggatgattgataaagttctattccttgacctgggtgtggttacaaggatgtttcctttataaaaatgaagaaaaacattaaaaaatcattacaggcaactttataaaactctttgcagtaagttagaagtagatgaaacattttttaaaaatattaaatttaatgctattccaatacaaaatcaagtttttttcttagagctaaacaagttaattataaaatgcatttaagaacaagaagaaactatcctaaaattcatatggaatgaaaagagagcccaaatagccaaagcaatcctaagcaaaaagaacaaagccagaggcatcacactactcaacttcaaactatactatacagccccagtaaccaaaacagcttctgtactggtacaaaaacagactcatagaccaatgaacagaacagaaaactcagaaataaagccacacacctacaaccatccaatctttgacaaggccagcaaaagcagcagtggaaaaagaccatactattcaatatatggtgttggaataactggctagccacatacagaagactgaagccagacccctacctttcaccatatacaaaaattaactcaaaatatattaaagatttcaatgtaagacctcaaactgtaagatcctggaagataacctaggaaatactcttcttgacgttggccttggcaaagaatttttggctaagttcccaaaaacgattgcaacaaaacaaaattggcaagtagaatttaactaaatgaaagagcttctgcacagcaagagaaacgtttgacagagaatacagacaacctactgaatgagagaaactatttgcaaactatgcatctgacaaaggcctaatatccagaatctacagggaacttatgcaaaaaacgttcactttctgtctgtgttcacgtcaccaagagaatagaaaggaaaagggaagaatgcaaaagtcaaagacacgtcaccctccttgagacagccctccagtccaggccaaatctcagcctgcccttggtccgctgtggttgggcctgcacccaagccatgagcacacgcagcaattgtggcagcagaagcttcctctgggctcagactcaggctgatgctgcgtcaggacctgccgcggtctcggctgggcttcctgggactcggtggttgtgggctgattgtaaagcacggaatgactcttagaaactgggcgtcattctttgtggttttccaagcttggtctctgatgatactccaggtcttaggagacatgctgaatatttattatgcttacattcaagcaacattaacccttaaggttgatgtagctccccgtctttttttcccagaaggaggagcactgaaggaacacttttccagtatggattctttccagctccgagaagctggaggcacacggatccctcggccagctctcatctatggacgtgctgtagtcacaaggactgtgactaaggctcagtccctgaggactgccttggcatgggctgctttaggctgtaaacacccagttttatccactttatgtgaagaaagccaacaaggggcatggagtgagttccgcaggttttagcggctgcggcggctggtgctcagtggggatgatggcgggaaggcgcctccctctgtgggccccgaggtctgtgcgggaatcagctctgcagctgtgtccaggggcagccgtagaccacacacggcaggctcacagctctgttccatgagaactttatacacaaaagcagacgggctgggcttggcctctggatcataatctgctgacccctgggtaagaaattttaaatatttacttatttctgttcaacagaaggggtgatatactgaggagtgaataatgggaaagatctgattcggctgtatcaggaaggactggtgtaaattcaacttattaactgaattcacagtattcgtgttttatgcctttaggggttaaaaatgggtcacacacgagcagcatgcacttcactggcgtggcagggcacctcagtgtttacatgtgtggttcccatgcttaccagggctggaggcccctgtgagtagtgaagtgcatgtggagttctggatacttttcctggctttctctatttgtgtgagcttgtgcagttagaggtttgggctgaatttgggtagaaatgggtggctcacaggctgcaaaagttctgtggacactttttcccccagctgattaatgttgtaaatattagaatattgttacataaaagtctggatttttagtttctttcacattggaatagctgccaacattgggcctgcattcatctctctagggcaacgtcggctgcagctgagatggctgctccccggtggggtgtgtgctcggcctgcagtccccgccctccggactccattcgcctccactctcaggtttgcacctcgtcattgtcttctaattttgcatccctggactgcgtgacctacaaggctctcagcacaacaagactctatgattctgtctattggaacaaaaagccagtgaggcaagtgtatcatcctgttgatgaattcacagcattaactctgggagttggggacagtgtgtattcttcctccagacactctctgtttctcctggatggaaaggttctgctacttgtcccgtggtcaggcccagccaatggaacggaatggaagtgactctgccccttattggcagaaactttaaaagccgcacaacgttcctgcaccctcccctctgccatgagcctggcagtgctcaggatgggaaaattatctcacctgggcctgaggatacaggagctacccccagcctgcagtggaagagaagcatggacaagtgattaaactttgtgttttcaagccacagaggttttttgaagttgtttgctaccatgctttgtccctacaaacacagtcatggagaaggccagtggcagagcctgagccgttcgcgcatctgttcaccagtatccagaataacaatagatttttgaaacattcctgagaaaattctgggagttgcataccggccagtcttattctctaaagttgttccttctaaagggtgtgatgaccgaaaatttcagaaaagcaaaccaccgctgaaaggcaacgttatttctgttggcagaaggcggcctgagcaatctagattttccacggttcaccaactagtttttaaggaaatatggctgtgagaggaataaaacatgattcctacctttaaggaactcagagaagtgaattaaaggaagtcacagatcagacaaccaaccacacaaagtttctaagagcaaactgttcaggtcggcaagtcactcttatccactgttttgccttctaaggtttcagttactctcagtcagtcatggtccaaaaacattaaatgaaaaattccagaaataaacaatacacacgtgttaaatcatgtttcattctgagtagcttgatgaagtctcatgccgtcccactcagccccacctggggtgtgacacctccctctgtcgagcagatccaccctgtctatactacctgcttttccaggagatccaccctgtctagactacctgcgtggccagcagatccaccctatctacactacctgcttttccagcagatccaccctgtctacactacctgcctgtccagcagatcaacactgtctacactacctgcttttccagcagatccacactgtctacactacctgcttttccagcagatccaccccgtctacactacctgcctggccagcatatccaccctgtctacactacctgcttttccagtagatctgccctatctacaatacctgcttgtccagcagaaccaccctgtctatactacctgcctgtccagcagaaccaccctgtctatactacctgcctgtccagcagatccaccctgtctacactacctgcctggccagcagatccgccctgtctatactacctgccgctccagcagatccaccctgtctacactacctgcctgtccagcagacccgccctgtctacactacctgcctggtcagtatatccaccctatctacactacctgcctggccagcatatccgccctgtctacactacctcccagcccagcagatccgccctgtctacactacctgcctggccagtagatccacgctatctacactacctgcctggccagcagatccaccctgtcaacactacctgcttgtccagcaggtccacactgtctacactacctgcctgtccagcaggtgcaccctatctacactacctgactgtccagcagatccaccctgtctacactacctgcctgtccaaaagatccaccctgtctatattacctgcctatacagcagaactaccctgtctacactaccagcctccccagcagatccaccctgtctatactacctgcctggccagtagatgcatcctgtcttcactacctgcttgtccagcaggtccaccatgtctacactgcctgcctggccagcagatccaccctgtctacactacctgcttgtccagcaggtccaccctgtctacactacctgcctgcaaagcagatccaccctgtctacactacctggctggccagtagatccacgctatctacactaccttcctgtccagcagatccaacctgtctatactacctgcctgtcgagcagatccaccctgtctatactacctgcctgtccagcaggtccaccctgtctacactacctgcgtgcccagctgatccgccctgtctacactacctgcttgtcgagcagatctgccctgtctacactacctgcctgtccagcagatccaccctgtctatactccgtacctggccagcagatccacgctatctacactacctgcctgtccagcagatccacactgtctacactacttgcctgtccagcagatccactctgtctacactaactgcctgcccagcagatccaccctgtctatactacttgcctggccagtagatccacgctatctacattcccttcctgtccagcagagccaccctgtctatactacctgcctttcgagccaatccaccctgtctatactacctgcctatccagcaggtccacgctgtctacactacctgcttgcccagaagatccacactgtctacactacctgcctggccagtagatccacggtatctacactacctccctggccagcagattcacccagtctacactaactgcttgtccagcaggtccaccctgtctacactacgtgcctgccagcagatccaagctgtctacactacctgcctggccagtagatccatgctatctccactacctgcctatccaactgatccaccctctctttactaccttcctgtccggcagattgaccctctctactctacctgcctggccagcagatccacgctatctacactacctgacttaccagatccaccctgtctacactacatgcttgtccagcaggtccaccctgtctacactacctgcctctccagaagatccaccctgtctatactacctgcctatccagcatatctaccctgtctacactacctacctgcccagcagatccaccctgtcttcactacctacctagcgagcagatccaccctgtctactctacctgcttgtccagcaggtccaccctgtctacactacctgcctgtccagcaaatccactctgtctacactacctggctgtccagcagatccaccctgtctacactacctgcctatccagcagatccaccctgtctatactacctgcctgtctagcagatccaccctgtctatactacctgcccatccagcaggtccaccctgtctacactacctccctgccgagtagatccaccctgtctacactacctgcctggccagaagatccaccctgtctacactaccttccttgccagtaatgcacgctatctacactacctgcctggctagcagatccacgctgtctatactacctccctgtccagtagacccaccctgtctatactacctccctggccagcagatccaccctgtctatactacctgcctggccagcagatccaccctgtctatactacctgactggccagcagatccaccctgtctacactacctgcctgcccagaagatgcgccatgtctacactacctgcttgtccagcagatccaccctgtctacactagctgcctgtccagcatgtccaccctatctacactacctgcctgtccagcagatccaccctgtctatactacctgcctatccagcagatctaccctgtctacactacctgcctgctcagcagatccaccctgtctatactaactgcctggccagcagatccacgctatctacactacctgcctggcgagcagatccaccctgtctacactacctgcttgcccagcaggtccaccctatctacactacctgcctgcccagcagatccgccctgtctgtactacctgcctggccagcagatccaccctgtctacactacctgcctgcccagcagatccaccctgtccatactacctgcctggccagtagattcacgctatctactctacctgtatggccagcagatccactctgtctatactacctgcctgtcaagcaggtccaccctgtctacactacctacctggccagtagatccacactatctacactacctgcctgtccagcagatccaccctgtctatactacctaactgtcgagcagatgcaccctgtctatactacctgcctatcctgcaggtccaccttgtctacactacctgcctgcccagcagatccaccctgtctacactacctgcctgtccagcagacccgccctttctatactacctgcctggccagcacatccgccctgtctatactaccggcctgtccagcagatccactctgtctatactacctgcctgtccagcagatccatcctgtctacactacctgcctacccaacagatccaccctgtctacactacctgcctggccagtagatccatgctatctacactacctgcctggccggcagatccactctgtctacactgcctgcttgtccagcaggtccaccctgtctacactacctgcctgcccagcagatccaccctgtctacactacctgcctggccagtagatccacgctatctatactacctggctggccagcagatccaccctgtctatactacctgcctgtccagcagatccaccctgtctctaatacctgcctgtccagcaacattagtccttaaaaaaagcaaacacacaaaatcagtgtctatttacaacagccaaatattatgactacgatttgaaataaatttgtagacccatgtaaataaattttaaaactcaatgaggatataaaaatgacatgaataaagcctgaaaatcatattattagaatggaggacatagtgacataaaacctcagtgactgtagactcagggcaacctagacttaaaagtcccatgtggtcttttacatgtaaaaaatgagaattagtctaaaagtcaattttgtctaaattttgatttttggtgagtatacagtcaaaatagttgtgaaaagaaaaaaataaagttgtcaaatttcatgtaacctatgttatttggaaatttaaaataagttatataaatatttataacaatgttaaacaatttcataagtggactgaataaaacataatattttatcatatacaatagctcctgccttcctgaggaaaacataaaatcaaagggcgtgaaggaaggattttggtttcactgcagaaacataataagacaccgaagtgtgtgtttgtgtgtgcgtacatatatttaaactacagaatataaaatagcatctaatatacatcaaaaatgagtttcatagaaaaattcattttacatatatgtctataaaataataaaatttattcagcctcacaattactttgtgaactggaaataacaatgagttgtcattttatccaaatctaaaaaaaaacatacatacagtatcaagttctggttaaagtagtagatgtactttacgtggtacataagagtatctatacagtttgtgggctgcatcttgctagaatatattacattataaaatgcaccatttatttactctgcgatcaaacccccaacttgccccaagtggaggaaccctcagacatttgcagaggagtcagtgtgctagtaagcagcattctttacaaatctatgaacatcaaggtctccttggaacagatgctctgtgaacaatttataaaactccctcctgttagacacttaggttgattccatttttaaatcaattactgaataaaacacactccatcgtgtggatgaaatgctaccttaatttgtcaaagctatcattttctaaacttttctttttaattcaaatcattaataatttgtgaccagatcaatactgattcattgttttaagcttcaaatgcattatacagttgggcagaacacatttcctctcatcaatcttcttttccaggatttgtcaggtattcctgacattaattcactactaatatgcacagtttctctaatcatggtcaacaaagatctgacagtgcattgtccctaaacgatccatacttgcctcactgacaccatgtggcccacttcccatctataatctatgtctgggtgtgaagcccttcccatatgatcccccgaatggaacttcacaagttcgaattcactgggtcacagtgtgatagtgtgaagatgggaggacgttaagggaaggctatgggtgagttgggaaatgtgttaggcagggtcagagattaccacatcctaaaaacaacacttaaggagggagatgacaaaacaatcaatgaataacatgactttttccagtgaaagtgccatatctaatccttttccatttttgttctctgagcttctttcttagggaagatccttcttgagaagcccctgctgagtattaggaaaatgcatttcaggacctctcatcaacacatcctctttctttaccacaaccacatatatgggggcataactcaacatgtgtaaaagacaatcttctgcttttcactgaacctccaggaattcaggacaataaacgtctacatggagaccaacaggtgagtttttctgccccttctttcataacaccgttcttccctagtgaagtccacacacatccttacatggcagctgtgggtatatcaactggtctgaccccttttagtcacagagcctgaagtctctgctagtacctgctgagcacagggtcatgggtgagaatgggcaagtctttttctttctctggttcctgaacttcccaggctctctcacttctggatcctgaatacccaaaaaccaagcttccttcccagaaccaacacctcctcctcattagaaagatacctttgttctgtgcttactttataaagtcttgctctttccctatccactgccttgtgtcagtatgtgtgtgtcttggggccggtggaaaggtgaacagaagccagtagagagtaaccagcaccagcttcacaggaatggcatgaccttgatacgatagcggcagttttcccttaacatccctgccccctaaagacttcagatcatatgtcacactcttaagtaacagcgatttgtctttcacggttttaatcatattgattaaaagcatttgtcttctccagaacatcacattaagtcatcaaaaaatataaaccttaaaaagatgtaattattggaactgaaaaacataaaaggtgagctttggaaatatctttgagcaatttattcgttatgaacacatgtaatctgttggaacaaagttctaggacaatccaggtcatccttcaatatttgcagaaaacatcacaaagaaaacttgatacttatacttagttggaaactttatgccacagccattaaatacagagatcatacaaaggaatagaggaagctgttgaatactaaactaactcaaatcatcaatatccttacggagtgcacactgaattaatgtaaaaagcatttagtaaacaaaaagtattttcaatatacaattaagactgaaaagtattgaggcctcataagctgaacctgacacaataaatttaaaagggaaactaatttggaaatcagaaaaccactaaggaatttgggaattaggcttctgctgccctctctgctactgacggtcaaggcctcctcattgtattctgtcctccatatctctgctgattcccattttgtctatttccatttaccccactactgcttgctcaggtcactctccttcactgtcggtgtttgttcaaattcctcagacccatccacttcccatctaaacttccctccccttttctcgctcgttggctctacctccctcctctctgttttctcctcactctcctgccccacctcgacatccacagcgaggcaatgaagaagcccctgccaaggaggagcccgcttctcagtgggacaccgggaaggtagacacccaacagtcaccgctagtgggaggcgattgtgcagaagcacgagggttgttacaggatcgggcaggtcccctaccccagtctcggactcagggtcctgtctgaggcggccaccccgaagcgtggggtttgcggagacgtagggcctggcggagggaaggacggggaagcatctcagggaggactggcgtctgccgaatcccagggctgccctgaggggccaagaggggcgagggtggggacgatggaagacaagccacatgccgaatggggacctgaggccgcgcgcgataggatgggcggacggtgaagagaactagggtggaagggccggacaggggcgacctcagtgacggaaccggacacagacgcagatctggcagctgagcgacaggcttcggagcatttccgggcgtcgcgggactccccgccgacaggagggcggttgccgagcctgtgacatccgcggagaccagcagaccccgggtgtggaggacgccgcagggaggggactgcgtggctgggtttggccacaaaaagcggagggcactcacccgagcggaccttggctccggataatccgtttccgggtcaacaaaaaacgtcgcgcgaggggcggggcgcgtacgtgcagggaggggaggcagagaaaaaggcggggccgggccgggccggggcggggtctcgggcaggggcggggagcttaccgacctcccgcccccgctgcgcgcgtttctggccctgccagtgtctccgccggttgaaagcgcgtgtctgcgtcgggttctgttggagtgcgttcggtgcgccgtgggtccgcgctgcttccacccaacttcctgttaggtaagaggcgcgtgaggctcctgtgccgggggcggtgctgctcccgagtcggcgcgcggcggggacgcgagtccgtaggtgctggcgggagcgagagtcgggtggggaccctcgcgagcccgcactccgcctctgggtagcagcctcttcggccccacacggcgtgacgcgcgctcgggctccgcgttcgcgtcgaggcagaggcgtagtaggggtcgggcccagggctggaggggccgggaccgggcggggtgccgccctggacaccgcgccggcagctgttccgcgcgggttcatgtcattcctattttcaacctgtcctgctccgcacctgagatgatttataaattcggtacctttgggacaggcgtggatgacatcccataatttacttcgttattaatttctaaatgtaatacataccactctctaaaagtattttttaatttgaaatatatttgtatatatgtacatatatatttatttatttctgaattttgtctccagtacatataatgaggcttgtaaagtggatagtgttcaggacataggtggattttgcttttaagtagtaaagacttaattggtgacttactggggctatttgataaggatttttttttttaaatgaacattaaaaacagtgaaattgtatttccggatttcattagcttcatttatatcttaattggtgaaaactgtaagttaataactcatttttatttcctttggagattcttaagtttgtgctaccaatgattatttccaaaaaaaggcacacttctggttttcccagaactaatgctagcttctcaatcttttgagtttacttgatattaatgtttgacctcaaatcatgtcacatttttgaagaaaactttctcttagccagtggaacataaaccaccctggagttcatatagaggaggggttcaaatgcctctgatagtgtcgtgttaaaactcatggccaaacccaaggtcacatagctttctttccatgttttcctctagaatttgtatagttttgtcattataaaatgggtcttgtcctagaccccaagaacaggtttttggatttcacatgggaaagaccttttggcaagtcacagagtatagtgaagttaagatagtttattagcaactactcagctacatagcagggcgtcctcagaaagcaagaggaggaatgcacctgttgtaaacatataatttttttttgaaacagtttctctcctgtcacaatggcatgatctcggctcactgcgacctctgcttcctgggttcaaggattctcctgcctcagcctcccaagtagctgggattacaggtgcgtgccaatatacccggctaattttttgtatttttggtagagactgggcttcaccatgttggtcaggctggtctggaactcctggcctcaagtgatctgcctgcctcggcttcccaaagtgctgggataacaggcatgagccacccggcgcccgggcttaatgtttgtttatataggttattaagaatcagtttgtgacaggctattagtattgttacttctctttgttactgtcgattttaacatcaatttatgtgtgtactattacctttaaagtaaaacttatttttaaactaagaatgctgagtggtgtgctgtgtgggtgtactgtgctggtgttctatgcaggtgtattatgcatgtgtgctgtgaaagtgtattgtgggggtatattatgtaggtgtgccatgcaggtgtattgtacaggtgtgctgtataggggtggtatgcaggtatattgtgcaggtgtgctgtgtaggtgtattatatgggcatgcagtacaggtgtgcagcatctgagctccgtcttcaccttaatcccgaacactcttttcacctctcacctgcactgcagtgctgtttcctggatcacacttttttgtttgtttgtttaattcctccaggagaatgagtgtataggaaataaggatttctcttcacattttacttgactaacagtttctctggttatagaatatattttggatttaaagctctctctgaattttgaaaacactgtttcattttccgcttgcctcctatgttgttctagagaagctcaatcgcaatctcgtcccccatcctcaagcgatacacttcttttttctttattatcttgaagcattcagggtcttttcttcatttttggctttctgaaattgcaggacaatatgatgtaggttcgtttttatctctgtgctagctcttttcatttggaaacctgtgttgcgttctgaatgctgtggtctgaaagtgtaccttcaaattcatatgttcacacttaatggccaaggtgatagtattgagaggtggggcctgaaggacgtggctaagtcacaagggcagagccttcacagtgggatcagtgcccttaaggaagggctgagggcctgggtttgcctttttaccttttcacctcctgccgcgtgagggcccagccacaaggtaccatctgggaagcagagtcccaacccttgccagacactgagcccactggtgctttatcttggactcccagcctccagaactgtgagagataaatttctgttttttataaagtactcagtctcctgtattttgttggagcagtacaaatggagtaaaacactaagacattttctggaattctttgattgataattttttcttctcagtcttttatcttgtctcttccttgaacacattatttctggtgttgaacattccagaccacttctccaattttcttatacttttttctcctatttttcaccttttagatctctttttgttgttgatttactttctgtgaggtttaccaactttatctagtacaagttttatggaatttaaaaattgtttcagagtttaagttcccagatcctctttttttaactgttcatttttcatgacttccagttctttagtggtgacgtatcttttctctctgaagacagtatttacagttactggaattccttcctgctctccacctgtctttggtctgttttccttttcccgttttgatctctgtccttcatggtgcatcctcctgttgactcctgaccatctgttcacatggggctgctgtggggtgaccgggccacgcagtctcccttggcagctctcagctgtctgtatccgtcagcattttctcttggtctggtcaggttttcccagaggggacagtccgttctccagcctgggacagaggtcagggacacatgtgctccctccctgggttggctctttatatggtgagtggcaactggttttggacctctctcttgcaggctgggtctgtgggatgtaattagaaagcaactttatttctattcacttacatttattcattggaggaggagtttctctttcctagggtacacgtggacatgcctatgacttttctgctttgtcttatgtttaaaaatgtccttcagtcattgcaggtcacaagcaggctatcagctcagtaattaaaataattcggttcttcatagtgaatgtaattctaaattagattttaagttgtaactccctgcttcagcaatggtgatggggcctagaaaccagagcacctgagctccatcctacagggggccataccgggatctttccattttcagaggcttctctctgacagtgaagtgtgatgacagacttgggggcagggcaatggctagcttctgaaagccgctggcactttagtgataaatttaaattaagtgacgggtagtgaggtgtttgtcaaggaaagtgccgtccaaatgctaaatactgattatttctgcagcagtgactgcaatacctcactcaatctctgtctttcttgaagaagtcataaataaacacgatgaatctatgtagaagcggtaagtcagaaaaatctgtgtgtttcattacataaacaacggtttatcattaattgacaggcttggattgggagttgttaatgaaactgatgagatgttggacagatgagctccctcttatttcgaagagcttatctagggctgagtcatgggacctgatagcgtcttgtggtgctgtcttcttgtagatatatccgtgttttagaggatttagttttttaaaatttctcttagaatgtgaattttacaaaaaagcacttcccaaatggatgattatttgaaaaatgaattgtcagacaaaactgacacatcagttatggagaaaacccttcaagaactggctttaaatgtgttttagtgggagccacagtgtggagagaaacagaagagggaggagagggcgccccttgtttcttctctccacagccaggccttcgccacctttctcagtgtcttcaagaataaaatgcctccgttgttggttttagctgcttttctccctcggggtaggtaaagtggttccaaaacgacaagcatcctgtaaagtcggaagagctgtgtcaacattaagctgcgtgactttggctatgagggaaaaaaggctggtgagtgcagagaagacagagctgtggcagggctcctcccgccaagtcgccatggagaggggctgtgaggtgtccttaaacggcctggtctccagggtgactcaggaagggctgagagtggtcagctccctcacctgctaaacccgcagcgccccgctcagcacacaccctccactctccaaccttgcccaagtgctggtccgtcacggcaccaggacagggcatggagacttgggctgattcttttctctcccttcctccctcttttttttcttctctcactcctccttttcctttcctgctgtttcctgctctcctgtttctgtcctgcagtgtctggagctccagagaggctggccctggggtggggtccacatggacatgggcgtaagcaggtttgatggtcatgggcataggcaggttcgatggccagagttctttcagctcacagtaagttttgttttgttttgttttgttttgttttgttttgttttgttttagatggagtcttgctttgtcgcccaggctgtagtgcagtggcgtgatcttggctcactgcagcctccaccttagagcaatcctcttgcctcatcctcccgggtagttgggactacatgtgcatgccacatgcctggctaatttttgtatttttagtagagacacggtttcaccatgttggccaggctggtgtccaactcctgacctcaggtgatccatccgcctcagcctcccaaagtgccgggattacaggtatgagccactgcacctggcctcagctgacagtaggttttagagccagatatttacacactaacttgccagaaacatatatgactttattattctaattgattttaagagatattatgaactcaaatccaaagttacgtcccacctatcatgacaatttcattaaggaaaaagtcaaaccattttggaaatgatttaagtgagcaacttggaaaaattttctacattcctaacttactttccaggggatcgttcctgacttaacatctatcaggtgtcttagcttagctctctttttacttcaggtttttcttgcctcctcagtgtgctgggagtcccactccactcaaatgccctcaggtctaataattaacttcattgcaggctcctggcaggcctgggtgggcggcagctgcattgtgctcctgaagaagatttaagttgggtttggtgaactggtagaatttgcattttgctgtttctttccctctcccagaatttgtacctttaaataggttttttagtgtcattaagtatatcaaaaggaaacccagtggggcaaattggccgggctccatagaggtggccttgtctaagcctttcatcttatcgataaggaaagacaggaccagagaagtcgccgactgtccctggtcccactgcttggtttggggcaatttcctgaaaataatatccaagatgcaaagcatatggctctggtgagacatgtgtgaggagctgagaatgagacggctgagtgtcgggggcagatcacgaagggctgcgctcaccatcaggaggtctggacttcgctgtgaaagacacaggccctcatgtacgtccaggatgcggtgacagcgaggcttgcaggagacaggtccctgctgtgtgggggtgaagctggaggcaagatgatgcctggagctaagagatggtcacaggaaatccggcaagaattaacgaggactggacagtgacaggcaggccaaagagtgagaggaacttcactggcaagagccaacagggcttgttgatttaggagaggagacaaaggactgaggggtttgggggctggggcctgggagggtggagaagccactgtctgcattatgggatgcaggaggagaagcattcagttctccacacaatgagttccctgagaggtgtctcagtgggatcgtggtgcagttggaaatgttcatgagaaagatgagaagcggcaccagcagcaaacatccaggaacccagaaaccatcagcacaggtgcctgctgagtcccatagacccactaatggcccaccaggaccaaccaggaagcaagtgtggagctgggagtgagggagctgggtgtggagatcagggggaagactgtcatctaaagggcgagagtgggaaggatggagtcatctgtagctacagggaaccaccattagtcagtccttgtgatgaaggtgcaagatgttcctgcttccgcgcacgtcgctcctgggctgtgggcaagtttggaactgctgttgttccccagcatagtctcaagcgagtggaatgacggtttcctatagaagcacagttcctacaggaaagaaggcgtggttaagagcatgagggccaaggaaaaggaggggattagagatagccagcagtgagggagacggttccagacacgagccgagtgggcaaagcagggaattcaagagagagaggagcatatattacgcaaattttaaattttttggtagcaagcaacctagcaaaactagctgaatccaaaggggatttattggctcacatcataaaaatctagtgaaagattctagctgaagtcataactagatatacgagtttaaataattttgtcagaaactgtttctttgctgctcatccacctatccatccacccatctatccaaccctccctccctccatccacccatccacccacctacccactcacccgtgtctttatccattgatccacgtgcacatccatcctttcatctctactttcctccatccctctcccttgcctccctccccatccatctgcccatccctccatccacctcttcatctctcctttcctccctcccccatccctccaccccctgttcacccacccattcatccatccctgcatctttccgtccacttctctatcttcttgtctctgcttctctttgtattttgttctcactattctctatttcataaggcttcctgaaagcggcatccatttattccttgtagcaagatccctagagaaagactcataatttatctctcagtgttcataaactctcagggcaagttttatttggcctgacttggatcacctgccaatatctgaacggattgcacacccaggtaatggagtattttaatcactgcagaccccccaccctcacctgaccagtgccccacagcaggaccacgagcagggccaaggtgtctccaaggtgctgaggagctgagcgctcagccagcccacggccacgatggtgtgcctccgaagccacgcggcttacttcacagccaggatccgggatcaggctatgtcccatgcagcctgatgaagggtaaaaaagagcccaatgcagagtgctggggaagcatagagagagccggggcacctgacccagcctgggacggtcaagggtgactgccgtgcaggagttggcatctgagctgttccttaattagaaagcctggcacagaatgaagaatgcattcctcaaactgagtcagggtgcagggatccacatgaccgtgctcctcttatccttaggaagggacaagagacttctatcctttggcctgcagctgctgaaatgacccttgcaagtactgaatcatctttaatgaaaaaatacactaatatgctgcaaatttggagcttatcctttcagtccaatccatggggaaggtgtgaattaaagaccctgtgcgtgtgctggaggcatcgtggacttttgttcacgatttcctttccttttgatgcttcagttatggtggttgcagctctataagctgtgtgatatgggcaattcctctcaccttttgaccactatttttcttactaatgaaatgaatacatacaagaatacttgaagtttaaataatgaaacatctgatactcacaggcactacagtattggctgaattcttaagtgactataggacacctttaagcatgttctagggcaggataaccaaggacaccatctcacgtgccaggaaatgaggggcctgtgtccaataagtccctggctccatgtggctctgctgttgcccacttctcttggaccctggttgtggtcttcccttgccacggggcctttgctggtgatactccctctgcctggagtacctccataatgtccactgctggggccttgcccatattctctacatgtggcactgcagtgcccccccagccagctcccaggggccagtgcccccagttccttgtccaaggtctttgtcccgcagctaaaacccaatctgctgccaccggctccatccacaggcaaaagttcccgggaataaatgcgtcagggcacagccctcaggagaccttggttacggacatctatccatctcctcgccctctggggtgaatacatctcaggtgcactcttttgggtgtttctttttgcttttgttgtttgcattggctcccagagtctgacagtggcagaaggctccagctgcccacagtggtgactggttttaagcgtaccctttgttggccatcttcctctctcttggaaataaacagcctgcactccaatccttgtcacagggtcagctcctgagggatcttcttggccttgctaatgctggcttatccttcagaatttagcttccattttcacttcttcatgggagtcttcttgagtatagtctcctcgtcatgtctgccgcttcttcctgagtcagggaatatctcttaggccatatctattatagtcgtggtctgacttatatttgtggtcaatttttttttcttaatttttcgtagagacggggtctcactatgttgcccaggctggtctcaaactctaagtgatcctcctgcctcagcctcccaaactgctgggattacaggcttgagccaccaagcctggcctatgtttgtggtctctttgactaaaaatgatcttttcttctaacctgaaatctcctgagggatggaactttgtgtctctttggtttatcccagcatataaatagttacgcatttttgaattaacaaatgagcacaaatttgtatcaaattattatctaggacaagcagtggaaaaaaattctgtaaagggccgggtaactgttttaagctttaagggccatgcagtttctgttgcagttaccaactctgctgttgaagggtgaagacgtgggtaggtaatatataaaggaatgagcatgtctggatgttccaataaaattttattttcaaaaataagcagcagaggagagcttctggaatggtggtgtgaggagcttggcaggccctctatccagggaaataaccatttaacctccgaacattcatttttttaaaactagaaattatcctaaaggcatacagcaggtggataaatatttactcaaataaataatcaaatctcagtaagaacggtaaggatcagtggtatcagagccacaatccaccgctccccaccctcaaagcgcattgtgatgaaagctctgctccaggaaggtccagctaacaagatgctgtggtctgtcttcccggctcctggtctagggctgtggtttcaccccaggaaggcaggccaccagcatctctcatccctctcagtttgcactgcagaagcaccgttccaggaagttgcaactgagaggactagggctcccctgcttcagcctgtgcttgtcctcagagggtgggagccccatcccaggtgtggcagactgagcacatctgcctggattgccccacaccaagtcactcacagtgtggaggttccatgtctggaggggcaagctaggaagacaagaggctaccatgcccacccagctactggctcatgcagcaagggtgtcgctctggtggaactggatcacggtccccaggagcagaggagacctaagagcagagcatgtccctgaggtgacagactttacttggagaacagcatgcggaagttcaagcccaaggaagttggcaaaaatagtggagattttgttgatgaacaattaagagtgggtgaaatggtagactagatagaacttaaacagagggaacaaggaagagagattgttgagaagagctccggggtctgagcagacttgaaaagctggcaacactctgcccctgcaaaagagcctgatgttcactggatgagtctatggagcaatttgtgccccaggcatcataaaaaatgatagagcacttgcatttagtggatgttaacagctgtgtgtgacaccaaagagagacagaccagcagaagcttaacagagagcccagagaaaaccacagataccacaggtggtcggagagactgtgtgctagtccaaggctgtgccctctgaggagcaatatcagagctacgtccctaatcaaataaacaagcaatcaaacagaaatagcagcccctgcgggtcggggtcagaatccagatttgctatgatatattacctaaaatgccagtttccacaaaaatgcaagaaaacaggaaagtgagacccatgctcaggaaaacagaaggcaacagaaactatgacaaattccagacatcggattaacagacaaagacagccagtgtcaaaacagccacagaaacatattcaagttactaaaggagaccatgttaaaagaattaaaagaaattatgatgacagtgtcccatctaataaggaatatcaataaagaaataaaaattattttaaaaaacaaaaaattgtggagttgaaaagaacaataactgaaatgaaaagttcactcaggggcccagcagtaaattggaacagtcagaagaaagaaccagcagacttgaagttatgtcaatagagattatacaacctgaaaaacagagagggaaaaataattaagaaaaatgaatagaagcttgggacatccttaatgagagtaccagaggagatgtgagagagaaagaagcagaaaaaaagttccaagcagaaaaaatgtccaagaaataatagctgaaaagctcccaaatttgctgaaaaatgttaacctacacattcaagaagcccaaaaagctctacacaaagagacacacctagacacacacacctggacacacacacctggacacaaacacctagacacaaacacctggacacacacacctagacgcacacacctggacgcacacacctggacaaacacacctggacacacacacctagacacacacacctagacacacactcctggacacacacacctagacacacacacctggacaaacacacctggacacacacacctagacacacacacctggacacacacacgtagacacacacacctagagacacacacctggacacacacacctagacacacacacctggacacacacacctggacgcacacacctggacacacatacctagacacaccagaatcaaaatgttcaagacaaagacaaggagaaaccttgaaaggaacagaataaaatggctcaccacaaagaagggaacccagtaggattaacacttgatctgtctgtaaaaggatggaggccagaaggcagtgggataacatattcaaagtgctcagaggaagaaactattaatccacaatcctatatccagcaaggccatctgtcagacatgaaggtgaaataaatttcaagataagcaaaaacggagagaatttcttgctagctgaactgctttatgagatattaaaggaattcttcaggctgaaaacaagtgaactcatacgattttcaaatccacacaaaaaagcaaagggcagtagtaaaggtaattatgtactttttaaaaaaggtgtaaatgcatatattttctcctgttttcaaaagcaactgcataggacaataagtatggaattgtattattggacgcataacatacagaaatgtaatatacttgacaataacagtacaaaggaggcaaatgggaaaaactgcactggagtaaggaaatggccacatattgtataatcccatttatatgaaatgtccagaataggcaaatccacagaagtagaaagtagattcatagttgcctgggcttgcgatgtgggtgcaagaaagaaggaaatgagtactaatgagcatgtttcccttagggaatgacaaaaatgtgatgatttcacagctctatgaacgtactaaaaaccattgtagtattaaaaaaaaaaaaaaagaacaaaagaaaagaagagtagaattttgggtacataattgtaaaatcaatctttagtggaaagctctgttatccagaaactcaaaattagctacataacttccccagaaatattcatccgcagcaaatattcatcagagacagaatccaaacccaggtctgtgtgaatctaaagtttattttcctccacctgccttaacaacaaattattgaataactcaaggacacaatacctcgaaagagtctgaaacatttctgtgatgaatttacttatgaatcccaatactcttgattctagatgatgtgttttgttcagcatctgtttcagtcatatcaagtaaaaccacttcccccaggtaatatagttttcctttttactttttcccttggcctcagcatttacagccccgtgcagactgttttaacaaacgcgttggtgaggtgtggtagaatcacaggcaaaggcgtgctttgctgtgctgtgtaggtacatatcaaacgctcaccaagaaattataaaatattattcatagcagtttttttcttcagtattttatgggctaagtgcaatctggcttttgataacaacggctgaataatatttgagtttgccagctgaaatgtcctaaatatcttattgattcatttattgcctcttcaaataacaaggcaacaagacagtgtcagaatgctcagtgtttttacttttttgtctatcatgggatggtgtcagtttcagtaaaaacgatgtctcttattttggtccacattgtaggaatctcaccagtgacacgcgtttgtgaaaagctgtgaatattcagtgccacagggttaaacctcggtacagaagcgagaccctgctgggcagagaaagggtgacctggaaggtgtgtgagggccccgcccatgggcccctgtgatggtcatggcctcaagaatcacagtccaggtgaggccctgaatatccacagccaggaccagttccctctgctcttgggtgccaaggccaccgtcagccaggagaggcctgcagaatcagcctgtgcacctctctgacgataagcagagatgctggtttagagacttgctactcacggggaagtccttgggcctcctgtactcacattacctggaacttcttggaaattcagaatctcaggccccaacccagacggactgaatcaaaatcttcattgtggtaagaccctcggtgacacacaggcctgggaagcacaggttagcgtgtcaccttgggcaaagctctcagcattgtgagcctctgttttctactctgtaaaggaggcatgaatatctacaacatcagtttgccatgagtattgaaaaataatgtcttagaagcacagggcagagcctggcatgtagtttgtgctcagtgcacagcagacaagaaaccacatgcaccagacctgggcggccgtcggcagcccaccctgagcaaccatgggtggccctcttgtctctcgggacaagaaatgcttctttagaaatgcttctttcctttctaaaatgaaagttttggacagtatttcctttcatttaaaaatttcatctgtgtatttgatggcctctgttgtttctttcctgaaactcctgctaacatactgggagctgaagaagggctccgtgaaggcgagtaggggtgcctgtccctcccagggaggagcttccctcctctcacctgctgcacgagccctagtgcttcaccaactccagcctcagtgccctgacactgggggagggaaaggaagcgcacgcaccagccgttccacccaccgaagttgtttggtcccaatctgcaaaatcagttaaacgtcttcctgcctggcagcagatcaaagggtgaggggtctgggacagacagagacggctagagaatggatggtgaagtgctcagaggccctgtgggctatcccacactcggcggaagacagcaacaccatcaaatctccaccctttgttatccatgacttaaagaaaagtgaacagggaggtggacaactgtgcaaagactggctggagtcaaatcctgggcataggtgaagcatcgagaatgcttgtcacacgtttgaatgtgcagggggactctgactggaagctcctagcagaggctgaagacactggttaggtcctggtgcgtgccttgggatgcatcccaggcaacgggcccaggagcttgaggtcatgtccacctggctcaccagggagtcctgcaccattcttcaaacctaactggaagagacactgatccttcctcccacctaagggctcccagagccacaggtctccgactctcctgcaacacctcctgctgcctgttcccaccgcccatgattcactcagtcaccatcctcagcagcacccgacagcctctgtgtgtctgtgtcactcaccattaccagccccctgggtgcccaatgcatgtatgttagacagaacaaatgcacggcggccttcagcagcaccgaccgcgtcaacccctctgtgctcacaccaggagtgatcagcgcacacgccctcccacaggatgggagaaggtgataacagctgagctgggtgtccagaagccagccccaccccacagccactactgagaggttatgagatcatggccttatcccgagtaatgctgctgcagtgaactgggacttttttcctctgaattcaaaggtggggcagtctaggcacctggatgcaccatctgctctgtcccggcctggtggctgctcactgtgggatgctgtgcaattagacagttactatctttccctggttgacggattagagtttcccttttctgagcatcttgttttgaagtgatccgaagtgtttagggttaaagagcgtgattttcccaaactgtccaaagaaatagaagcaggtctgcaagaggggggtgcccagagccttgagatggaagcgagatggggtgagacctggggagctctccaggccgccgggaagctgcacgtcatcctctggacctctttgctgactgtgtgctgtcaccacagcagccgccttctctcatctgtaaacaggattttacgtaaatttccatacacttggttgttgacaattaagtagattgtttttaaagatacttgaaatgatatcagaatttcctaaatatatcattaaaacaggaaacttagttacctactcactcgaatcactagagaataccaaataggaataggaagataacacactggtaagaaaaatgtccaaggccaatcacaggagtcaaagctcgtgatcaaatcagctctgcctggggaggccgtgctcatggcaccatttagtgacaagtgggtgactctggggcaagttccaggggtgtcacccccaaggcagcagctcaggtgcagccaccatggaggcagtttcactgaggggccctctgaggcccctactctgagattctaagacagggtttgaagaatgttccagcatttgaacacatgaaccctatgatgtcctgctgtgagagagaacaatgtcccaattttgcccaggtgatttgaacatctcggtatggatctgttatgggttgaattttctcctgcccaaattcttatgttgaagtccttacccctgatgggactagatttgtagacagggcctttaaggaggtgattagcgtagtgaggtcaccaggtgggccctgatgcaatctggcatcctcctaagaggacatgaggacacagacacatacagagggacgatcgtgtgaggacacagaggatggcatctgcacgccaaggagagaggcctcaggaggaaccagccctgcccacaccttgatctgggacttccagcctccagggttgtgagagagaaatgtctgttgtttaagccatgcagtctatggtgctttgttatggcagctccagcaagctaacctgggatctaaaatgatacttaaactggttcagtctgattcttaaactggttcagtggagctaggccaggctccctctgagcagatgttggtccctttgcaggcctgctgtgtgtgatgattgctaaccaggttatgacagtgatctttaagtaagtgggaatcttgtgagttttgaggttttgtttttttttttaatgaaatctacatgggatgtttcaaaaatagcagcctctgtatacatttgtcaagcaggaagctgggtctgcggggagtagggtggggctggttctcccacacgcttgccactttcaggcccttgccttgcatgggctgcggtggttctgccagtgtggattcgaaccgataggtttcgctgtaccttgatcagcatcctgctgccgagaaagccaaaaagggctggagcaaccctcccgtgtgccatgtgagcctgtttcctttctacagtcaccagttcacgcagcaagtgtcagagcattcctgtaaggcccggctctccacaggggccaggggagctttctctggcagggtcttcttcactgtgtgtaggatacggcagcctttgaggctggggaaccgaagttttccttttattctattttaattaatttaaattacaataagtattatcactaagtttatgcaaacacgtgagggaatgctgatttagagctggtggcgtaaggtcacagagctcccacgaatctcacatggaagccttgtttctccaggttttttgtagtttgtactgaatcacacaccatgctgcttccatgttttttcagggatttccaacacagattttcctgagtaccctggattaatctccttttggataggtccatgggggccctgctgctttttccccttagccctgggcgaggtcatcatagagggggagtggcaatggctcacaaggtactagtggaaccccagtaagttatctcagagcccgcttagaacacaagtgctacgtcccccaaaagctttgcaatgagtatctgatgggaacaaactcagtcaaggacaggcccaggttggggcttgcaggctgcagattcagaattgtttatgagatgggagccatactttctaacaacaagacctgaatttctcaatttaatccaagtcgtgacttaagttagcgcccttccgttcctctattacatttctgttcggcatggatcaaattgcctacaaggtggaacagatttcaactgcaatctctgaaccagaaaattcacttattctcatgaaagtttgtaatctttggagagttgcttaaacacttaaaaccatctttcctctttctatactccaaacttacctgctgcaatttcttgctaagaagcaaagtgctatttgcctattcctatctctctttaccatcagacactccttaagttaagagctagataattcgctcagcctcaggccaggccgagcctcactctagaagtcacattcctgaggtgtagggggtcaaaatgcctctcattgttcagaagcaggtgaggggccagccagggcacatcctgctctccaggcttggttcagataactgtcagcccagttttcaagagcacacaccaaaaatgcaccaaagcttacatccatacaaacacccgcacatggatgtttatggaagcttatttgtttttattcataatcacccaaactcagaatcaaccaagatgtccttcagtagatgaatggataaactgtggtgtgtccaggcagtggaatattattcaacgcaaaaagaaatgagctatcaaggcatgaaaaaatatgggggaactttaaatgcataaatgagtgaaagaagccagtctgaaaaggctacaccccgtgtgcttccaactacaggacatcctggaaaaagcagaattaccaacacagtgaaagataaggcctggtggtgtggggaaggatgaacaggtggagcacagggatctttaaggcagacaatctactctgtgtgatactgcaatgatgagttcatgccactatatattttcccaaacctatagaatgtacagcaccagtggtgagccctgatgtgagctgtggactctgggtgacaatagtgtgtcaatggaggttcatggactgtaacaaatgcatcactctggtgggggatgttgataatgggggaggctatgcatgtggggaggtgggtacatgggaaatctctgtactttctgctcagctttgctctgaatctaaaactgctctaaaaatcgtttatttaaaaatacaccaaagcaatgaggccgggcatgcatacagccaaagccaaatgatatttgtgtgagtcaggtaaatttgagatctgaaaaatgatcactccagggaggctgagctgtcatggggcacttattgagaacctactttatgcccatctggtgcttagaattacgaattagctattattattactaaacaattcaaaacaaagtcacttatctcagggcgctttcaatcttgttgccatcgaagctaacaaaagtggaaacagaacaaagctacatacggcacatttcccagaacatgccaggtggagcctggccctgttgattgtgtgtggctgtcacttgcaggagggttccatggacaagtgagtttgggaaatgctgggttgggcaaatatcaacaggcttccttactgcaagatttctcatagtcaaaacatactttaaatctccaagaggatgatacagagagccatgtttcccataattagttggccccagaaacagtttcttctgggaacattttgtaagattagtgctccttgaaacacactgagggagaggctaaactgagtggtagagattcatagactatttggattctggccccagagtataaaaggccagggggaaaggactgtgttcctgagatggtgaggtggagaaggggacgtgtttctccaccacccacagagagggctgagaagccctggcacacgggctgaatctgggaggtcagaaggtgaggtgagaggacaggaagacagcccacgagacttccaaaggaaatggtgagtcttaccatggctctctgggctgatggcagggcccggcacaaggtaggaactgagtgtgagtgcgggatgcacccaggtctgaaatgctcaggaaggaccctaggacatgagcaacctgggctggtcactcatggaacctgaatggctggaaagaaggaagggtgatcctgctaagacagggcgttgtgaagatttcctttccctccgaactaacatctcactcacttctctcagtttccatcattatcttctatggagttcttcattcccacatctgtggaccttaaaatcctaccgttgagtgcctgccttggatcagcagtcagttcgttaccttggttctcagacgatgcttgcaacaacgccatgcgattcgcccactcttgggtaggtggagacattggggctcaggtgtgggtaagtgattgtgtgactccttgttaagcggcagaaccgggactcaaattcacacagatctgattccaaaccctgtggccctaagcatagtgttattagacaataagccctctgcagggagatttccagtgctgatggcagggtctgtcatgaaggaggactctgctgaatttttctttgaaccccaggaagtgcctggcacagttctctgaagaaattagaatgcagccagtggttactaaagaaatgaataagtcaagtaaatggacagagctgtgtgctaagagttcttttgggacacagaaatgggtcagaattggaaatgtccagaaaatactcttggataattatgaaagctacatataggagctcaggtttaactccatatgaaatgaagagtcacaaaagaaaaggaggaggagcgtgttcaggcggaacctcaagcttgagagtgctatgaaatatgtttgagactcagaaaacagttcctgaaagaaatgacacattaatgaatgaaggtatagttatttggagaaaatgaacctagatataagagtaaccatatcaaaatgtgtttctttaactgcggtcttcagaacctatgaggttcattggtatattcttgggaactatgtgtgtttgagaaacatatttctggcgccaaactgacagtcacctcaaatccatcacagcacttatgatgaattcttttcaagttaaatgctgtaaagaaaatacttctcttttttactgttaattcacaatttaaaagtgttttcttactgaactacatgttggtccctcagataaggatttctcgagtctcaggtctttggggtctttgaggagtgtgacttctcaaattggatgacactgatctaactggctgtagtatccattcaagcatgagggaggtcagagcctgggaaagctcaggtccaaacagctcttgaaagaggacgttgcagggcaggctgctttgcacaaagggacctgtagacactgagaacatcagtataccaggaaccagcccaccctttcactctgccagacatgaggctgtgggttacccatctttccctgtctcctgaactcatagcaaaaacaaaaaacttcacttgtttgttaacacatatagttcaagacggaagggcctacactgaagcagaaaggattgaggtttatcagcatcttcgctttgaggcctcataatgtacttcccatggactaaagttgttcactttctttagaggatattagctaaagatgtggtaaaaccacatttttgcagaaaagtgaatattcaaaaacaaatgtatatggtgattatttaatagttttcactccacttcgcaactcaacttttggttgatgcaagagggatgcgaagggagaattgtgcttctaattccagcattgtggtggaataaaagagcacagcattgcagctgttgaatataggcagttttttctttttataggcagttttaagaagaatgcattgattctacaacgtgctattgtgaagccatccgggactgttcactcactcatttaagaaaggtgtattttccacttgaggtgtgagagaaagtgtggtgttcactcattgctcttccttctggcttttatttttctcacttttagagaaaataagagaagtatccctgaaggatgaaatatcctcgaatatgaaaaggtctgctctctgaagaccaactgtctcagtctgctttttgctgctgtaacagaataccacagacttggtaatttataaacagtagaagtccatgtggcttatgcttctggaggctgggaagtcccaggttaaggggctgcatccggcaagggcttctcgctgccttatcacatggcagaaggcaccttgtggtgagacagtgaggaagggctgatttcactctcacaacaaacccactcccatgataatggcattaatccattcagcagggcagagccttcgtgaccccatcacctcttaaggctcccgctcagcatggttgcactggggttaaatttctaacacctgaactttggggacatgttcaaaccatagccagggccctgagaaacccatttccactgacttcaaaatagttcatgaaaatggagtgctgagagagcagcagggcattcacaagaatggttttgagaggcctcactgtgccaggcatggccctcagggcaggcagctctgcacagccccccatggcagcagctggtcaggctgcccaaactcaccactttggaatcacttcagcaccacctgtcttcacttgaaatcaattgtctgcagattttaaactcgtttctatgtgcccagtaggcagagaagccttcagagaaggatcctgactcggtggtttgtgcagtgacatttggcagtgttttctcggcaagcgagtctttgaggctgccctcatgctgctcagtgggcacaccaagaacaagagctggccagggatgacggacgcatctaggccttctcggcctaagggcaagtcccattcttccttgataggtctttagatgtaccagtcagcaaatgtcatccccctctgcattcacgtcaagctgtgcagggaatgctaaacagaggcagatctaaacttaggagttaggcttcttctccatggagatgtggatctgcacagacaaagtgtccaagtgggattttcctgctatttcaaggactgctgctgcaccctgctggctcttcctgcactccctgcctccaggaatgactgtgtctctttgagttagtgaagtcatcaacttttttttttaaatctcttattattattattatactttaagttttagggtacatgtgcacattgtgcaggttagttacatatgtatacatgtgccatgctggtgcgctgcacccactaactcgtcatgtagcattaggtatatctcccagtgctatccctcccccctccccccaccccacaacagtccccagagtgtgatgttccccttcctgtgtccatgtgttctcattgttcagttcccacctatgagtgagaacatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcgttgttggacattcgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctcatcaacctttttaaaaagcatttaggagctgctggttgtaaatgatcactgagaaatagtatttccctcacttgtagccatctgcttctctttttggttctggaacattctagaaccttggaaggtggctggggctgagtctcagccagcagggttgcccagtgccccttgtcaccccccgagcaacacaagccaggctgcggttactctgggtctgtgcgtctgggatcatagtttttaaatctgccccagggtcctccagtcccagctgtggaaagtcaccctcagagggtgaggcgggcggcgcgcctctgtgtgagtggccccatccttcacagcgagtttgtgtctactgaatcgcagactctgggaggctgaagggttacaggaggtcgtgtgtctcacgtcgccacttcacggttgaggaccccgtgacccgctttgctcagtggctgcgcaagatgagtaatgacctgaaacagggaaaatgtcttggatacatcttgcgtaatgaggagaaaaatgcagccatgttgcagcctgataaaatactctgccagtgtcctgccataaaatgacaggcgaattttcagtagcagattctctaatagttctgtggtcttctaggtgctaaactgtttaagtatctacattttctaagcccgcctaatgcaaatattctcaaaaaacataaacccttcattctttctcaaataggttacattagttatacactctggaggtgacttgacctgtcattgtgaacaattattgctcttggacgacccaggacataggccagccagtacgtaccccagtgtgttggagaatcgcgctcggcttcttcctctgtgctgagtcatgaaagttgccggagcaggtgcagttacacaacctccaggtaacatcacatgatcgttcaaaaaataatcatccaagtccaggatgcagcatctgtctcagtttttggcataggatgacagtctgaaatacacttactgaatttgaataagaacgggctcaggtcagtgattatcgctagtgccttatcaacgccctgtggcttttcagcattagtccccatatcctcgtccggtgtggcactgagagcagctaactgttgccctcgttggttcccagttggcttccgtgactggtcagggtcaggtccactgccaacaggctggtgttgaatcccttggagaaacacagacattctgaccctaaattatgctttcaatgccatgtgttttcctatcacaaaaatcctcgttctcaagtttcttctttctttatttttatttcatttcattttttagcattcctccacaattcattgcccaaatctactttttactcaatttacttgctttggtcatttttcaatatagcactttaatttcttagacaaatattttcaacattctcctgttttctcaaggatgtctgttttctccccaggtatgatcctgtttaaggactggatttaggataactacttagaggttaaaagtcacaagggtgtatggatgaggctggagtgatctgggaccaaaggtatgggtgataaagcagagtatctaagcagctcctgggattggtgtctttaaaaaagtaataatgcatttgcttattttagagacagggtctcactatgttgcccaggctagacttgaactcctgggctcaagggatcctcccacctcagcctcctaagtagctgaaactgcaggcatgagccaccacactcaactcactatctttttttttggagacggagtctcgctttgtcccccaggctggagtgcagtgctgtgatctcagctcactgcaatctccacctcccgggttctagctattctcctgcctcagccacctgagtaggtgggattacaggcgtgcgccaccatgcccgtctaatttttgtattttcagtagagacgcggtttcgccatcttggccaggctggtcttggaactcctgacctcaagtgatctgcccgcctcggcctcccaaagtgctgggattacaggcatgagccactgtgccctgcctagctcactatctttcaatcagtagagattctttagttattttttaactccatggatcccaagctttgatttttgttttccaaacaaattgcatttataaataataatttttatttataatcaacagacatctaggcttgctgtcaaggcttctgatcaacatgagatgaccgccgtgtggtaaactgatgaaccctgaccctgatcaacatgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatcaacgtgagatgaccgccgtgtggtaaactgatgaaccccgaccctgatgaacatgagatgaccgccgtgtggtaaactgatgaaccccgaccctgatcaacatgagatgaccgccgtgtggtaaactgatgaaccccgaccctgatcaacatgagatgactgccgtgtggtaaactgatgaaccctgacccattaggctttggctacagaatgtggaaataagttgtgttactacatgtgtgtaatcctagggtgcaggacaccggccgggaggttccatagagtgatgggttctgcaggtaactcatcctctagtcctctgtaagctcctagaaggaagaaattatgtcctttagactaataaaattcctccaaaccaaatacagcacctactgtgaagacacaaagatacttttagaatagtaaaaactttatccattgagaaattccttaatgaaacagtatccaagaagtcatttgccagcagatttcttagaggtgcgataaagaagaggacattgccagtcgtcacagcagctgcaatagctcctctctattgttaaacagtgggatatcttgtgcaggttttcagttgacaatcaattttaaagattagtttcggtccccatcaatcaattatttattaacccatcaataaaaatttaaatgctctgtgaggtacaatagctattaaaagagacagaggcactttctgtgtccagaggggcttttagtctgctctggaaagcaagatgcgtgcagatgagtgacgcagtgcatcgtgtggatgcaaagggagggactcacatgggaaccagaggagctacgaagggaggcagtggggactggtgggtcgagacctggaaataacacatgaataggcaacaaaggtttcctttcctcttccatgcacttcagtccttgaaaaacgtcttaccacggaattccacagcgtaccaagcgattccacagcttgatggcacactctcctttctcagcattcttgaaaatggcgtgtgagccaagccatcttactgagaaattaccttaaaccatttgatgaaccaaaaatattttgtaatacccatctccgacattaggtaggcaaatcacacagaaacaccgaggtcttctgagtcatatttatctgaaaaatcacagcttgggtgcatgtgaagccagaggagcactcctggggcctgcggtgccatcactcagctcccctgggcttcacatggccatggagcacccagcaagtgtaggctctgagccttcagggaggggcggcatcagccagcaccatcgtctcctgggtcttgtgcctcttccttggttgcggtgttgtcagggccagaattgggcaattccgggtgacatccaggtgtggctgctgacacggagcacaggtgaggttcactgaggtaagtgggccatggccttgggcttctagttcagagcacaccatccactcagcatgtgaacccagctccaaagcgtatgtgtgcatgtgtgtacctgtgcacattgcgcatgtctctgtgtatgcatgtgctttgatgcatgttgatgtacgggtgtatctgtgtattgtgtatgcacacacgagcatatgtgtacatgaatttgtattgcacatgtgtttaatgcgaacacgtgtcatgtgtatgtgttcacatgcatgtgtgtctgtgtactgtgtgcaacagtgtgtgcaagtgtgtatatgtgggtttatgtttgtacagtgtgtgtagtgtgtgtacacatatacacctgtgtgcatgtgtacatggtatttaagcatgtttgcacgtgtgtttgtgcttgcatgtgctgcgtgtttgtgttggtgggatgtggggaggctgctgtggagacaaaagctggagagaacttggtagagtaacccaggtcaggaaatggcacctgcaaaggaaggctggagtgcctgggattcacgttgaaatggccaatccgtcagctgggctggacacagccatcacgctgggcagctgtgaggttaaaacagaaagtctgggctgtggggaggctgagaattgagatgcatgtatgagatgagtcacgagggccaagtggtgtgtgtgagaaagcaggcacagcaccactaaacactaaggagatttcaggggagttacgggtggagggaggacatcagatctaccctggaagttaaacgtgtttcgagtgcattaaatactatgggccacagacgccttgtctccatatctactcttttataaatgaagtaaagttcttgggaaatacttttctcactctaaagctcacaatctatcttgcaaaaaatattttaaattccatctcaaataagccagggtgaaaagggagcctgtgcaccagacactgccagccttgcctggctctcgccttcttgctcttccttccccacctgctggggattttcttaacgatggagatgggtttgggtttgtcctgctgtgctctgctccccattcccggatccaaggtcctgcctctgtcctgtcccctgagccacctcagggatgcagggtcccccacctggtcaagtgcccagtgctgtgttgtcatttgcaagttcttcctgtgactgaactccaaatggcactgggactgctgactccacccactggacaacccgtgttcttgcttttggggtttctgaaacagccccaagactctgggcatcttgattttgctcccattgcttctcaggacaccctgctcctgtggtttgcagccccggccttctcttcgaggacgcctctgctcttctgcctcacactcggattggaccttcttcagcacagccagtggccgaggcttcctccctggggctcagtggagcaggacagatgctgcatccaaactcttccattgggttccagtctgttccagtcatgcccttgagcctctaaagctcctaggtgagagacgtagcagctgacagcacttcccacttgatttgggtggactccagcctccccagcaacaataagagatcaaaagcatcgttgaggaagcagcttgctgaaacgctgagtgcccgccactctcaggtcaggtgggaccggcaggccagcatgagttcctgaacacttggttctcaatactggccacagccacactgtaaggggaaacaagagggcactgtatgcaaacatctcttgaactctggagtctgctcaccttcctgcctcaagcccctctcccacgtggtccagtcaccattctccacagagactaccctaaaacccagcgactctcgtgtgcctgcagaatggcacagcccgttctcatagcagcactcctgtttaatcagagggatgttaacgaccaagtcatatttgctcgatttgtgttcaacatatttcatttgtaccgataaaacttaaaaatatccccacacatgcattgcctattaaagagtatcttccaggtacacctcccttacacatcagttaacttgataatttcttcccattcttgtgcaataaatttccttcctgatcagctctgtccagcagcaacaataatccacgtagagacatgcaaactaaaagtccgttagtggaggcacgaagctgatgaggcttggaaaaaaatgaccgatttgattaaaattaggacccatgggagtggagctctgcctattttagaggcaaagtaaatgcctgggagtccaatcaccgacattctgtttgaggtttctaatcacaaggaagatggagaaaatgcagaacaagtggtcaagaacagggagataataaatagaatatttatgggctgaggaaaacaattaccaggggaaagcccaagaagcaaagatgaacagagaacgtgctgactgcgctcgtttggaaaggcctcatggccaaaggaggagaggcattatgaggagcagtgaccgagtgggcaggacccccggggatcaggaaaggtgcacggggggaaatgagaggcctgagcggcttcccagcgaaggtttttgaagcacggtttgattttctctctccccctcaccatccccaaattttagttgtgactatctccaggtacatggcttgcgacaggcggtgtataaaaactaatgtcagtttaattttaaaaccttagccattttctggaacttaaatatcaaagagaaaatgtccacatatgatgttaattgaggtttgtctcactggtgatttgtgctgattcaattcctgtttctttttttttttcttaaggggtcagttttagaattgggagataggtgtataacatatgactatacagcgcaggttggttttttaacatagaaatatctgcctttaaatgagaactgaaaacggagcttcttggaggccacctgctggtggcagtgatctgaccgctgtttaagctttctttgaactcctttttttaaaacagcctccataatcaatggtgtacgatctactctcgtggtaaaacttactcagtgaagagtgtgttttattttctgaggagctgaactgttccaacctgagtattctgaataaggacagtggtcgagcatgagtgatgccatctgggcttagaaataagtgggcctaaaatctgattgttttcatacattgttcagatattgacgcaaatagcaatttattttgtaaaaaatgattggtatccggaacttgcaacagctgtgtgtggcttgaagggagatgaagtggtgaaggcctggtttccaccgaagctctcacagcccagcctttcactgtgtggccgggggaagggtgctccgggtgggggacgggaatggtgggactggggatgccacgggacaaggctgctggcctggaaggtagtcacgtggagaaccgcaggagatgagattggaaagtagtaataagccatgtggataagaacagaggagcgggttttaagggggacgtcctgaaatgctgctcatgtcgtttcagttccatagaccacaggaaatgcaggtgagagggcagcccggtgggaaggaaggaagagggtggtggtgagccaggtgagtgtggagccgcccagggcaccgtgctgtgcgatagctcaggcatcgggtgcttctgccaaacccttcagcagctggtttggggccaaacgtccttcctgtgtgagagaaggcagagcctaggcagcattccaaaccccatccagatgggaggctgagtgcagagcaaacggagcccagcactccagagccgtgtcccttcactgccatgatcacatcacaaacagcgaggcttggagaggacttaagagctccttcaatgccatcttccatccactgcgtgagccagaatagaaaaaaaggaataagaagaggtcggttaagctctctattaagttgagaaaatgggaacttcaggtgatcatgtgagatattcaagttaaaaaaattatttaaaaagcacattcttattattaaaattttagaaagtacagagaaggaaattttaataacctacacctagaacactaagatactggtaacgtagaaaaatgtgtagttaatgccttgatggattcttttctatttttttctctagcaatatttatgtctatccacagaaagcgtacactcatgtatttgcatggctaatatattttatgtaaagttctatatatttctcaacatttcacttaatatttctttataaacatttttccagtgaataaaaatttttccaaacagtaattttaatgactatataacatttcattgcatttatatatcatttgttatttaactacttcatcattttggattcacatattttcaataatttccattataataataatgtcatgaatacctttgtacaagaatatttatatttctaattatttccttagtctagtatcctaaaaactaaaattcctacatcgaaaggtcaatgtgtatcacggctcttgattgacatattgatttccatgaagctttcatcaattaacccatgaacagtgtctgcaagtgctccttgccccataccttccacaatgtggactcttattggaagtatctaaatttcacttcagaattgcagccctgagttattaaacacacctctactacacctatgaaattgtctacaaattgtcttagtttcttttcagctttgatttctagaattgcatgacattgaagacaaatgatataatacccataaagaaggttttatgacctctttcattatctccaacaatcagaaaggcaaattcacagtagagggctgagaaatcttatctgaaaattaactaaaatgctgcttttgtcaacagaattacttgggcttcatttcattccacaatttcctgtgtactgtttattacaagaagaaaaaatttcctgccatacaaaatgctccatgcaggtagaaccaggaatctaaagaaacctgaggaaggtgctagaatcatcactaccatctttttttttttttttttttttttttttttttttatggagacagggtcttgctcttcacccaggctgcagtgcagtggtacaatcttggctcactacaacctccacctccaggggctcaagcgatcctcccacctcagcttcctgagtagctgggaccacaggcaaacgccactgtgcccagctaatttttaaacctttttgtagcaacaaggtctcactatgttgcccaggctggtcttggactcctgggctcaaacaatcgtcccgccttggcctcccaaaatgctggcattccaggcaggagccactgtacctggccccaccttctttttgctgtaggctgagcacaggagaagttgaatttatcagggaacctaaagacatgcccttctttgaaggcagaagtcctgtccacgtcaaatgccctccctccatccctcccagctccctagtcatccttcctattctaggctccaggagcgagacctcctccatgtgcctgctaacgtcagtgccacgggccctctttggttctcctgcccaccttctctgactctgcccaacacccacgggccagaggcccttttccttcttggcacttctcggtgttgtagcaggatgagccacggacaaaacccctcagacgccgggttaaggaatgatttggttttattcggccaggagcttcagcggactcaagtctcaagaaccgaactctctgaagacagagttcctggcccttttaagggtttacaacctttaggttccacgtgaaagggtcgtgatagattgagagcacatgcgtttagagtggggtgggggggttaatcttttaacctcaggcctgatcatcaggggcaccagctggtcttgccactgacttcattcctgttgtttttcaacttttacttcctcctcctcttcagacaggagacagtaagagaaatggcctctctcctcagcggcacaatggactttagacatcgcgcctgttttgtactctccaagccggacttctctactcgctggcctggcgctgatgcccagaggccccctgtgcttgtggtcgtggccttagacagttccctgccctttgtaagtactaacttaactcttgaatgtggacgttttaagctgacttttcttctcagccctctgtaagagtttcgaatctccccatagcaatcaatgtaattgttttcacccagggtgttggtcctggctgcttcgattttaaagtaatctctcattttgctgaggagaatttattagagtaaatgactgttttcacctgtcatgtcacattaaaatgtggagagaactggttgtaggggcagtcaaactggctgtgagacccttcgagcagccatgcatctcctggacagctcgaacactgatcagggaggagatactgaaaataagaaataagaattgcctttatatgtgtgtatgagtatagacacatacatcatgtacatgtatgtgtgtatgtgcatatgtgtgcatgtgaagatggatagatgatagatacataggtgatttatgtataggtagatgacagatattggtaattaattgatagtagataggttgatagtatataggtgattgatagatggatgatagatcattgatagatgataggtagatagtagatagattataggtagataaatagatggatgatggatggatgatagatacttgattgatagatgataggtagatagtagatagatgatagataatgatagatgatagctagatagtagatagatgtgataggtagatggtagatagagatgatgatagatggatgatagatggatggatggatgataggtgattgatagatggtagataggtggatggtagagatggtagataaatagatggatgatggatggatgatagagagctgatagtagataaggtagatagtagatagatgatagatggatggatgatagatgattgatagagagatagagagagaaggatgatagactgagcatcataacttcactgaatgctaccagttggattcaaaagtcagcaaactgaaacgtcgaatttcagccagctatcagaaatattgtaatctgacaacaaaagataaacaagggaacatggaagtggcagctattccagaagctgcacctctcagcatgggcacagaaccacagaagtggagccagagtcctctccacatctcctctgggtcggcgttatcattgtcacaatgggtggaggctggaccttgtgaaggcaaaggcatacggtgctttcttgcttctgctgtttggtgactcccttactcattccctctgcggtggctgaggggctgatgatcagttcctctgcccagaatgccctgaccatgctgggtgtctgtcctccctagacctgggtctgcaggatgacaaggaccctgcagcagaaactcctctgtctcttccctgagcaccgtcttccatgctgcctgactatggtgctggttcccctctgatatggagattggtggagaatgaccaggatattttatgtggcaatgggggttgaagcccacttcaaaatggcttaggataagtgaccaaaagtcccagtgtgagcatcaggcatggctggatccaggtgctcagcaccatctggaaatttgtctccatctttgactctgctgtctctgtgtgggcttcatttctaagatggttttctctgcacagctgtaacaaagctcagggcttgcatgatgctttgcagccagtacatcagagaggactttccctcaagacttctggcaaaatttggggtaacatgctgttcttgctggggtcaggagccatcttgcaccaatctcagaggccaggggatggagaactctcctagggtagtcccaggttctgtgcctccccggaaaacacaaggtcggagcctccccatccaaattaatgctcagactgtcagggaggaatgacttccaaagaaaaaccaagggcccttatgaagaaaaggaaggggtgcacctacagttgccagttctgtttggaagtgagggaggggagggcagattcccttggcttgttccctaggacagctgtacttaggttttactacacagtccactgaaaatgcttctctcattagtgttgtgcctctctcatgcctctttccttggataaagagcaagcacattacgagccacacttggtgctggtgctgtggcatgcaacactacctaatgcgagagaaagatgtgagcaaatatccggaatatacaaatataatacaaaaatacaaatataatcagttatacagcaaacagctgtgggaacagcagctctgcttgcagggttgggtagtggaaggtttcagagttgatagcatttggattgggctttaaggtatgactaggagcttaccagatagagaagtggtgtttggacgttgtatgagaaggaaacacaatctgagaaggtgtaccatcctaagtgaatctgtcacagaagcgagaagatgctgtgtaaaccggaataatgcttgtgtgcatggatcttgatcccttcgtgagcaataaatgattttgtgaataaattgaagaatgctgaattagatcatagggtgtgtttgccggggtggggagagaggagagcgtcgaaactggggaagtggggaaccagagatggcaaagcctgggacttccagcttcacccacaggacgcgaggagcctcatcagtatcacccgcacaagcaagctcccatgaaggcagcggtgtccaggctctgtcgcgtcctttctttgcagcctgggccttggtttcttgcaggtgctgtgcccaaaggttagattgacagatgtggccgtgtctatcagggaacatggactgaggccagtgctttcaaccatactcacttttcactgtgttcagagggggtgggaaatctcccctaaggaggagatacgacgtgtgcagattgagagctgggaccacacggattcctccaggggcaagggctggtgaccttgcagtaacttccagaggcctcagcaccctcctctgcacaatggtggtgggctagccagggcaccacagaaagggccagcaaggcacaccctcgtctattgcccaggcacacatgggcatccatgacagccatgcatgtgttagagcccgaccagagctgcagcctcctttggctgaggttggaaaagcggagatgtgttcacagttggagaattggtatgccttacccaagtgacatccctgtccttggaaacttattctggggtcacagaattaattccccaggattgggtgtcacgaggaggtggttcctgtggctgaaaaccaccaacacctcctttcctggaacatttccctcctggcatagggcagttctcatgccagaacatcttgggccacaaagaacctttaggactgagcatgtctttctgtttgctttaagcttttaagaaaaagaatatgcaaaggctgattgaggcaaaaataacaggctatttctgacgttcattcagaatgccacctaactaggccagtttttggactgtatgccagcctctttctgcgggatgtaatctcaatgtctttaagttcagtcagtcctataaattgctatccctattcatgcagtgtgttttcccctgtgtgaggcatttgtgagttccattagcactgataggacttttaaatgcagaagcagcagtgaagggaatggcatttcccagctgtagggcacgggccttctttgagataaaaacccaccctggcatcgatgacatgggaactattctgtgtcttttcacccgagagctcttcaatcaactgatgatcgcacctgcataactgctaccagacctgctaagggggagcctggcccagccatctcttctttgtggtcacaagcatgaacggccctgggacatcctctttcctcactgtcccctcacagcatttcctgaccactgtggccttggtcccaccacccacctgtgcagctcatctggccatgaacctctccagctcacaactctgttttctccctgttgtttctatgaaaccaggttccagccccgccacacagtctgcacggcctccaccgcagctctggtgagcctcttggccagctcctggtgacagcgtgcacctccctgctctgagaaggtctccctctcctctctgcccaccctgtacagagacatctttcaagcccatcccagaggagagtggcctctctcctcaaccccaagaggacggcctctcatgtggctgtcacccatctgacccctatcacagacctgagggtaagtggtgctcacgggcccacatctgtcagcctgcgcctggttggagacgcctccctctcatttgtccttgcttgctgcgtgactttggcaagtgcttgcctctttgagaccctcagttttcacacctgagaaatagaaaggtggtgcctgccccagctgccacgcagaagagtttaggtggcatgtgagaaaatgccttatgaactacgatgtgagcaactgcagcatgctgtgaacaccgctttcatgagctcctcaggggcagggtaacacccaagcattcttacacctcccaccgggcttgtcacgaccgtatgcaaatgaaggccatcaagcgtgtttgatcagtgatgtatttctttatttttagttgtagaatatgacaactctatttttagcagctatagcggccaaaactttgttaccactcagcagttgtgtgttcttcaagagtaggttttgtgctttcaaaatatctgaatcctctaccatttacaggtgttctgtgcatacttggtgtatgagttcctcaggaaggaagaaaaatgtgccctttttatcttttaaaaagatggcttggcttggtactcctttgcctgcattccttctctgtatttagaaacgaacctacacaagtgaaggcaaaggaagcctcttgaaagataaggcaggaaaaatgaggatagaaaacaaaacccttctagagagtttacgtggaggctaccacgggcatcgctgctctgcagtctgtcaaccagaggcccctggtgctgcagcacggccttggcagcttcaccaacaggaatgtgttctcctagggtactggagggtggcagtcccagagcaaggtgtggcagggctgctcctcctgaggcctctccctggcttgcagacgacatcttctcccatgttctcatgtgggcctccctctgcacacgtatatctgacatcctcccatgtcctcacacgttcctccctttgcactcgaatcccggacatcctcctatgtctcacgtggtcctctctctgcactcgaatcccagacatcctcctatgtcctcacatggtcctccccctgcactcacatccctgacgtcctcccgtgccctcacgtggtcctccctctgcactcacatccctgacgtcctcccgtgccctcacgtggtcctccccctgcactcacatccctgacgtcctcccgagccctcacgtggtcctccctctgcactcacatccctgacgtcctcccgtgccctcacgtggtcctccccctgcactcacatccctgacgtcctcccgagccctcacgtggtcctccccctgcactcacatccctgacgtcctcccgagccctcacgtggtcctccccctgcactcacatccctgacgtcctcccgagccctcacgtggtcctccctctgcactcacatccctgacgtcctcccgagccctcacgtggtcctccccctgcactcacatccctgacatcctcccgtgctctcacgtggtcctccccctgcactcacatccctgacgtcctcccgtgccctcacatggtcctccccctgcacttgcatccatgacgtcctcccatgccctcacgtggtcctccccctgcactcacatccctgacgtcctcccgtgctctcacgtggtcttccccctgcacctgcatccatgacgtcctcccaacagtgagcacgatatgttattggggtgggtgtgggataaataaggtataccaggtgagaataataagaaactcaactttaaaagacggtgctgatttggactgtggagagattcaactgccctgcttagcatttgagattgtgatggatgaactaattaagagcccaaaatgaaagcttgggataaatatctgagggtgtctaatatcccaatttttcatcctagagtgggcagagtccttgaccgcattctagggagacttccaaaagaaaaaagacctgcatttcttcaacaacccacactgagagactttcctgcacttctgacctgtggctaacactcctcaccgttcattctgtcatcagtgttttggggaagcacctttaactctctgtgatttacaggttattaagtggcccttacaattccctccagagatggaaaagacatgatgatggtgtctgagctcacagcagcaagcaggcgtgtgtgctcagcagccacgtggctcatctgctgggagcttgctaaatacgatgttctacaacattgcctaacacaaggggagacgctcctgactcagagtgtttaattgctcacctacttctttttctgccctcttgggcttctgaaatgaaaagaaccctggggtgatacagtgagtcaaaggggtgccagctgcatcacagcaaaatagattcctaaaaaatccctggcctaagatgatacccttggctggataagtttgaatgtgctcatagtggacatggtagaatgaaggtggttgaaatgttcacattaaagaacttccacccagattgcaagaaaagagagaagaatggagacggcagcacgagtccctacaataaaagcagatgttttgagatcagttatatttcttctgacaaaaattaaagacagaaaccaaagtttagcctgaggctacaattaattgggcaataagccagaggcacatatggcatagacagatttaaacatttctccctgatattaatacaaatactaaaattacaaatactttgattccaaataaaacaaatatttaaaaaatttaatgaataaacactggggtctacagtagtatttgaaggacagctcacaaacaggtttggtttttgaaggttagaactggtggtctagagaattcatttcattccagagagagaaagagaggaatttcttgggttccttcaggaatgcgtctagctttgcctcatctttgtttgaactatggatacggcagaagaaaacatgaggatttcacagatttaaggtgcaaaaagtcactgggttctctaagaagtctgggattcttctgctggaaaaataagtttgttgagaaaaaatgagttggaggaggctgttattgaagtgaagcagaattgtttttactaatctgcttattacccactctgtagtatggaaacaaattattcatgcacaaggtcctcttgctgttcctagaatgcagtggaaagagaacagattagttttcctccctcagaacacaatccctagagacaacctacctcagatgagatattgcctaattattttcaaaagacagtgaaacatcatggatgtaaatgtttgctgcaaaataaatacatgctagaaacagaagcatctgggtcacagctatattagagctgcctgtgttcccctgtcactgagattaaaacaaaaatgtccaatacaatcattcacagcatgggagaggggaagatgaaggatggaaaggccaggcataaaaggatttcagaatttcggtccataaggaagtggctttgtgcattgtctgttactatgtgcaaggtgaagtttgaagaatgaaaacgtgcagtaacaaaggctgctttgtccatctcacctccccagataccaagtttcagacatgttgcattttaattgaaaggttgatataattttttaaaagaacacttgtggtgtttgaagtgacaaaggctgctgtgacaaaaaagcagggaaagggaatttaaaaaaaaaaaagcaaacaacaacaacaaaaaccccacagaaaagcaaacaacaaacaaacaaaaaacagaggaagaagtcaaacaccctgggctgtggctacttccaggaaggggctacaagaggcagttggaaattctatttgttttgcaactgtgggttttccggcctgcttcctttctaaagtatattactctgcttttggttcatgaagttatccatttctgttttctggaacagctatgtatttatctatcatctatctatctacctgcctatcatctatctatctatttactatctatcttttctacctttcgccatcaagagcttcaacacctggacacattccgcaaagtttcctaagaaagcaagaaaaataattaaaaaaaaaaatccggagtccggggggctaatggggctttactgggactctctggcttaatcctccaaacaaccctgccatagcagcccatcagtcctctgagacaggtgaggaaactgaggtcgcaggagggcacccagaaggtccaggcagagcccccaggcccccacacctccccccgtggcagctccaaccccagctttttcactagtaaggcactcgcgctgctgggccacgcccactcccccacgcggggaaggagcttcgcgctgccgcctggctggggactgggcacgccctcccgcggctccggagccggctgccaccagggggcgcgcccgcggtgtccgggagcctggcggcgcctgtgcagcggccagtgcacctgctcctgccctcgcctcggtctctgccaggaccccgacgcccagccggaccctgccctccagcggggccgcggctccacggcccgcaacagcagccccacccggcattcggcgcgctccgcggggcagaggtcgcggtgtcctcaggctgtggcgccggcctacaacccccacgccgggcccgggccccgtgattatatttgggccccgtgtgattatatttgacaggtcttagttgacgcgctgttcagcgctttgagttcggctgagttttgggttggagaattttcttccacaggggattgtcttggatttttctatttctccctcagtatccacctggaaaacatttcaattaatttatattcacttaaacatttccgtgcaaaaactgtgtacaaaagccccaaagtataatttgcgcagttgagcacatgttctgttgtccagcatttatggtggtttgtagtggaaaagatttttagaatatgtggatttttgggatattcccagaagcccagatggccacactttaactttggaggaattaattctcagaatattgcacacaatcaatcgcctttggaaggagcatatattcccagcaaaagctctggttttttgaagtctgtgttgtgtgttatttccaggagaatatgcaatgatgacaatgttattaactgattcgaatatgaaatgctgttatgccaaacaatgaatctttgtgttacacattatgcctaactataaatcttcgtgttatacattttaatgtcattggagagtactcctgtcttcttggcattattgataattcgattctaattgctaataagtcagaaaaattaggaacaccaaatttcagtcgtctcaaaagcactcctcttattaaatttggatttttacctttatcacatcaaaagaaatattgttagaaaggtgtttaatgttttccagatggttagattactgttattagttctgatttcattgttaatttttaaaaccatagagttggaagtatcaatatgcctttcaatataccttagtggaatttattaaattttcatggatgtcctttaggaggttcaggaagttatttctattgctagatttctggaagatttatcaggaatgagtgtcagacattgtcagacgtccattgaaatcatcatggtcttttcctttattctattaatatggtgtattacactgatttttagatttgtattggtaggataattccacttggttatattgtctaacttttttctaattttctttaatttttattagagatgaggcctcactctgtcacccaggttggggtggagtggcacagtcacagctcactataacctcaaactcctgggctcaagtgatcctgccacctcagcctcctaagtagctggcactacaggtgtgcaccaccatgccaggcttatctaacatttttatgtgttgcttcttccagtttactagagtttttggagatttctgtcttcattcatgagggataatagtctgcacatttattttcttgtgatgcttttgtctgatttgttatctgggtaatactggcctcaaaaatgaattgaggttttcctgcttctctgctttgcaagtgtttgtgaaggattggttattcattaagtgtttaatagaattcactagtgaagctttgtgagcctgggctagactgatgaagagttttcattagtctaatctgtttacttgctgtatgagtatgcatatattctctttcttcttggtttacttttacaatttctgtatagcagggaatttgtttctaatttgtagtatttcatgcttctaggttttcatggcagttgagatgtaagaataaaaataatgttgggagaaagaagttgtggacaatctgtgaatatcccaacatctgttgtaggaaggttaagattttttttttttttttgctgtacttaactgaatactcatatttatagtgtgagacaaatgtaatgttgtgtataaatagaactaggaaaatgtcttagtatttaatcgagatggaagtctgggcctacctcctctcttttattaatatgtagacaggacaccaacacaaatttgaatgaggacaaataaaatgttagcaaatgaagaatagtatgaattggttaaaatgtgatgaaatagagtggtgaatatttacatagaatccatgatgtgttaggtgctatttcaagctatttgcacatatagttttaataccagtgacattaagatgtataacacaaagattcatataaataaaaattacaacattgaaaataatattagatgacactaaaactatcgtagaaatacacatttatataaaacaaagtaacatcaagtattaaataaattttagacactttgattactaatcagatgaataagtgattagccttttaatccagtaaacaaggcatacatattattttcaaattccagagacaaatattttaaatattgaagtctaagacctaaaaatgtgtcctgtaactctgggggagggggtttcatttgttccacctgcagtgaggtctgttagcccgtctcaggtttgactcctgacttaattcctaacaggggaagctgctgtcctgtaactctgggggagggggtttcatttgctccacctgcagcgaggttagcccgtctcaggtttgactcctgacttaattcctaacaggggaagctgctgtcctgtgactctggagaagggggtttcatttgctccacctgcagtgaggtctgttagcccatctcaggtttgactcctgacttaattcctaacaggggaagctgctgtcctgtaactctgggggagggggtttcatttgctccacctgcagcgaggttagcccatctcaggtttgactcctgacttaattcctaacaggggaagctgctgtcctgtgactctggagaagggggtttcatttgctccacctgcagcgaggtctgttagcccatctcaggtttgactcctgacttaattcctaacaggggaagctgctgtcctgtaactctgggggagggggtttcatttgctccacctgcagcgaggttagcccgtctcaggtttgactcctgacttaatttctaacaggggaagctgctgtcctgtaactccgggggagggggtttcatttgctccacctgcagggcgaatggtgctctcacctcacacgtgacacttggtcctttttgcattatggtggtgaccactgatgaccgtatacctggccgtggagtgactggctgtactgtcttacaggtcagtgtggggccagaaaaaactgggccaagggacactacacagaaggcaccgagctgatggagtcagtgatgtacgttgtcagaaaggaggctgagagctgtaactgcctgcagggtttccagctgacccactccctgggttgggggactgggtctgggatgggtacccttctcattagtaagatccgggaggagtacccagacaggatcataaacacattcagcgtcctgccctcgcccaaggtgtcggacaccgtggtggagccctacaacgccaccctctcagtccaccagctcatagaaaatgtggatgagaccttctgcatagataacgaagcgctatatgacatatgttccaggaccctaaaactgcccacacccacctatggtgacctgaaccacctggtgtctgctaccatgagtggggtcaccacgtgcctgcgcttcccgggccagctgaacgctgacctgcggaagctggccgtgaacatggtcccgtttccccggctgcatttcttcatgcccggctttgccccactgaccagccagggcagccagcagtaccgggccttgactgtggctgagctcacccagcagatgtttgatgctaagaacatgatggctgcccgtgacccccgtcacggccgctacctaacggcggctgccattttccagggtcgcatgcccatgagggaggtggatgaacaaatgttcaacattcaaaataagaacagcagctactttgctgactggctccccaacaacttaaaaactgccgtctgtgacatcccaccccgggagctaaaaatgtcagtcaccttcattgggaataatacggccatccaggaactcttcaagcgtgtctcagagcagtttacagcaatgttcaggcgcaaggccttcctccattggtacacgggcgagggcatggaagagatggaattcaccgaggccgagagcaacatgaacgacctggtgtctgaatatcagcaatatcaggatgccacggctgaggaggaggagtttgaggagtatgctgaggaggaggtggcctagaattttccttttctaggtaaaggggggaagcagcgtggattcttaactgttctgacagccatgtgtctctaagcacttattcatttgtgtcttcacctctcctcctgctgcattttaaagcacttttatagtatgcagttttgcctaatattttcacagcatctggtttcacctccaacttctttccatgggccctccggctactgctgccagatgtgcatagttgtcctgcaaggctgaagctgtctgggtttatcacatgcccaggaacaagcattccagtggctctaggaggggtcggcatgggttgtggacatggcaggcaggtgccacatgaacttggggatgccctgggccttgggcagcgacgtggtggaaaacctgttcctgaaggcaagccttggcttatcccatgtgccaaacttctaggggaccagctggccctctgtttctggaattttaaaaggggtcagtgaccctggtggacaatgtccccaaagtctcatctcagggtaggaatgtggtcagacagctggctctgaaccagcaaggaagggtgggcaagtaggaccccaggcactccatcaccacgatggcctgggtgtgtttgtgtggcctcattctcttcaccaggtgggcatggggtatctggcagggactaggcaggaatcaagcccggtgtatactcacatgcactgaaccctatgtagaagggattaggtcctgggggccatagatggcggttgctgggcctgtgtgctcggggcagtctctccaaaggcacagatggggtttctgaacaggacctggggagacaggcaggtgctcacaagtgctgcttcccccaactggcaaccagtgaggaaaaacgcccgagtggaggtctgacctgccccactctggagggctgatgctctctggaaaggtgggtgatgtgcagtgtctgctgtctccctgtcccccactccaaaacttcagggaaaaaataatccaagattgtcaggatgagcctggtgagggtggcacctttggggataggcccttcagcctggcagagtctcctccccaggcttcttggggagcctggactgcaaagcctgctttggggaagctgtcaaatgagagctgtgtgtgtgagctgggtgctgggcaacacgcacggacagtgttcttctccctggctcttgtagaacttgtccatggcctgtgtgttggtctcttggtaattcccaccctacccccatcacacagataagatgaagccagcatagcccaggggtggggagatgaacaggcgctaccccaggtcccctaggcatgcccatctgcctctgacatgtccgggaaagcaggtgaggccccttcttgttctctgaatgttgtcaatggtctattgcagccaaatggggacaggcaggcaggagagtgtctcatctcgaaagaagtggttcctggaagcagctgggaggtgggagaggttccccaaactcccccatactcccccatactcccccacattccctcacactcccccacgctcccccacgctcgcccacgctcgcccacgctcctcccccacactctcccacactcccccacactcccccacactcccccacgctcctcccccacactctcccacactcccccacactcccccacactcccccatactcccccatactcccccatactcccccacactcccccacactcccccacactcccccatactcgcccacactcccccacaccccacactcgcccacactcgcccacactcccccacactcgcccatactcgcccacactcccccacaccccacactcgcccacactcgcccacactcgcccacactcgcccacactcccccacactcgcccacactcccccacactcgcccacactcgcccacactcccccacactccctcacagtcgcccacactcccccacactcccccacactcccccacactcgcccacactcccccacgctcccccatactcgcccacgctcccccatactcgcccacgctcccccacgctcccccatactcccccacactcccccatactcccccaaactgttctcaggttaggaaaaggggcctctgtgacagccccactcagtggctctcactgtctgaggggtgtccttgcccaacccaggtgcgcacccatctgagatggccttgcatggacctggttgggaaggttcagctacagcaaccactggaacctgcccacacctagtgtctccactcacacgtggggctagatgttcctccctcccgtagtggcacagccagtggcagagggggcaagtcaccgctgcagttcccacttgagtctgaggggggatcaggcttagtgcccatgtatttcccaattacctggttccatctgggggcttcatggacaggagtggtgcttttccaggcctcttttccatatgccagctacaggcccaggtttccaagtttctggagcccctcttccagcctggcaagcatggcgtgttgtaggggaaggacatgaagcctacaggcagcagaacctgtctgggtatgttctctacccctggaggcccctggttgtttacctcttgggtgagagtcggcttaggatctcaacattcttgtaggacttcagaactgtgccgacaggggcccaggaaggagcagaggctggggctggcagctaaccagtgtagtgggagttgtagggctcagtttggtcttgcagggaattcagggaggcttggatttgctgaagctctagatgagcttgggcttggatatggaaacggcatggagccagggcccttctgcacactggggtctgagtagttgcactctggtgcatccataggtgttccccacctggagcacagctgtggatagaagccgggagagctgtggagggaagaggaggaggagggagtctcggggcagccccagctgccaggcagggcctctgcaagtgagatgcagatccagcctgttggccacttagcacttgcttggccgcctgcagatcacctgacctctgctcacctgtaaatgggggttgcagcagcacttaccttctgggactcctgcagcttgaaggggcagcacacaccacatgctgagaaggcgcctaactcaggcaagcttctccaacagcaccacatcagattaacatccaacctgtacaggacatcaaatctccccatccctcattccaatggaagaaaagggagtctctgtcctaggggagcaagcacaggcctatctatgcagttggcagttggcacttgacccaggttggggaaaggcccttggatacatgctggtttcaccaaccatctgtgggttgggtttggcctggacccatgtaccccaggaggccagcagccccctgcatgggacaggactgggaggtgtgtgggagggctgagctttgagggaagccattatttggcctcatgggaagtggtgcaggtggttgttggtggctcagttttgcagggcctgggtgatcacccaaggagtgaaaattgcctttttatgagaaattgccaaaactgatgcaagctcatccgttgaaaaggtgagtaatgctggcagttggcttcacctgccccttccccacaagtaactggtgttcagaggtggatttggttccttcccagcctttcccgtttgcatgtagctgtgtgcatgtacttttgtgtgtacacacacattccctggaggggttacttttatttttttatttggggggataactagtgaggcagcctgacactttcttatcttgtcttttaagtgtggagtcctctatggagtgggcatcaggtacttcctagctggcctctgccagctgtttggctgccccagtttctgcccttcacagacatgccagccacctgctgtgacattcagtggccttgtttgcagctagtgtgatgagacaagtggatcaggtacattataaactgaaaaagcacacgacatgcagagggaaagggtaaatgaccatgtgtgtcctgctcggctgaagtccacatcacatgactgagatgacattttttcacctaacatttgggccctgagaaacggcatctatgttttactttttatttatgacagagttagaagaaatactaccaggctttcttttccattttccccaactccctctttaccccctcaagtttacctacctcagagagaaagcggagctcgcctggttaatgacagcctgaaattatttgagtcaggtcactgtgtaaaggtcatactgcttctgtctccttgtgcatcacctgcgcagctcagatatttcatggctccctgtatacaggtagctgtgttaccctcctagccgctttcttggtttgatacatgcctgggagcatgtgggagcagttaaggtctaggctcatgggaggacagttctgcccaccccagctcatctctccagctcagcctgcatacctgccttcctccatctgattccagagtaggggatgggaggtctcacactgacctcaagtttatgtgactttttccacctctgctttcccagacagcccctgctgtgggacttgtaaggagatttgtgaagtcagtatctacttttcttgtgtgggtgtttgtttataaattattcccctggaggggaataaatgttagaggtactccaaacccctaacatataaacatctaagcctggcccttttttggtggtaaaatatatataacataaaacttaccattttaaccatgtttaaaggtacagttccatggcatccaatatattcagtgttgtccaaccatcgaatttatccatatctacaacttctttatcatcctaaaatgaaacaccaaaaccatgaagaagtcactgaatagaagactgatgtatttgactccataaaaattaaaactttgtatgagagaaaaatgcctcaaagtcaaaagtcaacaggctggggaaatagatctgcaatatacatgacacacaaaaagctaatttgggatatatatatacacacacacatatatatacatatggatatatgtaaatatccatttttaacaccatttaaaaaataccatcctttccccattgaatagtgttgactcccttgttaaaaatcatgaccgtgtttttcggttctttatttctatcgcattggtctttatgtctgtctctatgctggtacaacattgcttcgggtactgaagcattacagtaagtatgaaaccaggaggtgtttgtcctctaactttgttagtttttaagattgatttggctacttaggatttttttagatttcatctgaattttagaataggtttttctatttttgaatatattggaatttttatagtgattttattgaatctgtagatcgctatagataacaatggcatcttgacaaggttttgtcttccagtccataaacacatgatgtcttttcatttatttgtgtcatctttaatacttttctgccatgtttatagtttttgctgtacaggttaagtgggtttctaagtattttattcttttgatgctatcatacatgatactgttgtcttgatttcttcttcagatagtttattgttattgtagaaatacaactgatttctgtgtattgattttgtatcctgcaactttgctgaattttatttattgtatctgacagtttatttcacagaaactaaaagatttttaatatataaggttatgtcatctgcaaacagataattttactttttaaaaaattggaatatcctttattcttttactcaccttattgttttaactaactagaaccttcagtactacattaaatagaagtagtaaaagcaggcatccttgttttcgctctgagggtaaaagctttcagtctttcaccatgttagctgtgttttttgttgttgttgttttttggggttttttttgtataacattatgttaaggtgttttctttctttttataatttattaagtacattttatcatgaatgtgggttaaattttgacaaatgctttttctttaagatgatcacatgaggttttttccttcattatgttaatgtgatattacactgattttcatgtgttagaacatacttttatttcaggagtcagttatactcattcatagtgtataatccttttaatgtactgctaaatttgaattgctggtattttgttgaggatttttgcatcaacatttgtaagggatgtttgtttgtagttttcttatggtgcctttgtctggcttggtgtcagggtaatactggcctcatataataagttagaaaatgttacctccttttcaacgttttgaaaaagtttgagaaaaactgggttaattctgctttaaacgttgggtagaattcaacagtgtagccatctggtccaggcttttctttgttgctgggttttttattactgatgcaatcttcctgctgaatctccttgctcaataggtttattcaacttttctgattcagtcttagtaggttttttgtttctaggaatttgttcattttatttaggttattcaatttttttagtgtataattccttatggtactcttctacatcctttttttactccaaaagtttgttagttatgtacccattttatttttgagtttggtaatttgagtattccctttttttcttagtcaatctagataaaattttgtcagtttttatctttttcagagaacaaactgggttttgttggtttttgatatctttttctattctctatttcacttatttccactgctatctttatcatttttaaaattttgctagcttttagttgtccctctttaatagtccctctttttccctctgtttttctttccttaggagtaaagttgttgattcggtatcttattttttataatcatttatagctataaatttttcccgtgtggtactgtttttgatgtatctcttaacttttggtatttcatatttttaatttgtctctagatattttctattttctcttgtgatttcttcttttatccattcttgggtgtttaataactatatttttagacataaaatgtgtaacctacaaaattttcttgatttgttacagttttatttgttgtaagtttttatttcagaattaaatatgtgtatcaacatttgttgtgttctcataaactttgtaatacatggagatttctggtccacatatgtaagtctctacattaatattattttgaagcatttaaacttctgttttaatatttcaaaggtctaaatgaaattgagatttttggtttctgagatgaaatcatggtaggtgactgagaaatgcttaaaaattagccaaaacttaaaattaagttaaagtttactaagtcaccctgtattgctggtaataaaaaataagtctttaatggtataaaagcaaacttcagagaatgttttcttttccccagttgacatctaaattaaaagctggaaaaaaattttatggctttatgcgtttttcactttacaatttcaactttttctggttaaaatttttccaaacagattcctgtgtatttgaaagacaaattttttttagttgaaatgcttaagcagttaaataaggccatgaaactttcttgaacctgtgggaatccatgagaaaatctgacattatgttctattctcttggaaggtagaaatatcgtttgacttctgttttgctgacaagaaatatggtcctgagcaaggctccctgggacaatgacctcacacatggaaaacgctggagcccatctgtctccaatctgctgttttccaaaaattagggaacttcagttttccctttgatactctgtatttctaccaaccacaacgccagggctgtcctgcttctacaagtgacaatgacaaatataggcctgaaggaagatgagctgatggcattcccagcttactaccactccttgggtgccttatctcacatacgtggattcaactcatagactcaggtgggtgaggatctattgttcagctacattagaagtgactgcttaagactctggtgtgtggtgaaatgaggcagaattttctcaatgcagtgttaggagaattttctcctcataattaccatcttactatcactaaatcatagctaaaataaggaaattattcaagaagaaatagagatgtaatcttatgaagacataaatttagagatttgtggagagcccttcataatttcatggtgttctctttgagctgggattatagttgacatttcattataatatattagctattctagactttatgcatttatgtaaagttttctttgttgcactttaagttctgtgatacatgggcagagcatgcaggtttgttacgtaagtatacacgtgtcatggtggtttgctgcacccatcaacccatcatctacattaagtatttctcctaacactatttctcccccagcctctcaccccatgacaggccccagtgtgtgatgttcctctccctgtgtccatgtgttctcattgttcaactcccacttatgagtgagaacatgcagtgtttggttttcttttctttttttctttctctcttttctttttttttttttgagacaaactttcactcttgttgtccaggttggagtgcaatggcgcgatctcggctcactgcaacctctgcctcccgggttcaagcgattctcctgcctcagcctcccaagtagctaggattacaggcatgtgccaacatgcctggctaattgtttgtatttttagtagagacggggtttctccatgttggtcaggctggtctcaactccccacctcagcctcccgaagatctgagactacaggtgtgagccaatgctcctggcctggttttcttttcttgtgttagtttgctgagaatgatggtttccagcttcatctacgtccctggaaaggacataaatgcgtagtattccatggtgtatatgtgccaccttttctttatccagtttatcattaatgggcatttgggttggttccaggtctttgctattgtgaacagtgctgaaataaacatacagtgcatgtgtctttatagtataataatttataatgctttgggtatataccccgtaatgggattgctaggtcaaattgtatttctggttctagatccttgaggaattgtcacactgtcttccataatgactgaactaatttacactcctaccaacagtatgaaagcattcctatttctccacagcctcatcagcatctgttgtttcctgacttttaataatagccattctaactggcttgagatggtatctcattgtggttttgatttgcatttatctaatgaccagtgacgatgagctttttttcatgtttgttggccacataaatgtcttcttttgagaagtgtctgtttgtttcctttgcccactttttgatggggttgttttttcttgtaaatttgtttaagttatttgtagattctggatattagccctttgtcagacagatagattgcaaaaattttctcccaatctataggttgtctgttcactctgatgatagtttattttgctgtgcagaagctctttagtttaattagatcccattcgtcaattttggcttcttttgttgccattgcttttggtgttttagtcataaagtctttgcccatgcctatgtcctgaatggtattgcctaggttttcttctagggtttttatggttttaggtcttatgtttaagtctttattccatcttcagttatttttttgtataaggtgtaaggaagatgtccagtttcaatttctgcatatggctagccagttttcccaacatgatttattaaataaggaatcctttccccgttgcttgtgtttgtcaggtttgtcaaagatcagatggttgtatgtgtatgctcttatttcagagttctatattctggttcattggtctatgtgtctgtttttgtaccagtaccatgctgttttggttactgtagccttatagtatattttgaagttgggtagtgtgatgcctccagctttgttatttttgcttagaattgtcttggctatttgggctcttttttggttcatgagaatttttaaatagtttcttctaattctgtgaagaatgtcattggtagtttaatgggaataccattaaattcttttataaattactttggggagtatggctattttcacgaattaattcttccgtatccatgagcatggaatgcttctccatttgtttgtgtcctgtctgatttctctgagcagtggtttgtagtcctccttgaagaggttcttcacttctcttgttagctgtattctgatgtattttattctctttgtagcaattgtgaatgaatttcattcatgatttggctctctacttgcctgttgttgatgtatagaaatactagcaatttttgcacattggttttgtatactgagattctgttgatgtggtttatcagcttaagaagcttttgggctgagatgatggggttttctagatacaggatcatgtcgtctgcaaacaaagataatttgacttcctctcttcctatttaaatacctttatttctttctcctgcctgattgccctggccagaaattccagcactatattgaataggagtggtaagagaggccatccttgtcttgtgccagttttcaaggggaatgcttccagcttttgctcattcagtatgatattggctgtgggtttgtcatttatggctcttattattttgaggtgtgatccttcaatagctattttattgagggtttttaacatgaagggatgttgaatttcattgaaggccttttctgcatctattgagatagtcgtgttgttttatgtttagttctgtttatgtgatgaattacatttatagatttgcctgtgttgaaccaaccttgtatcccagggatgaagccatcttgatcgtggtgggccaagctatccttaacagtcttaagttcagtctttttacataatcccacatttcttgaaggttttgttgttcattcttttttgttcttttttctctattcttttcttcctgtcttgtatcagatagttttcaagctctgagattctttcctccacttggcctattctgctagtgatacttatggttgcattgtgaagttctcatgttgtgtttctcacctccatcaggtcagttatgttcctctctaaactgaatattctgcttatcagctactgtgttcttttatgatttttagcttcttgcattaagttagaacgtgcccctttagctcagtgaagtttgatattacccacctcctaaagcctacttttgtcaattcagccatctcagccttgggtcagttctgtgcccttgctggggaggtggtgttgtcatttagaggagaagaggcattctgcctttttgagttttcagcgtttttgtgttgatgctttctcatctttgtgggcttatctacctttgatctttgacgttgctgacctttgaatggggtttttgtggggtcttttttgttgatattgttgttgttgctttctgtttgttcttaacagtcagaccactctttcctagggctgctgtggttttctgggggtccactctggaccctagtcacctcagtctctcctgcacctggaggtatcaccggtgaaggctgcaaaacagcaaagatggcagcctgatccttcctctgggagtactatccaagtgggtaccgacttgacgtcagctggaacgctcctgtaggaggtgtctggagacccctgttgggaggcctcacccagtcaggggaaacaagatcaggaactgcttaaagaagcagtctggctgccctttggcagagcaggtgtgctgtgctgtgctgatccccgggagtctccagagccagcaggctggaaaggctcagccagctgaactggggagatagcagctacccctctccctggggacttcatcccagggagaaatcagagttctgtccatagaactctggctggagttgctaaaattccaatggggaggccctgtccagtgaggagggatgtgttttggtctcacttaaagaagcagcctggccacaatcaggcacagcagctgtgctgtgttatgggaaactcctcctggaccctggtgccagcaggctagagtggccaactcaaaccacagatatagtggctgcccttccctccaggaactcggtccatctctggctgtctccagcctgctgcctctggccagctggaattccaagccaatgggttttgtgaggtgctgtgggagtggggcctcagaatgatgtcacttggctccctggattcagcccccttcctaggggaatgcacagatgtatctcccactttgctggaattctcggggcataggatgcaaaactcctgggtttccacgcatgccccagtgagccagcgagcattccgccgagactccacacagctctgtgcttcagacccaaggccatggtggctgagctcaccgggggacctcccaatctgcaggttgcaaagatccgtggggaaagcatggtttcccaggcagtcacgcaatcactcaccgcctcccttggctgcgagtgggggctccctagctccgtgccacacctggatgggccatcaccccacttgcttttcctcactccctgtgggcctagtgggcctagtcagtcccaatgcaagaacctggatacctcaactcaaggtgcagaagtcacttgtagttttcattgctctccatgagagccatgggccacagctgcttctaatcggccagcttggccccatctaaagtatgatttcttaatacatgagatgttttaagtacatgacaataatgatatttatcacaaataatattttatctcaatttcatataaaaattgctaacaaatcaattatttttggttaccacaaagctatctggaaatgtaacatctgccatttataaaatttctgtagagttaatagaacttttcctgaagggaggccggcaatatgcatcatgaattcaagcactaccagtgaagttgtggagtttgaagtggtactcacatcttgttactgggattataaattcgtacaaactttatctaatgtgattaaacaatatataccaaaattatcagtggaaatactctctgattcagcaatttcatttccagaaatttaccctacagacatactcatgatgcctggaattatgtatgaatgggagaaagtattataccacctttttcattaacaaaagtctggaaatcaccttaatgtttatcagtcacattaatggttatcaccttactgtgtattgaaattatggttattcatacgatagcatactatgcagctatttaaaaaaataaattttaaaaggatgctcaaaaatgatgtccaatatatgttacaaagtaaaaacaaccctgggtgcagagccatgtgtctgatatgcctccattcctataaaatcagagtgtgtagaaatgcatagaatatctctattaactggtaactgttacaaaattcaaagttaatgcaggcaagacctttcttttttaatgctaacactccaaggaactgcacaacatttgaggattcccaacacatgccaatctacctttgaacctatagattttaggaaatgaggctcttgaaaaatcaagcattaatattcctagctacagttgtttgggacataattagaatgatccattctttgaaagtttgtaaaatttgctcatacaaccatctgggcctagtccttcctttgtgaaagattttattttactagagattttattttcttcacattatagtacttcttaggttttctatttcttcttgattcttgagtcaattttggtaccactttgtaccccacagggtgcttgggctcagaacacatcagtcaaagaaagagagaagaaaggaaggcaggaaggcagggtgaaaggaaggaaggaaggaagaaggaaggagacaaggaaagagagagaaggaaggatggagggagagaaagatggaaagagagaaagaaggaaatgagagagagagaaggagagaaggaaggaaggagggagagaaagggaaagaaggaaagaaacaaggaagcagggagggagagaaagaggaagggagaggaaggaaggagggagagaaagagggaaagggaaagaaggaaggaaagaaacaaggaagcagggagggagagaaagaggaagggagaggaaggagggagggagggaaaggagacagggagggagagagggagggagggaggaaaagaaagagagaaaggtgaaaggtggggacgggaagggaagaggagccagccaaaggctacaggctgtttgttcactcttctacttgacccaagcagttctgccttttaaatattccaccttctgccatgagttacactgttcaatattcatttctcagagcattcaaaggtctatgtgtgccctgccatgatggaccatggcttcagctctcaaacacaaccctcagccaaaatattcatgactgttccctcccatatactcatcaatcccccatgctatggtctgcatgtgtcccccagagctcacgtgttgaaaacttaatcctctatatgacagtgttgagaggcggggcctaataagagtgattaggttataagattctgcccccatgtatggattaatgtcattatctcaggagtgggttagttatcttgggagtgggcttgtattaaaagcatgttcagccccttttgctctctttctttcccaaactcttgctcttctgccttcagccatgagatgacacagccagaaggccctcacgagatgcagacccctcatccttggatttcctagcctccagaactctaagaaataaatttcttttctttatagattccctagtctgtggtattctgttatagcagcacaaaatgggttaagatgccccattacatggagagtgctgatccacagggttcagatcattgacttagggcttggagtcttatacaacatccctatgggagttgacctccatattccctatcttcccggaatcgcaaatggtgatttcagaccaaaatatagcccagatattttgcatttggcaatattgccgacttttccacaactttatcatggcaggtttgatgtgctcacttctatgatccctgaaaggatatgggttcaagatcctgcaaggttacaatccaaggatagaagagcctagacaagagtcccatcacctgggcgatcagtgcagagatatgtcacaaagcccctgtaggcagagcctagacaagagttacatcacctgggtgacaggcaaacaacaatgacaacttattttcatccccacttcagtctttgaggttagacagacctggattcaaatccaagctccacccctcgctgtgtgagtttgctcatgctgctaacctctctgagacttgactcttcatttatgaaatgaggataaagccccttctctcaggggctgtgccaaggatgaaatgagtcacgcattggtcaggacaggtgatgctgtgtaacaagcccctaaacctcagtggcgtcaacagcaaagttgacttcttttcttttttctattttttcttttgttgggggggtggggaggtggatggagtctcactctgtcacccgggctggagtgcagtggtgcaatctcagctcactgcaacctccacctcctgggttcaagtgattctcctgcctcagcctcctgagtagctggggctacagatgtcagccaccaggcccagctaattttttgtatttttagtagagatggggtttcaccatgttagtcaggatggtctcgatctcctgacctcatgatctgcctgcctcagcctcccaaagtgttgggattacaggcgtgagccactgcacccggccttgacttctcaattgatttcacatccatcacgggtcaacaagggggttctggtggtcgtagtcaatgagccgagaccatgccactgcactccagcctgagtgacagagtgagacttcatctcaaaaaaaaaaagtctcaggctatgtctgaactaggagggtagaaagaatagtcattttggttgccacaaaccatcgaaacaaagatgcagatcattgatgtaaaattacagttagttccttcccactccttttcagcttctcttcgttgctatgacccagcgtctcctgtgtcagttttcagtctattgtctcccagcttctagtgcacctttcaatatgtgcactgtgataaactgggaagcacttttcaatataccttctggaagtgaacattctgcaggcatctagatagaggatggagagactgcagggggcaggagctctctggctgggccttgttcaagccccaaccacagagacctaggcatggtccctcagccaccttgcagccttggctagcaacatctcgacacggaaaccaaaacgcagcagagcccatgtgatctgaaggttcctgaaaagttgcccagacctcctcttgtacccacatacaaagagtgtgtccagggtcatgagtgagcatgatattacagaggaatgtaaacaggaaaaccatagcatagagcagtggggatccatagctcacagtgatagcatggaagtttcctggttacatgaagtaattaagacgtatttaaaagccaagagtacaaaattagacctgatgaaaaagcaggagttatcatcccagccatgcagaaaagccaagccttctctcccttctcaagaaggaacagaagacaatgatgtgatctgtgagtcatgtgtaacatgaaagtacaggaaaagttgaatttctgatacacaaatctgaaaagtttttatagtaacagatttcaggattaaaagtcaatatttattacttcattaagagcaaataaatactttaagaaaaccttgttgttttaaccaaaatttttagttttgtatcactatgtttttaatattatacctaatttaaataaactttataaacaatctatctgatctcaatcagttttgacctcgaggtaagatttacgtaaacttttaataaccttgtataattttttccatcttttccaactttttatacacattttatctatcttttttattccttcaatttaaaataatccttaaaaatctctaagcgaatttactttctctgaaacaaaaaccggtatacattttgcatacagaattgtttctcttgtacctagtagtcttaatcacatatatctaccacaatattaatacttagtaacctttattttaataaaaaacctaggaagcaagaaatcttgaattgtcatatagcagtatcttacagatgagaataatttcataatttagaaatatgtgttcctaaaacatttttttttaagatggagtttcgctcttgttgcccaggctggagtgcaatggaacaatctcggctcactgcaacttccgccccccgggttcaagtaattctcctgcctcagcctcccgagcagctgggattacaggcacccgccaccatacctggctaattttttgtattttttagtagagatggggtttctccatgttggtcaggctggtcttgagctcctgaccttgggtgatccacctgcctcagcctcccaaagtgctgggattacaggcatgaggcaccacgcctgggctaaaacataagtttttaaattggaaataacccagatagttaatgagtatctattatttaatttaacataactaaaatttcaaaaataggctgggcatggtggctcacacctgtaatcccaacactttaggaggccaaggcaggagtatcatgagaccagcctgagcaaaatagtgagatgctaactctacaaaaaaaataaaaattagctgagcatggtggtgcatgcctgtaattacagctacttgggaggctgaggtgggaggatcccttgagggcaggaggtcaaggttgcagtgagctgtgatcataccactgtacttcagcctgggtgacagacagagacactatctcaaaaaaatttcaaaaatacattaagatgtcttggatagacatgtatccatttacatttacttatttttaacagtttatctagagtatttgtgagaactgaggtattagacaaagctagtcatcatttctaggttattttcttgttaaccatgttatagcctgtgaatatcaggtgttcacgtaagtgaggacttcaaagttaaatacatgggtattttaccaataactcagaaaattccattacttttgttcaacaaaccgtattaaattggtcttatgtattaaaaaaaatcacaaaaacaaatattcctttttttcctgtgtttatagctttataaccttcatgccaaaccctagcaccttaaaatatctagcaaatgtaaatataaaacacagtcaaaaatgtatgctgacaattctgaagacatttctattttccttttatccatactttttaaattatttgtatttataaaagaactcttttgtctgggcacagtggttcatgcctatatcccagcactttgagaggctgaggcaagaggatcacttgagctcaggagtttgagaccagcctgggcaacatagcgagaccgaatctctactaagaataagataaaaaattgccaggcatggtggtgcatgcctattgtcccagctactggagaggatgaggcaggaggatcacctgagcctgggaggttgaggtaacagtgagctctggtcccactactgcactccagcctggggaacagagtgagaccttagagagagaccttgtctcaaaaagagaaaaaaataaagaattatttcattcttttgtttttcttcagccaagtaaccttgaattggtaataccacagacagtaagtttcatctcaacaccagtagacaagtcagcagattcaaaataggcagggaaaaaaaaatagacaggcaaaagaactgagattttttcattttagggtttttaaaaatataaactatttgagttctgaattttctttcatgttattcggccatcaggtttaaagtgtgcactagaagccaggcgtggtggctcctgcctgtaatcccaacactttgggaggctgaggcaggtggatcacttgaggccaggagttcgagaccagcctggccaacatgacaaaaacccgtctctactgaaaatacaaaaattaactgggtgtggtggtgtgcacctgtagtcccagctactcgggaggctgaggcaggagaattgctcaaacctgggaggtggaggttgcagtgagccaagattgtaccactgtactccagcctgggaaacagagcaagactctgtgtcaaaaagaaaaaaaaaaaaaaaaaaaatatatatatatatatatatatatatatatatatatataggcctgtgcgcagtggctcatgcctgtaatcccagcagtttgggaggccgaggcgggtggatcacttgagatcaggagttcgagaccagcctggccaacatggtgaaacctcgtctctactaaaaccacaaaaattagccgggcatggtggcacacacctgtaatcgcagctactcaggaggctgagacaggagaatcactagaacctgggaagtggaggttgcagtcagccaagatcacaccactgcactccagcctgggcaacagagcaagactctgtctcaaaaaaatgtgtgtgtgtgtgactagaatggtctataatatatagccagctcgagtcccagaaaacctagcaagcttaaggttagagcttctcattttggccttttcaagattaaatctcctttagtaggcccctcccctctagggaagtacttgccggagcgctgcctaaagttggttttctgatgccctgttgtttctgttctgaatggtttatttctcattataagggctcagcaaagcaggcagagttaaaaagcagagacaggaagaatttttaaaatcgtggacttcactcctacactgaatctcaggtccccagaaagacagaaacaccatgggaccacagcaaaggcaggaggaggagtgagggagggaggtggacagaacaacaaacaggagttggctctcagtttttcacgtgtgccattttctttaggtttttctagtttatggagtctctttgttcaagttgagcacacagataaactagagatctcacaaggcttttgctgagaccatcaaagcctttaacctctgttgggccaaatattttagaccaaaaatacagatagacacacaaaagccagaaccagaccagattgagtatctcagtggctgcagcctttattccctttattctttaggatttgaactcaaaccagattcagggttctaacccaaccaggatccccctggggtgaaactgaaacccacagtctagacaaggttgggggtctttttttatttttattttttcattttttttgagacggagtttcactcttgttgcccaggctggagtgcaatggtgcaatatcgcctcactgcaacctccgcctctcgggtttaagcactcatcctgcctcagcctcccaagtagctgggattacaggcatgtgccaccacgcccatttaattttgtatttttagtagagacagggtttctccatgttggtcaagctggtctcgaactcccaacctcaggtgatccgcctgcctaagcctcccaaagtgttgggtttacaggcgtgagccaccacgcccggcccgcttgttcttttcatttcatcctgatgtccgaatacaggagagtagctgagttggtgttcactaacaagcacggaagctttgttacatttacagtgtcattcttggcaaaacctgaagttttgcctcccgggttcacgccattctcctgcctcagcctcccgagtagctgggactataggcgcccgccacctcacccagctaattttttgtatttttagtagacacggtgtttcaccgtgttagccaggatggtctcgatctcctgaccttgtgatccgcccacctcggcctcccagagtgctgggattacaggcgtgagccacgcgcccagccagaagctctgtaatttcaatgatgattgtgcttttaatctctttctcggcatctggctcatgataaagtttcaggtgtcttgatggtatctaaatcagttgttgattcggtcctggagaaacacaagcataacctctacgccaagttattattttacctatttcccaactttttgttattggatctgtccaccaaaccagttgttctgcttgtgtctttgcagctggtttctgtagatgctgttcagctgctggtaacatctggcctttgggaaggctcgaaaaatggaaagttaataatgcaagattcaattgtgtctgggctgtcccgtaatccctgtttccccccttttttgtttttattatcagttgttcatctgtatgaaatcgtaactgagcattttcaattaactgtgtggaatgaaccatgtatgaagaatcagaaatcacattaataggcatatcaaaagcagtcaatacctcaattacagctacaagctccactttttgagctgaaatatagggcgtctggaaaactttaccttttgatccagaataagaagctttaccattactggacccatctgtgaaacaatgaaaacgcttagcaggctgcaggttgtttactgcaggaattgtaaatgcaaatcgttcacagtcttgctcagctaaaagggtagtaaagaaacagtcttttaaatctgtgactattaaaggccaattttttggaattatagtaggagaaggcaatcctggctgttatatttccataggttgtataactgaattgatggctcttaagtcagttaacattctccatttacctgattttttcttaattatgaaaactggagaattccaaggggaaaatgttggagctatgtgcccattttctaattgttcagtaactaatttctctaaagcgtccagtttctctttgcttagcagccattattctatccatattggcttatctgttaaccatttgtaaaggtataggttctggaagcttaacaacggccgccgtcaaaaatgatatcctaatctttggcaggaactttgtctttccacttgaagcagttctttcaaaccttgcaaatattttcctagtcccataccaggaacatgccccatttcatgaattatatgtcgactttgagggctatataattgttctggaattagaacttgtgctccccattgttgtaataaatctctcccccataaatttataggtacagaagttataattggttgaatagtcccaggttgtccattgggcccttcacaatgcaaaatataactactttgatatacttcaggggctttaccaactccaactatgttaaattgagtgggttgaattggccacgcggacggccactgctgtagagaaataattgaaatgtctgctcctgtatctaccaaacctttaaagttctttccctgaatagttatttcacaggtaggacgtttatcagtaatttgatttacccaataagccactttgtcttgtttatttgtgcttccaaatcctcctgttcatttaatttcacttttccccattcccacatatggcacaatcaggagccgatctcctggctctgctttccagggaacagaagtagatataacaatttgaatttccccattgtgatctgaatcagtgactcctgtatgtatttgtaccccttttaaacttaaactagacctttctaaaagtaatcctatcgtccctgctggcaagggtccacagactcctgttgggaccttttgcaggggttccccaggcagagggctcacagcttttgtgcagcataaatctactgcaacactaccagctgtggcaggggacagacattgtacggtggggagggaatggcctgagttggaaatgccccggtttagaacgggcctaggatgggcccctcatggtgtttcccgaaatcgggttccgttcttcatcaaacttagagtgacattggttagcccaatgatttccttttttacattttggacatatttcagcttagcagttctcttttttcccctatctgacagccgactcactgattttttttctacattcttttttagtatgaatagcttctttaaattctttgagtaatttaaaaggaaaaggttcaaatgtagctataatatctccctgttgatctggggggtgtattctaacagggaactgccaagcctctaaatcaccctctcttctagcttgctgaattcctgcctgaatagaactaagagcagtcgctccaggcgctgctcagtcactggggcaactacttttcgcccacagtcctctggaaaagaaatacctggagggtcattttcttcaaaataataatgagggggtgcagaagggtagggatgaacctctccctcctttgccgcttcagctttagctggcaaacaaacctggtctgtaacctcttctgttacgtcgctatactctccttcctcctcctcatcagtgtgaaaaggttccaaggtgaaacgaaccagaccccacgcctgtcccattgttaccctgatgcttccgagctccccttcttactcaccacggggatggctttaagagtactcaggtgtcctccagctagttccacgttctccaaccgtcgctctggcgacccttcgacctggattcgagcccccacgatggacgccacttgcagagaccagctcggtcaggaagaccctaacccagcggcactagaggaattaaagacacatacacagaaatacagaggtgtgaagtgggaaatcaggggtctcacagccttcagagctgacagccccgaacagagatttacccacatatttagtaacagcaaaccagtcattagcattgtttctattaactaaaagtatcccttacgggaaatgaagggatgggccggaataaaggggtgggtttggctagttatctgcagcaggagcatgccctgatggcacagatcgctcatgctatgtttgtggtttgagaacgtctttcagcggttttccaccctgggcgggtcaggtgttccttgccctcattccggtaaacccacaaccttccagcgtgggcgttagggccattatgaacatgtcacagtgctgcagagattttgtttatggccagttttgtggccagtttatggccagattttggggggcctgttcccaacagtaaccaatattaagtcattctcatttcaacatttaaactcttccaactgaatgcattaaaaaacaaaagtcacacaccactgtaccccttatatgtacacagcggtcggcaaacatgtgacaggtggaggtcctgaggcaccactgggagcttgtgagcggatgggcgtcttccagaacgcactctgcaggcactcggcaacgtgaagtgttcacgtcctgtgatgcagcctctgctccaggccacttccggaactgcgagggaacagctgtgggcgcgctcatttcagctttgcttcagatcctgggagttgggggcaccttctttttttttttttttttttttagacggagtcttgctctgtcacccaggctggagtgcagtggcgcgatctcggctcactgcaagctccgcctcccgggttcacgccattctcctgcctcagcctcccgagtagctgggactacaggcgcccgccaccgtgcctggctaattttttgtatttttagtacagacggggtttcaccatgttagccaggatggtctcgatctcctgacctcgtgatccgcccatctcggcctcccataaagtgctgggattacaggcatgagccaccgcgcccggctgggggcaccttctggcccacagtgagggaataagcaaaccagaatggggggtgcctgcacggaatactcctaagtgctcagacacggcgtccacagatggatccaaatcagtgctggatgacgggcactcaccccaggtctgcagtccaataacacgggcctgagcagaaagcacgtggcatggagccccgtggcagatatggggacgagcggccaatacatcagctcaggtgtccgaggggtttcagggacatgagagagagtggggaacgaagggggaaatcgcttggagacccaggacgagcctggcacaccaggatgctgattctgaaagggcgattaaggagattccatgttttaaaaatctggatttctggcttcttctgaaaaaaatcagaagatgtttagcacaacagcgtggcatcgtcagctgtactcctgccccactgtcccccagggagcctggctcatcccatggctcacagaggcccacactgtggccagacaggtccactgatggctcagcacgtgcaccccggctgcagggagatgggtaccagcccaggaagtgggacactggctgaaacaggatgggatgcagggatggggtgggatgggagaccaaaccagtgtgaggaatgaggataaaggagatgctggagataaaatctgggcaagtaagcagggggtggtcctgctggctgaggccagagatgccagcccactcagactcctgcgctggcccttccacaccatcccaggcccaaggcctcccacacacagcgtcacatacacaaacagcaccctcctcatggcaacaggtgaccctgccccttcacagacctccctgcccccacagtcaccccacattttaaagggaacttgagtccatcctgatatgtaaacgtgaggttaaatatctatcatgggggagaacagacaaatctccagtgcagaatagttctaaataacctaagtggaggctccactcttgaggagatccagcctaactccccacctctccaacgcggctcatcgcagcgacctccttcttccaacgtggctcatcgcagtgacctccttctcaggagtgcagagtggaggtcagtggtggagtgaagacggaccagggttaacatcggcagtgatcacttgacctctgcacacttgactctgggtctttctccccaaaaaaaaccagaacctcagtataatcgtgaggaaaatagacaaatcctaattgagggacattctccaaaatacctgactggccctcctcaaaactgccaaggtcatggaaaaaggaaagtctgaaaaactcacagtttaggaacctaaagagacttgattactaaatggaatatatcctgggatcctggaaaagaaaaggacattatgtaaaaactaagaaaacctgaataaaatgtggcctttagttaataagaatccatcaatattggtgcattcgttgtaacaagtagttgtaacaagtgccacgctaatgtaacacgttagtaccagcgtaactgggtgccaggcgtttgtaaactctgttccgtcttctcaattgttttgtgaatctaaaaccgttctttaaaaagagtttatttagtaggctgggcatggtggctcacacctgcaatcccagcacttgggaaggccaagactggtggatcacttgagctcaggagttggagacatgcctaggtaacatggcaaaaccccatctctactaaaaatacaaaaattagccaggtgtggtggcgcacacctgtagtcgcagccacttgggaggttgaggtgggaggatcgctggagcctcggaggtcgaggtggtagtgagccaagattgcaccactgcactccagcccgggcaaccagagtgaaacgctgtgtccaaaaaataaaaaaagagtgtatgtaaagtgaaaacagagagagtacaagaaaagagggaaaccaggggctcagtggaggtgggcaggggctggtccatgtgcattcagcccacctggttggcagctgcccaggtgtctcctcaggtgtcggaacaggagtttcttccacagccttcagtttgctcaggtgggcatgtggcgatggcagacccttgggctgtgagaaactatgttgctgttttatccaagtcttcacagaccaaagacggggctttgcccagaggaggccttgagaagccaggctggagtttgtggagagagtgtgtgtcactcacaggacatatgacgcatttgcaacatgcgttctcaaagtgggagccacagcagtgttcgttttactattgctgggcctgtaaatggagcgttttatctttttcgtcagctggttcattgaacaagtgtttacagagcacctgctaggcaaatccatcgtgacagagactcggtgtgcccccaaggagctcacagtctagcggtaaagatggtgcataaactccctgacactcagggtggcaacagccaccccacctgctcctccctttcctaatgcccacacggagcagacactcgagggctgcttttaggagtgctgactacatgcttccctacctccatgtaggcatgtgtgtacacaagcgtgtcctgttttcaccttttcacaaaactatgtcaaaagtgaaacattttggaatacatttccagttatgcaaaatgtttaaaatatgaatttcttcggttaacacaaattaggcatgaaatgtaggcaaccctgtttaccaagaaacatcagggtgcggtgtgggtctgggaggtgcccatgagcacctcatcttgaggccagtcttcatgctagaccctgggtggagagagcgaggcggctggaggtgggtgtgtgacaccaggtgacttagcggccccaggagggtgacttcccctccggaggtgccatgcgactgtacagctcaggagcactcggggtcacctacaggaggggcaactcctgggtgtctcccaacagagcccaaaacctggaagtggacagagcaccccccgctcatctcctgggccctcgtctcagaggaaggacggccattctggccaacactgaccaatgctccagcccacactgccctgcactgcctagaaggagaacctaggctgggctcccagacaggagagaggggtgcgtttgtggggctaattaatagtaataataggccgggagcggtggctcatgcctgtaatcccagcactttgggaggccgaggtgggtggatcaccttagctcaggagttcaagaccagcctggccaacatggtgaaaccccgtctaaaaatgcaaaaaaactagctgggcgtggtggtgcctgtagtcccagctactcgggaggctgagacagaatcacatgaacccgggaggcggagcttgcagtgagccgagatcgcgccattgcacccagcctgggcaaccagagtgaaactctgtctcaaaaaaaaaaaaaaatcgtcataataataatcccccctcacctgagttctgggaggtcaatccaggttcaagattcctcctttgaaaggtagactggatttggatacagagggtgcccatgcgtgaggggacgagggggcccgggatgcgggtccgtgtgaggggctgaagagttgcccctgtgctagtcagtgccgccgccataaccgagccccgccggctgcgcggcgtcttcagcaagcgtttatttgctaattctgggggctggaggtccgcggtcacggtgtccacagactgacttctccagaggcctctccttggcttgtggacaccgtcttctccctaaatcctcatctcctcttcttatacattgtatcagggcccgccccatgaccccatttcaccttaatcgcctcgttaaagaccccatctccaaacaaccatattctgaggtcctgggggttagggcctcagcacaggaatttggggcggggggacacacactctgacttcgcaccacctccccaccactgcgtggtgtgtgctgcggtttagcttgtgtgactgtgatctttttcgtcaactggttcattgaacaagtgttcaacgggccctctaagaaagtaattaacgtcaaatgaggccctaagggtggggccctgatctgatagaattcgtgtccttataaaagaggcaccagagcacccactccctgtctccgacgtgtggggacagaacaggcggccatctgcaagccaggtaagagccctcgccaggaaaggcccagctcacaccttgaccctggacttccagcccctagaactgtgagaaaattaatttctgtttaacctacccagtctgtggtacagtcatctctcagtatctgtggggcactgattccaggatccccacagataccaaaatccacagatgttcaagtcccccagtgagccgtctgcatccatggaggcagccccagccttggagaccgactgtgtttccttagggcagccctaggcgcagcggtgcaaggagagccacatttacccctggcgctgcacggccctgaggctgggcaaggctgtccaccccgctgtcagaaccccagcagggaaggtgtccagaaggcagtcctgggaaccctgcacagaggcccagcgggcacaaggttggggcagctctgttcccagcaggccgagcccgggtggctggagagggagctctggaaggtcagcctaggggccgtcggcccctgcagaccctgtgcccagcccagcatcccggggagctccctccacatgctcatctcacgaggttcctgctgcactcagagtggaggatgggaggcctggggcggagggccggggctttggaatggctgagggggacaaggatgcacaaggggccagtgcagaggacagcgcgactcccaggggcccggggtcctggtcttcctggtcctgccgtttttattagaagcgagccctccaccccagtgggtgtagagcccaggacgcagcagagggtgggggggtggggggcggcatcggggcaggtggcaaccccttggacgcaggctcaggacgccagggtcagggcgtgagtgccggggccccctcaaagccgcggggtccaaagaggccgccggccccggccccgccctctgctcctcctccccctccaccgccaggcccgggtggccgccgcctcctccgaacgcggccgcctcctcctccgaacgtggcctcctccgaacgcggccgcctcctcctccgaacgcggccgcctcctcctccgaacgtggcctcctccgaacgtggccgcctcctcctccgaacgtggcctcctccgaacgcggccgccgcctcctccgaacgcggcctcctcctcctccgaacgcggccgcctcctcctccgaacgtggccgcctccgaacgtggccgccgcctcctccgaacgtggccgcttccgcagcgcccggcgcaggccgcactccgccaccagggggcgccacagctcctcgcgccgccgcctcccgcaaacacaaagagccgcgcggccacgacggccgcgtgcccggagcgccggggtctttcctgggctccaaagtcaagagctcacgttccgggaggatctgtccgcggaaattcggttctgagcgtcgccggactccgccgcggggaggcgggtgaggggagggggccggagggtcgggggtgccggggggtgcgggaaggctgcgggggaggctgttggggacgttcgtggcgggggaggctgttggggacgttcgtggcgggggaggctgttggggacgttcgtggcgggggaggctgttgggtcccctccccgccccaccgcgtcccagggaaccccggcagggcacccagtgaggggggcccgggcgtccgcccattcctcactgctgtccccgcctgtgcccgaaacccccgttcacgttcaccgagaaaacagacataaacccagccaggcacatccactagaatggctgtgatttcagaaaagcggacgtaagtgctgccgaggagatggaggcgttggaccccctcgcgcattgtcggggcgggtgcagccgcggtgcaaaaggaccttcctcagaaagttgagcacgaagttcccacaggcccggaagttcccctcccgggcgctccccagagagctgaagactgggcgcgtgccggcggcaaatgttcacagcaaagggcggcccagtgcgcagctggaacatcagccccaggcggtcgctgcgacagggacgagcctgggaaacgtgaaaatgtccagaacagggaatccacagataaagaaaagacatcgtggttgccagagctcgcgggagggggcaacagggaccgactgcttaacgtgtatggttccccttcagggtgaggacgtgttctgggacgaggtcgaggtcagggttgcaggacaagatgaaagcgctaaatgccactgaattgtttgctttaacgtcattaattttgttatgtgaatttcatctcaatagaataaataggtcaagctggctgcagggcccaccccaccgcggcctggagcagggtcttctggggtgtaccacctctgccctcacccaggctccaccacgaccagcttcgtccaccccccaggagaccatgaaggcccacgtctgaaatcctcactaagcccaccctcccatctccctgaactacgggtaggacccctctggcccccagccctgcccttgacccggcccaccaagcccccacccagatccacaccaccaggcactcttgcccttggcctgctgccaggctggccccgctccttctgggcctcctggagcttcaacccctgcctccacagcagaccttggcctttagcatgttcagtctcctcagtggcagccccgggagggccatcttcttgggtcaaagccctcctcactacccaccctcttgccaggactagctgtgtcctgcagcagcccagcatgtgccgttgagctggccttttctcaggcccagtgcccaaggaggagctgattgcataggctcagagtttccaggaagagtggggactcagatgtctgcccaggtgtctccaccgcgtccgccagggcctccagctttcctaaccaggaccctggcctctggccttggttgagtatttcaccttcttccatgtttagtcccttgggctctgctaccctcctgctggaggtgagagcatcctgtgtgcaaccagagatgccctctggctttcagacctgcctgcttttcaccctcagccctttctcactcagcaaaattgtgggggtccctagtcagcagctccctgggcagctctctgagcaaggtggtctctgtggtcatgaaggagagccggctaggacagtgccggaaactcagctgcctctccccttcaactcagctggccccccgcacctgaagtgcacaggagccgggaagagagtctggagcccaccccggagggcagcacaggaggtgtctctgcagctggtgtcctgccacccctgcaggcagcacacgtcccgggcattctccttagccacagacagaacagccagtgccagagtctgctgtcgcttcccctttaagcacactcattcaccacacccgaggaggccagaggtgcagggagcatgggctgtcgcttcccctttaagcacactcattcaccacacccgaggaggccagaagtgcagggagcatgggctgggtgcacctccgcaggagagaaggctgagccaccgccgtcccgggagcccggctcccaggcctctcgttttcccctacctccctaagacttttctgtcactctctggccattgaaaggcttctgttccttaaagtgctgttacactctcctttcccaggatgcagcaagccaaaacagtaccactgcacgtcagcctgggtgacagagtgagaccctatcttaaaaaaaaaaaaaattggctggacatgatggctcacgcctgtaatcccagcacttagggaagccaaagtgggcggatcatttgaggtcaggagttcaagaccagcctggccaacatggtgaaaccccatctctctactaaaaatacaaaaattagcatggtgtggtggtgcatgcccataatcccagctactggggaggctgaggtgaaagaattgcttgaacccaagaggtggaggttgcagtgagccgagatcacaccattgcactccagcctgggcaacagagggagactgtgtctcctaaaaaaaaaaaaaaaaaaaaaaaagtcttctttccatgatgagaatgtcaggccctgcagcctcttgcactggccagaggggctggggtcactgtctgtttccttgcccaccctcaagggacaaggaggagaggtgaggctgtgggcgcacctgattttacctgctggagtctgtgttctctgggattagggagcatctggagctgactcttcctccatgggaccctccctttttcaggaaaacttcccctcctcggggatcccgcagggctaagaaacaccctcttcacctccctcctgcccggtccttctgaccagccgagagagtacagaccctccccgatctgggaggagggcccatcactggctccctgccccctgctcgccaagccccccgggacttcccaggctgttccttccacctgaagggtctccctctggccaaggcgaggctcacagttcccctgtcaggatggggccttagacacccagactgacccagtgacaatcaccttaattctccacagataactacctacaagttttctgatttattcattagtggatttgttcgtgatcagccccacacctgttagaatggaagctgcaggcagcaggaaccagtgtggccaagtcggagggcagcacaagccggtcctcctcgtggacagcaggtgtggagcaggccaggcccacaggagggcgggcaggagggcaggcaccgagaggtgcggatggcctctcagaacaggggtgcaggctggtgggggcagcagctggaaggggaaggtcacagagccagaaagatagggtgtccgccacagccagttctttggaagtttccctgaaaaagggaaaagagacaagatatggttcaaaggaaagcagggcctgggagaggcctgtgtgcagtgtgtctgcaaagggaggaggaggcaaagatactgaaggtgaagagggaaaggaggaagggacaggggaggtgacagagggaggggagggggaggaggggcgggggagaggagggaaaagggggaggcgatgggacgggggagggaatgggggaacaggtgggaggggaggagggggtgggggagaggagacaggggagaggggagtagggggaggggatgaggggaaggtgggaggggagaggggaggggatgggggagggaatgaggggacaggtgggaggggagaggggacaagtgggaggggaagggatgggggagggatgaggggacaggtgggaggggagggaatgaggggcaggggggaagggagggatgaggggcaggggggaagggaggggggtttggccctgcagcaggtgggattctgctcagcccatttcctgggccacgggattcatgaagggcaccgggtcaggccccccgggcgcaccgttgctggtatatgcggtgatcggggtcaggcccccgggcgcacctttgctggtatatgcgggggtcggggtcaggcccccgggcgcaccgttgctggtatatgcgggggtcggggtcaggcccccgggcgcaccgttgctggtatatgcggtggtcggggtcaggccccccgggcgcactgttgctggtatatgcggtggtcggggtcaggcccccgggcgcacctttgctggtatatgcgggggtcggggtcaggcccccgggcgcaccgttgctggtatatgcgggggtcggggtcaggcccccgggcgttgctggtatatgcgggggtcggggtcaggcccccgggcgcaccgttgctggtatatgcggtggtcggggtcaggcccccgggcgcaccgttgctggtatatgcgggggtcggggtcaggcccccgggcgcaccgttgctggtatatgcggtggtcggggtcaggcccccgggcgcatctttgctggtatatgcggtggtcggggtcaggccccccgggcgcactgttgctggtatatgcggtggtcggggtcaggcccccgggcgcacctttgctggtatatgcgggggtcggggtcaggcccccgggcgcaccgttgctggtatatgcgggggtcggggtcaggcccccgggcgttgctggtatatgcggtggtcggggtcaggcccccgggcgcaccgttgctggtatatgcgggggtcggggtcaggcccccgggcgcaccgttgctggtatatgcggtggtcggggtcaggcccccgggcgcaccgttgctggtatatgcgggggtcggggtcaggcccccgggcgttgctggtatatgcgggggtcggggtcaggcccccgggcgcaccgttgctggtatatgcgggggttggggtcaggccccccgggcgcaccgttgctggtatatgcgggggtcgtttgtggtgtcatcactgctatcttccaggccgggaggaaggaccgagggtgggcccggcgcgggtgggggtcctgggcaggggcggcggcgcggccgggctggtcctggcgctgggacccgcagctgcgccctctgcctgagcagagaccggggcccccacgctccgcgccagcacccggccgcgccgcggagagggaagggttacggcggggatgggggtgggggggttggcgggggcgcgactgacgggctcgggattggctcggcgcgcgcgggacccgggggcagctgcgggcccagacttcccggacgccctggcgcctctgctgcccacggcggccccgaggccgcgcccgcggagaggggggcccccatctcctgtcagccgcagtgactgcgggtgcctgacggcgccgccagcccggggggcccctcccggccccagcggggtctcccggggctgcctctgtcggtcccgacctgcctggtccctggagctggggtgggagtcgtgctttgatcagtcaccgggggcggggagactggtcgaccacccctgagggcccgggacttgtttgccacacctggggagtttcgcggcggcatctggaggggtcctggttgagcagctaggggggtgtctggtaaccagccgggcccctcaggctccctcccggcaggccctgaacagacagccagggatggaactcgccccctgggcaccctgtgcctgccctcagcctccccactgaggcccaggactttagaggtgggcgtgcccgccaggctgccaggccgtccctccgtgggcagctgagcaggccacagtgtggaagaggctccagaaaacccagccctgccgctgcacacgtgcgtggccagcagataaagtcttccttgttattgtgggcagcgtagctgcacctgcggtgaggccggcactgctgaagagatgtcaattcacagagcttgactatgacccaaaggtgaggtcaggactccgggagaggatggcagcggtcttcaggggaaactctccttttcttctgtctggacactggagccacacactcgcctgtccccatcctcccacagcatagggctcctgggacctcggccctgggcaggatttgggggatggccacgtctctctgagtgggctctgctcatggtcctcacaaggcccgggacatggatgagaccaggcttgcgtcctctgcctccccgccccactgtggctgtgccagcctccctgacaggggctcttccgtccacgtgcccctcctgggccactatcccgttataaacaggcaggagtcttccttccagcctccctctggggcgggcaggcagcacggcgatcacctgcccccactccctcatctatcaccctgaactgtgttcacggtaaaattactcatcctcagccagtgataaatggcatcagtctagagccagcccgcggcagggggtggggctccctgctcagggttcccaggcctgggccagataaacctggtgagctgcgcctttgtgctcacacgcagctggcaatggcaagtcagtggatttgtacgtgtctgatgtgtgcccttggtaaaagcacacgtgtgcacgattctgtgtgcatgtgcttgcgggggctgggggctgagggaggccatctgggatgtggggtctggatgtggtggccagggtgggcgctaggcaggcagcagagtggagaaggtatgtcaccaggagaagggacccaaggaatcgaagagcagggggagccactgagtggggtgcagggaagatggggtgtctgggagctcagcctcgtgcagagggagggaagcaggcagctcctgggtgcacgggtggggcatactctctacagattcaatgctggatttgtatagtgtatagattttcaatagttatttaaaatcatcaaaaacaatcgtgtttacaatttactgggcagccactatatgctggtcaacatctagaatttatcaacaattgtacaagccaagtattttatcctcatttctacagaggataaaaccgagaataaggaactttacattgtcaatgatcaaacacctagtgcacccatggccgtgcgtccgcaggacaaagcagcctttggagccctggaacttaagatgtccagagatcagcagctctcggctcaggcccaggcagctggacagcacccagcgcctcctccaggtcctcctgggtcccctcctttctttcactttcagcccgggaatctctgtgaagtcctagctgataactaaggggttaatgaataatcacagtgatgagctctggaggagccatggcccagagcagctgtggcctcctttgattaaaccacagaagtccggaggatcaggcctcaaacctccaccacctgccagctggcacctgtgaaggaggtgggaccagcacccacctcacagtggctgcagggtcacctgagatggtgattgcaaagtgctgagccatcgggacacatatttccaagacctcctgagtgccggctggcccctggagcagagatgagacccctgtggggcctacagtccagttatgaaggcagggttcctgtgtaagccagcaggcccagttctggaaaggccaggatgtgggttcagaagctcaaggacaatggactcattctgactggagggatccaggaaggcttcgtggaggaagtggcatttgacattggcatcaaggatgaacaggaatagagagaggggactggtgtctgcgtgaaggatcgccaaagcgctgttctggggtgagggcgatcagcccctcctgcccctcctgaactatgaggctcgggagcctttggcagaaggtggctctgcacgccccaggtgcaagcttggagcttccttttctgcactccacagcaggaagaagggcagtgtgaactgctcaccactgtcttcctgggtttgcagctctgcgcctggcacagagacaggctcagtgacggttgaaggaatcggagaaataatgaaaagtgtgttcatcctgcaggcagcagagcctcgggttaaccgttaacgtcaggaaatgacagatccaacgctcctgcttggggcagcgtggaggccagcggaggaactgcaggagcctaaaggagatggcgcgcgggcctggctcaggagagcagccgtctgaaagatggcggcgaagggtgcgggaggagatgccccgggcaggggcttggcggggtctggcaccaaacttcccaaagcagctgcctctgtgaactgtgcctggcagggagggagccacaccgggagtgaccctagacgctggctccccaggggtgactggaggcagtgtctcccgcccatgtgggcctccggcttggggtccccagagctctgccctgctgctggctgcactgagagaggtggccttctgaatgggccctgtccccggggagcctctggtaaagagattcacctgcaccctcaaaacacgccatgcccattggaggctctgggtgcaggctgcccctcaaacagagaaaaaccacacgctgtttaagacccaaaccaaggagacagcccctcatgcccccttctatctccccttctgtccagggccccctgcctgctctggtccaccccgtcctgaccccctctgcctgttcatctgagggccgtgagccaaggcctgggcctggccaagggtcagggatcctgggacctgcttgagaccatgccccatacactccttcggccagaaggtcagccgtagagacaaacccccaccctgagcccgcagtgtcagcaacgccctgtcctcagtgccaggcagtgtcaggctgagacccgggccacctgatccaacgtccactccaagcaagccagagccaggtgctgccagcctgcccatgtgcacacgttagcagacaggtttcctggtgtggcacacacgtgttatgaccgcggctgctgcccccagcccagagtgcacttccgggtaatccagcaccctgaggcttcactgctctcctgagagttttctaagattaaatctccttcacaatgacagcctcctgtcacctgggccctggtgacaaagcctttggagaggcaaggacccagccggggcattcacagtgggcatgctatccaccctccgcccctgtcctggcccccacagtggagccgccaccttgggtaacaggggctgcctgaggtcctggagaaggaagaaccaggtggcccaccttcggtgcacagggaacagcagggacctgacggcagcccccgcacccctccctgggctgaagttcaggctgtctcatcccttgccaggagctcagggctgagctaggttggcaggggatgggttgagggtctgttgtccagcagattgcccgggccccacccaggccactcagaaaacacctgtgagagccccgcaggcatgcagggcactgtcgtgagcacaccagtggggacagacgtccaggcaggagggagcagccagacccccatcccgccagggtcaccaggtgagcaaggctggggaacaatggaggcggagccccgcgactgcccagctcactgcccccagtgtccaggctgtggtgcaggcgtggggacccaggtgtgttcaggggtctccttcagggaaggagaccaagctgggagtctggggaggctgaggtgtgaggtgacagcaggtaaagagtgagccacaatcagcattttcacatgaaaggaaactacaggcctgggcgcagtggctcacgcctgtaatcccggcactgtgggaggctgaggtgggaggatcacctgaggtcgggagttcgagaccagcctgaccaacatggagaaaccccatttctactaaaaaaaatacaaaattagctgggcatggtggcgcatgcctgtaatcctagctattcgggaggctgagacaggagaatcacttgaacccgggaggcggaggttatggagagccaagatcgcaccactgcaccccagcctgggcaacaagagtaaaactccgtctcaaaaaaaaaaaaaaaagaagaaagaaaaagaaaaaaagaaaggcaactacagaaggtgaggagaaccacccgagatcaccagagggaaccgtggaaggtccgtggtccaccagccaggctggggcacctcagcccctgggcagagcaccaagcagggccgtgccctggtaaaggagggcacagtcagccccagactacaagctgccttggtcctcccagcagggcttaaaagcaagaccccaaaggaccaaacagcttccaagtaacttcctggagtcctgagcaaagtaagcttttctcagctttgctacaaaaatagtcagcacccagcaaaattcacaatccctgtcacccattcaaaaatcaccaggcatgcgaggaagcaggaaaaggaaaatgcacccagaagagaaggagcacccatcaacggggccgcctcagaagcaacagacgaccgggcaagtccaagggcaccgaggcacctgccaccactgcgcccagcactcccgaagccagagggcaggtgggacataggtggggacgttctgagcaaaaacgcatgcggccaagctggggtcgcccgtgggaagagggcgaaacgcttgcacgtgggtagggcagtctctgcaaagggctgtgtgggctccgggaccagatgctgtgagggcctcaccagctgcgaggtggcaggaccagatgctgtaagggcctcaccagctgcaaggtggctgtctctgccccaccccacacgctcaatgcatgttaatttcatcttgtttcattctcattcccattttacagattgaggttcagagaagtcagaagccttcccaaggctgcacagccagaagtgggcacagcgtcctggggtgagggctcacaccatctgcgccacctgccctccaggtcccaccatcctcacaaattcaaggcaaggttctggaacccccagccctccagaaaggggaagctgagcccaggaagcacatctgagagttcgggtccgtgagtttaccctgcgctcacgccgattcctcctgcatcctctgtcgggatgtctggattccagagtccccaccctgattttccaaccttgcctcagccttggcttctcccttttggggtgggacagggaaccccagcagcaggtgtatgagggcatgagagggcaggaggtgccctatgcctacccgccagaccagggccccagccctggacacagggagagagcatgagcgctgttcctgctcccactccctcatctgagcaggtgctcccaggtacaggtgccgagtcccacccagaggggccctgccacaaccagaggactgacaaacccagacacaactgtctcttccccctggtcagggtctgggcaagggtccctctgggctgctgtccatgctgtgagtgtccgtgctgtgggccactgccgtgggtgtccgtgctgtggcctgctgtcgtgggtgtccgtgctgtggcccggtatgtgaggttgtgtttccaacagggagtaatttggctttggttacctgagggtctgaggacaggcactaaagccccacctttctggcttccagagttgccggctccagcagcagcctccaggcctgagcaggctctggggctcccacacctggggggccagggtgggggtgacaaagggccccaggcgacggctgagagccggccctgagccggccagggcgggcagcagaacagccaccagctcccgccaggccctggcagcatgagcgatggcaggcccagcgataagaaactaataatttatgcttccagctcccggggccggcgccgagggaaggttgggccacagcctcccccgcactgagcggctgcagtcctttattgcacaaattattaacgaccagagaatgaatgactctgtaatcagatcaggttgccagcacttttcattgcatttatttgtataaattctgaagtcggggtctgccctaagctcagcaagccagcgtcgtgctggctgggcgcccaggcccccacccagaaggaacacccgtccctcaccctgcccacgggttccagaggacagagggctcaggaaggggtgcagggaactgctctgagccagaagccgagttcataggcacccaaagcagccctgggccagggtcagagctctgtccttgaacctgcctcagggaagattcccaactgtcctcagagccaggggcacccagggcttgggagctgaaggggggtgggtctgagaccaggagaaggctccccagccctgagggaaccctcatcacccccctgctctcctcgatccaggaaccgtcccagggttgccccaggcctcctggctctcccgcctccatcccgtgggcttcccgggagccccaggctggtctcccacctgccccctccttttctggtcttgcctgggctgggcccaggggctctggctgtgggttttctgtgcagcacctcgcagtgagcctgacgctggtcctctcctgagcccccgtttaatcttattgacctctcgttacgctacagagcgtaaattcagatttagagatcttatgttccatcataaattgggctggcagacttccgatcaacaagataaagctgtcttccgtgaggctggtgttttattagtcttggtcccagtgctgcaggtgtgggctggggagtgcctgagggaggggcctctgcttgggacccttcctgcctgggcgaggggctgagtccctcctgccgcccgggctgggccccaggtacctggcgaacaaagggaccctgaaattgccgcctttcccctgcctcttgggctctgcatatgatttcagccaatccctgctgcccagcctcgcccacccgcttctggggccacccccgcgttaagcagggctgtgcagcatgggggtcctgttctcattcagccaccggcacggccaccccagtgtgattcctcagcagccacacagaagacagatggtccataggagactcagaaacagagaagcctcacgccaggtccacagaggcacccacgcccgccaaaaggatgccacgcactcaccctgccctctggggagcacagtgggagtccaggacaccgccttggatggggtgaggctccgtctgtgacctcagaaagtcagtctggggctggacttgacatgggaaacagaataaaactgcctgtccacctgagcttgccgccctaaaaatccctgacatgatacagaagtcagtgctgacagagggcctgctacccccagtgaccctgccggtggggtctcaacccacccacttcttctggagcagccggtcacagctgtggtcctgctggcgcacacgggtatgagaccctaaaacacacagcgactgcacagtgcaaccctgcatatcccatttgggtacaagtttcattacaggaagaaacacggggagggaccccagagcagctcacgcgtgggtaccctccgctgtgttagcgtcccggccctcacacggcacccaggcctcgttggggcaaggccttgtgcagacacggtgggatctgcatgtgcactggggcctgtgcctgggctgctgctccccggccaccggtgtcaggatctccaggacccccatgagtggtcagtggagcagagatggcacagacgccagcgacctgggtcattctctacctgggatgtgggaccccagagaccatgctgtgggtctttatctgcctcttcatgcaggagcaggtgcgacccccgcctgccccagccatgaggctctgtcacaggggacctctgtggcaccctgtgctgcaggcaaggccttaggacagatgccacgccactgtccaggagactgtctcctgagactgacctccccttgcactgggcaatgtctgctgaagataaggacgtcttcactgggccaggcctggagttctcccagatcgtgagctttcctctctctgatgaagaggatacctgtggtcaaactcctacagagcactggggacaggaaggcaggcagagtcccacctgggcaggtggtaggagtggaaggagcaggcaggcagcagggctgcccagggctaggagtctggctgtgagcagggcccaccctcccctggacacaatggaggaccccgtgtgtggttttcactgactgagcacctatctcgtgccagacatgtgggattgccggtgaattaacaaaagccctgctctcagggggctcccatcccagcacatacaccgtcacatctggggtccagcctggacccccccatgcagttggagagggtctcagaaccaggtctgagaacagcaacttccagccacggcaccccacccctccccagctggcctgggctccagctcctcgcacctgaggctgcctgtgcagggcccccggctggtgcccctctcctctgaagctcgggggtcgccacagcctggcaccctcatcgggcctgttacgcacgttctggtctctccgtgcccacagacccgccaagctcaccagccaatgtgcagccagcacaagcccgacctgctaggggcctcagaacaagcggtgtggcccgaggccgtcacacagcacctgtgctgagagtgagctgacgtggacggcggcaccgtggccgtggcagaggcaccatccctccaccctcactcatgtagggatgtggggcacacggactggagcccaaggccttcgtgctgggccctggctctgcactcggctcccagagtctcccacccaatgtcagagagggtgccgcaacagtgcttcgggggctcctgtcatgagggctgaggaccacctaggcccacgtccgcccagcaggtggcagctgcatccccggtcccctccacaacccgggccaggtccaggctgcaggccgcagtgttggcagggggaggagagggtgaaattggctgagcccatccattgggacagaccctcccgctccttggggctctggagaactctattccttctctttgcttaacctcaaggtgctggggcctctggctgctgcagcatttacagaggaattgtctgggatgtgccgggccgagcactgtagctctcgccggtgtctgcgtcagcacgctagtgacatggcaggtgaggaccacggcaccgcccctgcgatctggcagtcagagcccacctgtgtgtctgcaggagcatccctgactacacaccacgggacggcagggaagggtccctcgggccccacccctttgttctttcaatggtaaaggttcaggtcggtggacagactggacttggaaacaccttcttgcgtcctcgaaacgacgtggcacgcagccagctcacagcacccaaaggcacgggcaagttgcatcacggcagcccctcctgtctgaccaggagcaggtgcgttcctgaggtcctggccacttctgcaggagcgtccgagggagcccagctgatataccacagcccctgacctcccaggttagcctttccatccaacagcaccaggactggacaggccaccttggctgaggatcacgtgtgcctgggtctgggcggtgctgatgcccacaggccctgagtctgtgttgcgcacaggccttggaaagcagtgcacatcctgtctgcaccggtgtctatagtgaagccatctttgtccgtgtggccatgggagggtctgtctgtgctgtgtgtgtgtcctgcgcgcgtcgggagctgctgcgccacacacaggcacgcagggtgtgggcacacctgtgcttctgagcccacgtgcccttgccggtggccaggcacacacacagctgtgcatccttggcccaagatcagctgtgccacacctgcaggctgcaggatcttttctgtatatctccctccatcaccagaagtaagctcaggactgaggctgacaggctggtctgagcgctgctcacctgcacctcctggctgcacctgtggccccggactcagcttccccatctctctcctccccaccccacctctgggtcatctccggctggggctgtaccacatctgggctcaataaatggttgattgattgatgaggggatggatgagaagggctctaagagaaatgctggggagcctgggcaggcactcccggatggcggaggcggcatgcgggctggggcagcggcccctggcgcccccacactcccccaggacgtctggggtcaccgtctgctccatggcagccccagggttatttatgacctcctccctctggcggcgggaggcaggctccagcctcagcccagcggcggaggggccccagcagggggacccggagcagcgacagaggcaccaaggcccaggcaggcggggctcggtgggccggaggaggggcggtggagtccacaccgccaggtccctgcctcgctcaggatgattccagcgccagaactccgttcctctggcctctgccgccagcctgaggagtgcaggggagagtggggcccaggtgtcccagaccaagacaggtgtgtgagtggacatgggacacaggtgtggtagtggaggacacgtgtgagcaagtgaacacatcacacagatgtgcgagcagacacaagacatgggacacaggtgcgccagtgaacacgggactggtgtaagccagcgggcatgagacacgggtgtgagcgagtggacacgggacacgtgtgagtgggcacggacagtacaggtgtgagcgagtggacacgagacacaggtgtgggagtggacacaggtgtgtgggagtggacacagaacaggtgtgaacatggacacggacacgggtgtgtgtgagtggacaggaccaaggaaggggcacaaccccgtggaaaagggtgatgctgggggtgaggagcctggtcctgtgggaacgtggcctctgaacgggtgcctgcttcccaggaagacaaggaggtggtggggaaggcctcctcacccagcccctggagggacctccagaacatcagggagtggacagtgaggatagaggggtgcctccagctttggacccagtcagggtcttttctggaagacaccatgggccccgggtaggcccccacacccagccagaaacccagggccagccccatgcccctccttaaccacactgtgggcctgagcatgatgagatgctggtgaacaggggagggctcttggaagggaaaggaggcccctctgctggcccaggtcagaggagaggcctggcccaagggcctcagaccctgagaggcactgccatgcagacctgcgcctccccagcctccctctccaaatcactgtgtgaacatcagggagtcaggtgcaggcgaacctagaaggagggtcaggtgcaggtgaacctagtagcccacacacgggcagtagggtcagggctgcatccagacagtgggcactcagggccagtccacatggcctccagctggccccaggagcagactttccacatggtatcagacctgggagaagacacagacttcaggagaggaaggcacaggaactcactggcagccacagctggggtcagggatgtgctggtgtcctggatgcagacaggttgatagggccaagggtggccacataaggaagggtcaccgacactcacacccacactcctacctggccccccagaccccaacagaccaacgagcccccacagaacagggccaggatagcgggggaggcttctgggcatgttccttgcctgagcagagcactcctggcccagacctcactccgcgggttggctgtgggaccagcagaagcctctggtgagataaggtgaaggagcccagcgtggtcacccagggtcaggtttatgctcaaggaagctggtctggcaggaggtggtggtgggctgttccctccctcgaagaaggcacctgtgcaaacaggcctgtggcccactcacccctggacctgctctgggagatgcccacagggacatgccagctgcatctcaagggcaggggccagggtcagaacaggaggcccctttctagtggatgcaacaccgcacagcagcgcaggacaaggctgtctcacctgctgttaccaacgcccccaggttgtgtttctcttcggaacgctccagatgcaatgccgatctgggcacgcagggaggtggggggtgatgggaagctcaccaggaaccagggactggggcccagactgacctgtcagaaggcaccaaggtggacgtggtgtggccggtcctgcttcactagccttgctcctcctagtgggaggccgtgcactctgccaacccgctatcccccaccctcaccctgcctcggatccacaccaccttcctgctgggaggtgtggggtgacaggaagctcttgccccacaccatggtcctggcgcggtcctggtgtgagacatcctgcatttgaaacagctgtgtgacttcaggagagttacttgacctttctgtctcagcgtcttctgcaaaagactgaacaggaactccgtggctcgggcgaactcactcctgtcaagtgcataggaaggggcacgagtgggcggggaggtgctgccctgttattcacagaacactttgcccaggcaacacactacaaatccacaacctcgctccctgcaggtgcactgagaccacccacgccctcccggacaccaacgcccaccatcagattcgctgcgcaaagtcccagagccgccggcgcacgctcacaccccggcgagcagcccccagctccctccctccgagaggagcccggtccgcgaccagcccagcccatcccagtcccgcgcggagtcctggattccagccgctcgcagtgactcggtactcgggatagtgccgggggccgcagccctgtcccgctgccgccgccggatgccccgagtcggccgtcacgcaccccccgcgggagcccgcgccgcccgccgcgccggggccgtttaaatgggccaagttgtggcggcggcgtcggcggcggagtctcccaagtccccgccgggcgggcgcgcgccagtggacgcgggtgcacgactgacgcggcccgggcggcggggcgggggcttgggacccccgagaggggcggggactccgcgactcctcgctgccgggctcggcctggcgggtgggtcggcgagccgggcgtgggactgccccgggcgcgggcgctggtggccggggcgcgggactccagacgccccggggagccccgaggccctggaactgcggcgctcggcgagtcgatccgggatcgatagcagctccatgtctccggcctctgaggccccgccggccggctgggcagtccggggaggcctggcgggcggcgcgtaggcggcggctgcgggcgccggggcgcactagcggacggcgtgggcgcgcggccaggcgcctccccggcccccgcgacccaactccagcccgggccggaataagttgctgccgccggcggagagcggggctgcggagccaccggggcgccatgccggcggtcaagaaggagttcccgggccgcgaggacctggccctggctctggccacgttccacccgaccctggccgcgctgccgctgccgccgctgccaggctacctggcgccactgcccgcggcggccgccctccccccggccgcctcgctgcccgcctcggccgccggttacgaggctctgctggccccgccgctccgccccccgcgcgcctacctcagcctgcacgaggccgccccgcacctccacctgcccagggacccgctggccctcgagcgcttctcggccaccgcggccgcggccccggatttccagccgctgctggacaacggcgagccgtgcatcgaggtggagtgcggcgccaaccgcgcgctgctctacgtgcgcaaactctgccagggcagcaagggcccgtccatccgccaccgcggcgagtggctcacgcccaacgagttccagttcgtcagcggccgcgagacggccaaggactggaagcgcagcatccgccacaaaggtgccgccgcccctcccttcgctgccgggacccgcgggccccgaccccaccccctacccgactcggacacccgggagcctccggctcggccgagggggcgctgcagctccagggctgcgcggggacacccccgccgcgcgcggaggcctcggtgaacacggacagatcgccccccgctgcacctccccccagcttgggccacagcgcttggggctcgcgggccgctccctccgctcggaaggtctctgcgaggctcctgggccttaaggcccgaaggaagtttacggggactcgagagagcgggcaggaggcgggttgggagggcgcggagccccgggttcgggggagactggaggggcgcacgtgcggccgggtgcgagcgcgcggcgggggaggctgcggggcggcgcgggggcgcgcgcggagcccgagcggcggcgccaggtcacacaacctgttttggcgcctgcgggcgcctgggcccaagggtgcgacgcgggggcgcctgagccgggacacagggggtgcggtgagcgccaggcgccgcggggagttaaaaagttcgggacctgagcggtgcgtggttccgcggtggccgcctcttcctgccgcgcaggccgagggtcccgacggcgccgctcaccgctccgggactcagcctttctgggcccggcctgcggttccctcggggccggggagagggtggagcgcgggaggaggggcgccgggtggggacgcccaggcccttcgtcgggggagggcgctccacccgggctggagttgcagagcccagcagatccctgcggcgttcgcgagggtgggacgggaagcgggctgggaagtcgggccgaggtgggtgtggggttcggggtgtatttcgtccacgagccggggagggggtactggccctgccgctgactgcgcgcagaagcgtgccgctccctcacagggtctgcctcggctctgctcgcagggaaaagtctgaagacgcttatgtccaaggggatcctgcaggtgcatcctccgatctgcgactgcccgggctgccgaatatcctccccggtggtgagatgcggggctcggttggggctgggagttactctcccctgcggagcttgtccctgcggttttcagggttttcaggatcgagagtcctaacctcacccctgcgggtgtgctggagggagcctccgaagggcagggggaagcggctttacctcgtgctctcccagcccttctacctggacgggggaggagtcctcgggcacccgagcgccctccccggtggagacaggggggccgcgcttgtcttagagcctccccttgggtgccttttagctgcttatcctcgagtcctgggtcagggtcttctccctgggaggagtaattcaacgtgggcctggcactgtgccctgtcaccgcttgggggtcaccgtgttctctggcccagctggtgaggtgtgattctgggacgacagcattttggggagctacaggcttgggtgtgagtgacttgtgtctctgggtgctgaaggccagagggtgcaagggcctggacgtcgaagtgtgtcctagggacgcagaggctagccaggggcagagtctttgcagtgtgggcctttggtgtccagggaactggagtcggaggctggttcaaggccccaacccagggtagacagctatggacaccctcactgagggagcaggcaggagagacggggatgctgggagctgccttctgctcagggaggcacctgcaccccctacccagtctccagccccctagttgggcagcaagggttagaggattgatctgaaaaggaagaatgcctgttgggaaggactagtttggagccaattagggccatggctgctgggggtgggggctgcaattcctgacacactcaggaaccccttcttccaggaaagggtaggagaggcagaggtgcaaaatgggcctgagggtcccgggcgtacctccgcttgcctgctttgggcctgaggtaggatgggggaggggatgcccaggggcctgtgagccatgagtgccgtagccagggagctgggcggctgcagacacacctgtgaagacggctggtccctcagacatacagcatgttgggcaggggaaggggacacagccgcacctcacccatgtgcccacctgacacacaatccgacatggacctgcacgcacaggcaggcagctcacagagttcccaggcaggtgtgcagacagccggcagccccctgtctgctgtcacagacctacccggggcaagaggcccagttccctcctttcaagcagctggtgctggagagggctcctctgggcagcccgctgcctagccttgggtctctgtttggatttgagcggcccccttgagggctcccccaggagtggggagcacacagcctgagcccagcgtcagtctcttccgacagtgcttccgtgagcatctcctccccaccccgtggccacagccaggagatgcccccccacctggggctcccaggtccctgccctgcgtgagggacggctcagatccaggcctgcctctgccagtccctcccaggcctgtcccacacccttcccctaggaagcaactccaggggccccttctttccagcccccatgtttcttactcagaggctgtctcccccaagccccatgccaaatccgcaggcatgtgcacctcatggtcacagatgctccggggcagaatatgagtgtgtatgtgccttggggaccctgcacaggggccctgcaggccaagcaccttccaagaggaggtgctgtcaggggccgagttttcagatctgtgtgctgtggccgaggtctctagtgtggaggaggtgtgttctgtccttgggcagggtgggtggcagggaagctgtcctggtcctcagcacccccatcagccactccagacctgccctccaggtgccttggggcgtggctggggtgccggtgtgtccccacgcccgactctgcgcatcacggggctgaggctggtatacagcctgggctccattcccagccagccctggcctccttccaaggggcagtcttctggtccttgcttccctctcttccccatcccacagacaagaagcagagagcaaagcattgtgtcttctcctcaaaagaagggaggtgggaggccgggtgtggtggcgcatgcctgtaatcccagcactttgggaggccgaggcgggcggatcacgaggtcaggagatcgagaccatcctgactaacacggtgaaacccgtctctactaaaaatacaaaaaattagccgggcgtggtggcgggtgcctgtagtcccagctacttgggaggctgaggcaggagaatggcatgaacccgggaggcggagcttgcagtgagcccagattgtgccaccgcactccagcctgggcaacagagtgagactccgtctcaaaaaactaaaaaagaagagaggtgggagaggagaggctgtcagagcctctaagccctggtgcttgggctgcagaagggcagagctaagcgggacttcccagcacagcacactccggacaggctgtggctgttgaagggacccccgagctccagctgacacgcggaggcccgggcacagacaggcatcataccttcggccttggccgcactctgtggtcattggtgttgggggcagcccagggtcagggcagggtctcagcctcggaccccaggccccaccccttgcccagcagtgctgcgttttcccagtgagctgtcgtggagagagcagaggggacccagcgcaggcccagtggccggtgaggggagacgtggctctgggacgggggcctccacctgggtggggggatgctccagcttccagacccttggggagggggcactgcccaaactaagctggcactggggctgtgcatttgaaggtgatggtggttctaggtctgaggaggacaccctcctaacagcctcatccccaagctccgggctgtgttgtggcaatgggagggaggaagtctgaggagaccctggtgactgaacggaggagggagtgagttagacgctctcaagggctctgccacctcccggagccagcggcctgttactacatttaaaaaagcctcccgcccactggaaaataatcaataactttcctttatccctgggggtggcaggacctagaaacactggaggagtccggaagtgcctggggctgggccggcgctggtgtgctgtgcagggtgccgcgggcacgtccgccgcgtgtgtgcgtcagctcggggctcggctgtgctctgcagggaccacagcgggcgtgtctgtgctcccacccgaggcacccacagctccacacgctcgttccgtgggtgcaaaggagatgggagaaagaagccctgtgagaaatgcggggcagggtttgcggaacaggggacctgggctggtgagggctcctcgtctggtgacctgtgagccccggggcctgcagtctgcgagggttcagctcagacagttgccagtggccttgcaccaggctgcagctgcccctgagccgggctgtgcgtggcgctgatgaaatagaaaagggcattcgcttgtcaacgttggcatcggtggcagggtgtggtgggcagaagggtcacaaagtacgggtgggattggcaggcagatacacggagggaacgtgcgcatttgagtgcacgtccaccagcaccagccccaggccacaggcagatcccaggagacacgcaggggccctaagaagggagctgggaatgaggggccacacaagcccgggacggaggcctgtcgcacatggggtggccccgactcaggccctggagttggccaggaccctctagcatcctcaagggctgggccaaccaggctggcgtggggtggggcaggggagggctgagccagtgggcgtcgtctgtagggggatgcccaactgcggccccgtctctcggctctcctctgggtctctggccagctgtggctcctgctggccccaggcgcatcccagaggcaggtagagggaggatggctgctctgagggcacctctgccgtgcttggggctcggcctggggtgcgagaccagggcagacccccgggagatggaacggcccggtccagccccaccttcctctcctcctgccccaccttcctctcctcctgccccaccttcctctcctcctgccccaccagaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaaggtacttggaccagggccggacaggaaggcgcaaggctcagatggggctggagcttcaggccttcagctgctcagatgagagtgtccacaccggcctcccacaccttccctcagatgctggtctttttggggtcctgtgtgggtcgcaggcaggagctgtttcctcatctgccccctgtctggcgtcccctcccacctctgctctgcggcgctcactggcagaggcaggttggcagcagttgggacccagaggtctgcaccttcctgggccgacgctccagctacccttgctgaccgggtcccagtctggccagagagcagctctagcaacagggagctccattcaggctcgtgactggctgtgcagaagcagcctcggcccccacctgcggtacaacaggagggctcctctgagtgcacggcaacaagcaagagggagaaggggcctcggtcctgttcttcctgatgcgtgtctgctgaggccaggagctggctttggcccatgggcctgtcctagtgggaggccccagcatgttgagccagtagcaggtggtgctgggcatggcagccgccctcgttcactgcccagggctgtggcccagcggggcactgacccgagacaggtctgcgcacgccctgctatcctgaggctggggtcaggggcctccagagcaacatggaccttctgcttcccttcctgcagagtccacacccactgggacgtgaacatctctttccgagaggcgtcctgcaggtaggagccgtgctgtgcgtgcataagagggggccgtgactcccctccctccctcccacccctgaccgtgccctgctgtctgctgtccgctgtctcagcgtgagctgatgctgtgatgctggctgagtgtctgccaggtttgacatgtgctgcaaggttgtcccccatcccgggaggcagacagtgttgcacccagttgggactgagggaccccagacccagtcagatgcagctctcggcagcagctcaggtgtgagttctgggcagcccggccctggagttagagtgcacttcctcccatgtgagactggccatttgagcccaaaaatgaggctgtcacctcccccttcccaccctcctagagacccacaaggaggtgagaatgctgatgtgtgagtggggccctgaagggtgtgtaggagctctaaggcgaggggatgtctgcagagtagaggaacagggaagggcgtgtaggagggacgaggagtgaacctggcagctctggttcagttggatgctgaagagtcatggatgctgggcctgtgggcaccgtcctccaggcgggagccaccgaaagttcttgagcagggcagtgaccaggtgtatgtttggagaaggtccctctggaggccttcctggcagacaggggattggattcaggctgtggaagcaggacggtagggggtgtgattccaggatgtggaaaggagataaaaatgaagagccccggggaagaggtcaagggagttgggggacccgagttcctggctccagggggaagcgagtggtaagtctgtgaacagagcccagctgtggattctgtcaatggggtcaggtctcaccctgtggcttccagggcagcaaggcaggaaggaggcgtctgccacaaggccagcttcctggggccagagccgtgaaggcccaggggacctgcgtgtcttggctccacgccagatgtgttattatttatgtctctgagaatgtctggatctcagagccgaattacaataaaaacatctttaaacttatttctacctcattttggggttgccagctcacctgatcatttttatgaactgtcatgaacactgatgacattttatgagccttttacatgggacactacagaatacatttgtcagcgaggcctgtagggaaacccagccgcggtccccccgaccccgctccagtaacggctcctcctgcctgcagccccctcctccgtctgcctggcctcgggaatgcagcgtccctcggcagcactgacggcagacagcctggggtgccctaggaagaggccaggtcttccatcctgcacgggccctagaaggggctaggatgagtttctgaatctcccaagggcgagatttcggtcagaggggagggcgtgctggggtccccggaggagaaggcccagcacacgcctgagtggactgaagcctccgcctgttgacctgaccctggtgtccggtcagagcgggtggtggtccctgaacccacacgggctcccagaccatgtctgtgtttctttcagcctgtccctgggtccttctgcctctgcaggctcccacagaacacactgccaggccacctccatctgtgtgttcatttgctcccgtccagtggtctccacccatctgtccgtctgtccttccatccccttcgccctgtctggctggctctgcagtgaccacctgccttttggagccagcggagccccaggccgtcctcctctgcctcaggaacccggggtggcagatgctcctcgagccattgtttgcaggcgggggcttggcccctctctcctgggcccctgagctggtgggaaaatgggcaagggctaggccgtgtggtcatcaatgaggggcggtggcgggaggcccatgcgtgggcagctggggtcacacctgccaggctctggcctccccctccccctctccttcctgcgcctcctgccccagccctgactgcttctcccagcttccccacctcctgacctgcagcccggccccaccacagagactctcaggggcttcgtcccttgtgcgaagcagggtgcagagggcattctgtggttcgaggaccatgcgctgatgtgcccgggccgggttcctgcttctccactctgggacgtccagggcgtgtttctttacataaaactggcataactggctcactgagtggccaagtgaccagaacaggttttcaggggccgggccaggccaggctgtgtcggaacctcaggagcaaactccaaggcagagaccaggggcggggagggcaggtggcacccagctccccaccaggtgccactgcccagccacagcccctccacccagctattaggccctccctcactttccttctgggcgccaggctcggggctcactgccagcccccaacctctggagtctctgggaaactagttctcctcctgcaggcgtcctggggacaccagaggggggacccctggggagaactccatggcagctgtggctactgccaggccagccctcagcccccaccccatgctgaggccagcagtcctctcctgacacccccgcgtcgattaggatcatggaagggatgagtctcgctgccgattaatcccataaagtacttactcccacccagctgccttcctatgtgcctggggggggcttcctttcccactgggagccggtgggggtgggggagagccgtcatctaggtctcctggaaggtttagagcccagcctgggagtctttggtgctgaaacggatctgcttaggggcagccttggattagcccagctccagccagcccaggtcaggggagccgggagctatttaacgaggtttagggtaggctcctaggtcactgcgcaggactgctccgttacaggtgggcaggggaggcggctgcgttacaggtgggcaggggaggcggctgcgttacaggtgggcaggggaggcggctgcgttacaggtgggcaggggaggcggctgcgttacaggtgggcaggggaggcggctccgttacaggtgggcaggggaggcggctgcgttacaggtgggcaggggaggcggctgcgttacaggtgggcaggggaggcggctgcgttacaggtgggcaggggaggcggctccgttacaggtgggcaggggaggcggctccgttacaggtgggcaggggaggcggctgcgttacaggtgggcaggggaggcggctgcgttacaggtgggcgggggaggcggctgcgttacaggtgggcgggggaggcggctgcgttacaggtgggcagggggggcggctgcgttacaggtgggcgggggaggcggctgcgttacaggtgggcgggggaggcggctccgttacaggtgggcgggggaggcggctgcgttacaggtgggcgggggaggcggctgcgttacaggtgggcggggggggcggctgcgttacaggtgggcgggggaggctgctccgttacaggtgggcgggggaggctgctccgttacaggtgggcggggggggcggctgcgttacaggtgggcggggggggcggctgcgttacaggtgggcgggggaggcggctgcgttacaggtgggcgggggaggcggctccgttacaggtgggcgggggaggcggctgcgttacaggtgggcgggggaggcggctgcgttacaggtgggcaggggaggcggctgcgttacaggtgggcaggggaggcggctgcgttacaggtgggcgggggaggcggctccgttacaggtgggcgggggaggcggctgcgttacaggtgggcgggggaggcggctgcgttacaggtgggcgggggaggcggctgcgttacaggtgggcggggggggcggctgcgttacaggtgggcgggcggtgctgcaggaggactgctcagggagtggcgcctggaccctgagccccttctctgctgactggggagaggctcacggaaccgggaaggggtggagggccgtgctccacacagttcgtctcattgctctctgggactctgtggatgtgggattgggctgaattagcaagaagaggagaaatgagggaagaaaagagttaaatgcatgttgattccaagcccccgcctgccggggggacagcgggaggttggagcacgcagccctggtgcctggtgcgagctgcacgtgtctgccggtgccgtgtgtgcgtggggcgcgtctcatcagctgcaggactgtggtctgggcctcagtttcctcgtgtgcagaaatcgggggtcaggggatggttcacatgtggcacattctctcctggggcctgtcctgcaggactgcccctgagcagatcggcctcttcccgggcgcccggtgggcccctcgaccccctttgaggcagggagtgagataactgtgattccctgtggagggcgtgaaggcagagccggctggctgctccacatagaccctccctggagcagccgtggggtcccaggtcccagtgccaggttctgtgtcgctttgactcgggtgctgcgtgggtgtgcacacagtggcgtcacgggccacatgccgaggcgtgggcacagcaacgtggcactcagaggtcatccccacgctcacacacagagctaggcactccctgtgcccaggctgggctccagcctcgcagctgcccacggggtcagcttttcccggtctcgttctgcagccaggacggcaaccttcccaccctcatatccagcgtccaccgcagccgccacctcgttatgcccgagcatcagagccgctgtgaattccagagaggcagcctggagattggcctgcgacccgccggtgaggagcacagggggcctgagggcggggtcggggctgtggggccagaggacggtggcgtctccactcagcaccagcagccttggcaggcagccagagaggcaggaggagcggcctgtcccccaggggctgcatgggatggtaattgtgttaatcccagccagcggggcagacaggaggcagaggcggtggctccgctgtggctgccgctggggtgggcttggagtagccggggccctgccaccccctttccacagggcagacgtaggcgtggcctcagaggttcagaaacgcacaccctggaggaacgcacgcactcccgcagcgcacgcatgactggtcccgcctcctagggctcctggacggaaggggtccccggtcccgcctcctagggctcctggacggagggggtccccggtcccgcctcctagggctcctggacggaaggggtccccggtcccgcctcctagggctcctggacggaaggggtccccggtcccgcctcctagggctcctggacggagggggtccccggtcggtcccgccttctagggctccgggaaggatggggttctcgggagggaagggatccggcgcctgagggaggtgctgctgcctggtcacagttgtggggggaccaggcccccctcagagggcactgctgtagagaggggcacagcagagcctcagccccagggcaggccgtgaaaggaggcgggggcgccccgaggccctgtggaccccaggcaggggtgttcccagcagggcctgcatctcttgggaaggaggggtgggggaggcccacccccatctgtgtcccccatccatggcccccatccgcgtcctcgtgcacctaggaaggcccttgtggggctgggtgggggcagcttctgatgccgcgttggagacagctgagaggcggttgataaaatctaattgccccatcgatccagcagagcggagggagccccacaatgattgagatattctgagccagcaggccctcccctgtgccttcacacagggagacctcctcaggtacacgcgtgtgcgtgtgccggcatgtctgtgtctggggtcctgtggggtgcacgtgatgggggttgcccggcagctctcacccatggagtcaggacgtgttcgtgcacttccgggctcacaggctctacggggcctcacgtgtcctggacccgtgtccaggtctcccatacgcactccgtgtcagggtctggcccgctccccggagcctcctcttggaggggcattcaccctggggggcgttcacctcttctcccttcctgtgaccccaggaaccacacatccatcctgttcccagcccgggccctcccgctaagccgcacctccctgggccctgggctgtgagggactcagagcaggtcctgcatctgcctctgtgagacccgctggggtccatgagtgaggagtgagcatggcctcatcggccttcctgcggtctcattgcaggcccccttccacctgcccccccccccacccagtcacctcccccaggctaggaggaggccttagccccccacagaacggagagggtagtttccactgtgtacaatggaaaagtgattgccaggaggtgagaggccttgctaaccctgagggcatgtgcatggtgggccaggtggcaggtgtggaaaagagccaggttcccccagccttggcccaccccctcccagcccaccgagctctggcacgggaggctgtgggggagacgatggcttctcaggggcctgagcagtggtgcctggatccgtgtgtggccaggtgccccccgccgcccgccgggcccagccacccgatctgtcaccgaggtggggaccctggaccagaccgtgggactgaccctctctctggggccgggcctgacagcagccgggccaggatcaataagttattagcaccactctgtcagctgtaatgtgggattgatcggtgtggccgccgcacttccccagcctgataaaaatgacagattaagggaataagaaaaaggaattaggcctggagctgacggcagggcttgtggggggacgggcttgggagccccactgcctaggcctcatggaggtcttgggtcacaggggagtggcccctcactccacccagctagagccctcatgaggatgaggaagggccagagtcggaggcactggctggcctgggagacccccagggcgtggagtcaggggcttcggaggagctcggggtgggtcggagatgggtacatggatggtgtggtctggaatgggtgcggtcggcaggacccaagggaggacctcaggagagtgagctgggcctggcctgggcctcccctctgccacctgctgggctgtgtttggggctgaagctggacctggcctgggcctcccctctgccacctgctgggctgtgtttggggctagggctgggctggcctcgtggctgaggaggtgggtgaagctactgggaggtgcaccccagaagcccagagcctggctgggctggtggacaagggcatgacagccacgccagggtgctagctcaggcaggactgggccagagaggaggacgtgggccttctgggggcagggatgggtatgaccaagtaggaggcctgggagtggaggcgcctcgaggcggcctggggggcccacagcccagtgactcacagagcagcaagaggtcaggtgtgaggtccttcccggcttgtctcaccccacgctggcatgtgaccctgcacagcccgccctcactcctgtccaggaggggaaggtggtgcctggtcaaaccaaaagctttttattctcctctagggggatgagaggggggctcgttaacttgcacaagaggctagatggcgggtggggcagctgggtgcctgctgtggatctcttctgcacacacgcaccagggccagtgtcagagctcccctgtgcccctgtcccgccacagccaggcgtgatgtcctctgcgctgaaggctggggctgccagggctgggcaaggcctgtactcaccaggaccaagggccccctgagagatggtgggtgcggtccaggctgagctggagcaggggctgggttccccttccattccttgagatgcaggtgggcactcactaccctcccgcaggtgacctgttgggcaagaggctgggccgctccccccgtatcagcagcgactgcttttcagagaagagggcacgaagcgaatcgcctcaaggtaagagcgtggctgggacgagagacaggtcaccaggggagggggcagtccctgagggtcccctggacctcgagcaggcactctagaggggcgtggtcctcggcagtgcctggagaaacctctcaccccgggtcctccccagcagaggcgctgctgctgccgcgggagctggggcccagcatggccccggaggaccattaccgccggcttgtgtcagcactgagcgaggccagcacctttgaggaccctcagcgcctctaccacctgggcctccccagccacggtgaggacccaccctggcatgatccccctcatcacctccccagccacggtgaggacccaccctggcatgatctcccctcatcacctccccagccacatgtactcggccattcctgttgctgaggccctgctgacaccaaggccaggctggatgcaggtccctctgccacacgtcctgccccatgccccctggggcgggccacacctccatgtcccctaggtccccagggtcatgactagctcacattttatatagagagaaatggagtctggggtggacccaggtgagggtgggcagtgggcatgtcagcagcaccccccgaggagagcaagctcctggaccctgtggtctgtgagtcgtctatgcagccagtggacgccgacctgccagacgcctgccccaggagcctggggaggggcagtgagcagaaaggccgggctgggtgcagtgggcacttggccaccaggactccccaggtgctgaagagacgccagctggaggggctgccccttcccccgggtcggccctgaccctgtccaccccacctcaggacgttctccaggggtccctccgggatgcactcggaccccctgcccgctgcactcagcctcccaggccccagccgcccgcctggcaggggagcttggcttttcgggctagaggtgggtgggggcgccgggaaaggaggcaggattcctcacaccaggcaccgtcccccagggcagctcaggcaccaagagcctgaataattcaccaaatgttaataatgtaaaaatcctcctttttaattgctttccctgctctgcctggggccgctctgctggccgcgcgggggaggggcgccggccgccggggagcgcgctgtcaatcaggccgcgccgccgccccccccccccgccccgccgcggagccggccgtaaataaccctgtaactaacccggccgctagcgcgggggcgctgggccccgctgggatcgatgcgggcggccgcgccggctgggctctgcgggctggcacccggcccggggcgggacccacctccgctttcgggtaattaatttataaacagaggcggcggtggagctggcggagcctgcatagtgggggctgcggggactcgggaggcccgggcgggagggagaggccgagagacctgggacgcggcgccttagacgcgggcgctgcgtgcgcattggggcgagtgtggccacgcgggacagtgaccctgcgcagccgggactgggcgacccctgtgctagtgtggcgtgcgtgcgcgggcgctgccttgcctttgtgacaagctttggccagccgcgtctactatggggacctcagattttcttgcctcccaccgaagagggggtcccctgggcggtcagcccctggctggcacttctggactctctcgctgccccgcaggctctgtggcctcgggacgtctgcacagccccctccccgcaaggctcagccgcctctcaggccggaagcctccaggcacccggctccccttcggggaagagcttttcccgacacttcctcgcccagcatcttgtctgccgtctcggccctgtggccgcccatcctcctgccccgtgcccgagaccagcccaggggccgagcacggccgagtggtgtggtcagttccccacctcagtgttctacgccaggacgcgggctggggaggatgagggcgcatagccggggggatcactgctgttgtcccccacccagatctcctgagggtccggcaggaggtggcggctgcagctctgaggggccccagtggcctggaagcccacctgccctcctccacggcaggtcagcgtcggaagcagggcctggctcagcaccgggagggcgccgccccagctgccgccccgtccttctcggagaggtactggggtggctgccgttctctgcttgtttctggggtgccgcccgcacccccgcgctctcagccaccagcacgcgccccgagagtgccaagcactgtgttcagctctaggttcgggtccgggcagagcgtttcgggggtgacaccgatctgggctgcagtgttgagggcgccactggggtgcgtgagggaggctgaggcccatcagggggttccctggaggagaagccagagaaggggagagctccaagtctggaaccccggggtcagtcgggaggggtcggccagaggactcagagctggaggcggagggggggtcctggctggcgctcaaatgtagacgccggcgccggatctgttcccggcacagacaaggcctccggcacagacccgggtttctcgggtccaggacacgaggcggggcggggcgcctggagaagggaggggccgcctgaggcccgagtccctgcccggccgctgagcccggcgtctgcagctgcctccaccgccgcccggattgcggctaatgacgcccccgcttcccccgccgctcgggtccgcaggggaggggagcaggcggggccggcgccccgcgcagtaattaccgctgcagccgtcgccgcccgccgggtcagcgcctccgcgccgccgccgagattaattggcgccgccggcgggggcggggatggcgcgcgacctggggccgtaacgagctgcgcatcgaccgcccgcggggccggcaattagcggaggcggcgggggaggggcgccggggcctttacgggaacgggggcgggggggacgccgctcattgcgctgccgtccacagggagctgcctcagccgccccccttgctgtcgccgcagaatgcccctcacgtcgccctgggcccccatctcaggccccccttcctgggggtgccctcggctctgtgccagaccccaggtgaggaggcgggtgcgcatcccctgggagcccgcgtggaggctcgcggacccggccctgcccctgtcggagccgagacggaccgggtaggggattgcaaagggccggctcggaccgcctcggaccccccgaccccgcgttgtccccctccccaccaggctacggcttcctgccccccgcgcaggcggagatgttcgcctggcagcaggagctcctgcggaagcagaacctggcccggtaggtgcggggaggcgggcggggccgcgcggcccgggaggcggctgacccgcgtctgcccccggcccaggctggagctgcccgccgacctcctgcggcagaaggagctggagagcgcgcgcccacagctgctggcgcccgagaccgccctgcgccccaacgacggcgccgaggagctgcagcggcgcggggccctgctggtgctgaaccacggcgcggcgccactgctggccctgcccccccaggggcccccgggctccggaccccccaccccgtcccgggactctgcccggcgagccccccggaaggggggtcccggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggtgggcacccccacactctagatccttccagagggcacaggactggcaggccgcctgtggaagggtcttggggggaggaaaaattccccttaggcacccatcccccacctcagcaattggggcacacgacggtcaggagacgggcgggtatgggaaagccagccagagccctagtaacacgccccacaactcaggcgcggtagggggactctccatggatggggaggaggccccagcccctgaggacgtcaccaagtggaccgtggatgacgtctgcagcttcgtggggggcctgtctggctgtggagagtacactcgggtaagggggggccccagttcctggggcggggctggagctggctggcagtcactacctccctggaaaggatggtggggtagggccattccccaacgccctctccctccccaaaagcagtgcgcagcagggactggactgtgcaccccaccttttttttttttttttttttttgccaggtgttttctgcctgacactcaaacccaacagatcactgtttttaaaaaatttccgtgagctgcacaaacagctcctcttggctctgctgggctggaggatggagcagcacccgggtcctgaccctccctccctcccccttccaggtcttcagggagcaggggatcgacggggagaccctgccactgctgacggaggagcacctgctgaccaacatggggctgaagctggggcccgccctcaagatccgggcccaggtgagacgctggggagtgaggtcagggtctccagaccacagctgggcagaaagctctgggtgggtgtgcgacagcccccaccaggccatctctctgcaggtggccaggcgcctgggccgagttttctacgtggccagcttccccgtggctctgccactgcagccaccaaccctgcgggccccggagcgagaactcggcacaggagagcagcccttgtcccccacgacggccacgtccccctatggagggggccacgcccttgccggtcaaacttcacccaagcaggagaatgggaccttggctctacttccaggggcccccgacccttcccagcctctgtgttgaggttgccgggggtaggggtggggccacacaaatctccaggagccaccactcaacacaatggccctgcctcccaccgctttatttctttcggtttcggatgcaaaacaaaaaattttaaaagaaaatgtgacttcaaaggaaaggaacaaattttcaaagacttgggggagtgaaggcagagcctggtgcagatggacgaggtctgcagacggagggcagaggtggtggaaggggccaggggcctgcaggcctccccctggaactgggactggtctcggtctgctgacgtcagggtcagctcccccgcggagctgacttcagcagcccacagctgtggggcttcagcagccacaccagcccagcccagcccagctctcgatacgtttggtctttcatgctgaaaaataaataataaagcctgtcccgtgtctactgcctcccccaactgcacagacgccagcctctaggcctgactgccagggaggtggaaacactggccaccagcccggcagcccctacaggccccccagatgggctgcctcagtcgtcctctgagagctgcagatcctccagctcgtcctccggcccctgggccagctgctgcagctccccaggggccagccccgcctctgcgtctgggtctccatctgcggggagagatggaggctacataaattttgctttatcaggaagaagccagccttagaggttactcatcactaattaatcacggcactaattaatttatccctgttgctggctgccagagaacagagcatttggcctggccttcccagggagggaaaagcctggcccagagccccacgccccccgcccacgtggctctgccctcccgccagatgggctcacagggccacaccctctcaccccaagaccattcaccctccgagttgctgctgtcctcctcgccctcctcctcgtcctcttcatcgtcttccaccccatgccgagtgctcaggggcctcagtatccctgaggaacaagaagcagagtccatatgactcccacccacagggtccaccagcaaagtcacagtgggggcaggagggtggccaggctcccaacacccttccctccgctgacttccagcaggtggagaggagccctggggaggaactgggaggtcacaggcctggggacagagttaccaatcccagtaggccttcacttcaaggagggaaggcgctggcaccagaagcctggcaacactgaggttggccccagctgggccagagactggtgagccccctgcaggatgggtacaggtggccctcgtggctctgggaagtccagcagagccctccaggcccacccttcccctgggagcaccacgcaggccccacctctctccgagaatccctcggtgtcgtcctcttcagagctgttcaggtcaaagaggtctttaaattgcttcctgtcctcatccttcctgtcagccatcttccttcgtttgatctcagggaagttcaggtcttccagctggaaggccaaagaaccaggggctcaggtgagagagggcaggggctggcggccacagcagggccaggcatcgccagacccaccaccagggccccatgtggccaatttctagtcccctctgttcccaaatcacaaagccatcctccaagttgtccatcccatgtccaaggtcaaaggcagagcccttcctgcttctcctcacgggcccctggtgcccacatactggcctgggtgacgaggtcagtccagccactccacctgcccggagcctccagcccatcaggcctgagggggcatggcctccccaacctagtgcagcctggggcttcccctccctggaaacgcctggttctggccagttctccaacacctaccccctctccaagtcgaatcatccgggcacggccctggccgcctggcactgtttccaaaccctcgccctggtctcaagtcatagtgcgctagatctgaaacccaggaagtcacaacacacccccaggtcccctcgccgagccgcacccgctctttgccactgatctccagctggatctcccggtcacgcagcttgcgccagtggctgtagtacaaggtcaggggtgtcccctcttcccgggtcagcttctcccaggcttcctggggggttgggggagttcagggtcatgcctcaccctgggcaaacccccacatgtagctggggctataccctggcaggtgccctcaggtggcactacccccagggcccactaaccactgcctgctgctcagagacgccgaaggaaaccctctggcggcggctgcagatgtatgccgagttctcctgaaccttcccaagcagctgctgcacctgccggcagtagttggccaccttgcactcccggaggaacgacttcagctgcggaagggaggggtcagccactgaagcccaggaccgctccatgtgcacagctggcccaggtcctgtgcaaaaccacgcgtggtggccacggggataccccaggaggggacatggatcccatctcagggctcaagtgcatagctgttgcagctgggatggcagaggcagaatcagcccaccctctgggccaaccctgcccactactcacctctggaaataaagttttatgccaggcgtggtggctctcgcctgtaatcccagcactttgggaggctgaggcgggtggatcacctgaggtcaggagttcaagaccagcctggccaacgtggcaaaaccccgtctctactaaaataccaaaattagctgggtgtggtggtgggcgcctgtaaacccagctccttgggaggctgaggctggagaatcgcttgagcccaggagatggagattgcagtgagccgagatcgcaccattgcactccagcctgggcaacacagcgagactccatctcaaacaatactactactactaataaaatacagtctcgctgacgtgcagccacacgtgtgcattgcatggttctgcagttgcctgtgcagctgaacatccgtaggaagccacgtttaccatttggcccctcaccaaaaacattttctgacccctaccccagaccccgaccctgggcccttgagtccagaagcagagatgccccaatgccaggtatcaccacccaagaggacatgggaggaacagaggctgtggcccctgctgtgagtgccccccagaaagggggtcccggctctgtgcatgtgacatgtgtggccgtgtgtgagtacacacacatgcacacacctctatctggataagcctctgaccaattgtggctcatgtgagcagatccctcctccccacactgcacagacctatagtcggcacatctgattccagccaccagggccagacagcagggcccccaccccttccactaggcacaggcctccctgaggctggaaacatcacggctgagagcaaacagacctcccgtgggggcccagaaggaccttctgaggataaggagaaccccctcctccaccccactcctgcctaagatgaggctgacgtggggtatttagcggggcaggctgggccttcctatgaggctgatgtggggtatttggcggggcaggccaggccttcctgccacctgagaagccactccacccactccccacacccgggatggcctggggaagtgtgcgatcagcgtaccagcctgagccagggtcggcatgctcagtcccaaccccgaagcaaagatcagccttgtggttcccacctggggaggaggctgttgtgctcccagggtcctcagcccactgcccaggcctgcccccaaacctcctgaatggcttagaacccctcatcagcccctccaagggggcctcacggggcgcgttgccagcagtcaggttccaccccagtcccaggtacccgggacaagggcacctcctaccagcctggggcagccaagcccgttataagacagtctgagtcggccacgagccggtgtgggcaggacacacacctgcaggaccacaggcagcaccagctccgggaagccgatgcagtgtgcctggctgtgcaggtactccagggtgaggtcgtacagctgctccaccaggccgtcctgaagagcaggagagagggccgagtgcatcagggagaggctggggctgggcactcaggccccttcccctcaggctgtcagggcagcgccatctccagggcacggactgcaaggaaggggctcctgggccccagccctgggagaccatgaaggtccatgcttgaacttggaggatgccagccccctcccatccacctcagcacccccaaccccaccctgggaactgcccaggcccctccccaggaggccagcctcacccggtacgccttctcctgcaggttgacattggacagcttcaggatcacggagaagttgatgggcttggagctcatgcgccctggcttcctgttgaagtcgacctgctggaacatctgccccaagggccgtgtcaggctctctcggccccatgcctggtcaccctggcttcaccctggctgcaccctggtccccctggtccctttggccctgcacctggctgcaccctggtcaccctggtcctcaggcttcagcacgaggagacccaacccgaaacaagagataagcagctaggcacggtcccagccccatggccccacacagcctggcgtgtccccgagtggggctctgatcagcagggaaggatcaggaacacgggccctctcccaaaatcctgggaagcactaaggacccacgtctggagacctagaggtccctgccacacagagtaccaggacagcccccattcctgacaacatggcactgaggcccatcctggccctcagcacagcaatgccacatggggctccgtcccgagcaaccagaagacgcagcagcaacagcaaagagtgccagacacaggacgggacagatggaggtcacgggaggcctggggggcccctcccacaccctccacagaagccacaggccatgcacctccgtaggacatgccaggaggagcagagaaagagtcagcctggcctctcagtcttgtgacccctccccaaccactaggagccctcaggctgtgaaccagagagatccagggtacatgctggggcaccagaggacagaagcagattatggggggcccaagggtggaggccccagcaagacaccccactcagcaggggtggctgccagacagctgagctcaggtccagatgggaaaacgccctggtactgatgaacctctgggaggacactgcccttctctagcctgggccaaaagtatgggcaggcgactggcttcctgtccaggcaccggggaagggcaggcacggcctacagctgagggctttgttttagcttttagggtttgctttttccggagaggagaggcctgcatccctgcgtgagaggggcctacagggtgcggctgcagtgaaccagggcagtgcacaagtgaagaaacagacactgcaagagagtaagaaagcacgtagccaaggagattggacaagggaaacagacacaaagcatgcctggagctgggcagcagagctggaggcccacagacacaggggccaggccaagggctgggcaatcagagaccactgctggctgccatgggagtgaacatggcttcctaaagatgttcagcatccctgcctcagtggaaggggaatcagaacgtgcctggggcttccataccttctggacccagcaacctggggacccagccccaaggacagctgtgacacgactctgggccttcatgaggctgagaactcattagataaacagggtggagatcgtgaattcctaaatttacagcggggtggggcctaacccacccactgaaagttgaaacttcggactccaatctttccctacctgagtggcatgtgcacgtgcaaagatgcatacacacaggtacacacaggcgcacacatgcacaggcacacacgtagacgcacgtacatgcacacaggtgcacacacgcacaggcacacacaagcagacgtgcatgcatgcacccaagtgtacaggtacacgcacaggtacacacgcacagtacacacatgcagatgcaaatgcatgcacacaagtgcacacagacacgtgtgtatgcacataggtgcacacaggtacatagatgcacgcagacacacatgcatgcacacagatgcacacatgcaaaggttcatgcatgcacaggtagacacatgcagacgcaaatgcatgcacacaggtgcacacacgcacaggtacacacatgcagacaggtgcacacaggtacacacgcatgtgcatgcatacaggtacacacaggtacacactggtatacaaagacacatgcacaggtgcacacacgcaaaggtacacgcaaaggtacacacatgcatacacacaggtgtacacacgcacagatgcacacacctgcaggcacacaggcattcatggatacacgtgcatacacacatacagatgcacacatgaactgatatgcacacacacacagatttacagacccatgcacccagatggtgcacacacacgcatgcatgcacagacaaacgcacccacccagatgtacacacatcccccatacaaatgcatacacatgcacacaactgtcagggcagggcactgttcagtgtacagttcagcaatcagacttgggttttggcccatctcgcctcctgcctactccagtcttgggcaagcacctacagggtcaggtcccggcatcctcaagcacagccctagcagcagccgccttcatccccagtggtcccacgttccccaacactgcccccagcacacggaggagcactgtcctcgtgacacccgtgacaaggaggcggccagggctccgggaagtcgccggacaactcagcacagacgcccggagcagcagatgctccctacaggagcaggcagaggtgccacacgcccaccacagcctcactcacctccaggatgaaaggcagcaccgggatgaaggcccccgagctccccgagagcagcgtcagggcacggatgcagtgcattcgcagcgggtagaagcgggcagtggggatgagcctgggggtgggaaggccgagtgagcagaggccccggctctggcagcccctgcccctccccctgctgtcttggacctcctcccccactcaccgacatcagacccctaaagcaggacaaggcacgtctgaaccccagggacctgcaccccttgcccagctatggggctgcaggtaccttacccagctttcagctttatttcaacacggtggcaggggtcatctgttcctgcctgctctcctccctgttcccgcctttcctacttcttcccttggacttcccacctcccttcccagccttgagtttctaaggctcagccagacagatgccccctcctggccaaagaggccacagtactgctcccaccttttcctgctgcagcccctaccgtgcctggaccctcctaagcgctcacacccaaaatgcagttcactgcatcagatgtgctccacccaagaaccccacgtaatgaaccaaactcactgcaaactgcacacaagcccccagaacacacgctgggtggcacccgaggcggctaaaccgctgttggaggagctcatgtcacaggtgcccaccagccctagctctccagaatccagagcatctccccgtagcaggtacagggaccccagcccttcctcagggacggccaggacacagactcaggccccaaggccctgaacgccagaggcaccgcccacacagtcccagcaaatttgcttctcctgaccctcccgcacaaccctgcccaccccacaactcacttgatacagccaatgatgacttgggcaagggggtagaccaagggctggagggcttcgctggggcccgcagtgctcaggacccggcaccacaggaagaggcagtgcacatactgccagttgtacacagactggtatgtttcctggtcagagagaaccacgtcagctactggccaggctgacaagtcaggctgatgcacgttcctcctgggccggcacaggaatcatttcctcatcttgcacacggggtctcaacccatccacccttcccccacctgcaaggaccgactgcaccagggtgctgggctgtctccagacaggggcttcggggaggccccaggccctgccttgggtcgggcacctgggctgccccaccccatgcccagcatgagcctggaagggccccaccacacaccttcttgcgagtggtcatggcgttgcgcaggtgtatggcgagctggcggatgtagaggaaggcgtgctggtaggccacacccggctccagggccagcagctccgtcaaggtccactgcatgaaactgatgaaggggagggcaccaggcgaggtgaacttgcagttcctcacatacgtgatgtacatttgctgcggagagacccgggtcagagccacctgggatcagggccatgcacctccaccgcccactccagggcccctgtgaacacctgggcctttccctcagagctgggcctcgaggaagagccgtagccccttgcacagcccccacccccaagtgcccaccagcctcaggcctgggagaagctggggcagaagctcctgctgcacactgggcccctctgggggctgagggtccccacatgcaggccacccatggcttggggacgggcagtaggactgtaccctggccatggcctcaggtcccaacacccagtgtcctcctccagccagagaggccctcccctggggaagctgtgtgaagcagggtccaggtggggccctgagaaggccgagggctctcttccctgcccaccacccccaggtgctctgtgagacattcgtgatccaagggcccaggtctgctcagagctgcagtgagggtccagtgaggggcaccaaccacaaaggcagcccgccctgcccttaggccgagatttccaatgcagatgctgagggacacagacgcagggcccaccactaccttgaggacggggccaaggaaagtgtccttcttgtgccggcagactctgctgaggaccaggaaagccagcacccgcagagactcttccccagtgctccatacgatcaccattctctgcagaaggtcagacgtcactggtggccccccagcctcctcagcagggatgccccagggccagcacagccctccccagccaggcaaaggctcccatggccaccagctcttcccaaagcacctcgggggagccgtgagttaggtgctcagttacagaagtgaacagaacaggtgtgttgctccttgtgagaagaggaccacaaaagtttaccacgtcagacacgccgacgtatgtgagatcacaccgggaagaagatacctcaccgtggctttgctcacggactgagccgcgctgcccgggcaggcagggactgcctgagacagaaaccccaggtgggggtgggggccaggtgcttctgtggcctctctagccaagcggagccagtggagtgtgggcaccacctgtgccctggccaggagtgggatgtggtgggggtagccgtgtggccccccgaccccatgacagacacagggaggggactgggccacgaaccttgagcagcatgcggcactgcttggggaaggtcaggaagcagggcaccagcacgctgatgtgccgcagcacggccgccaacaccgtcgtctccgacagacaggacaccagctgggggcaggaggggacagtgaagccccaaacccatgtattctgggatacaaaaaaggaccgaccaccagatacagccaggcccccgtgccctccccaccagaatagcacctgtatggccgagcccaggtaagccttgatgtccacacgaagcttcccccagagcgggctgctggacggctgcagcatcctgcagagagaccacccacccctggctgggaggccccacggctcggacgcgaggctgctcagcatgttggcgcgtgccctggccagcatagcctctacgactctgcagagaccccccgtctctccactcaaaaaagctcagggccccttacagctggacagacacaggggcttaggaggaccctctcaagtgcattagctcctccttcagtggccttgaactcctgtctgccctgcccagggttggccaccgccctaagagtccccggaagtcccagcctccaactccctctcagacataaaccttttctaggtccccttgatcacatccccaccgtgagaccacacgaggtccctaagcccagcagctggtactcagcacctctggggtcgcccaggcaccaccaactgccgcagactggtttcctttggcccacatttgctgcacaaagaaaagaaaatcagagggcaggtgtggagactcatgccagtactcactgcactttgggaggccaaggcaggaggatcaaactccaagcccaggagtttgagaccagcctgaacaacacagtgagaccccgtctctacaaaaatatacaaaatattatccaggcctggtggcggagtcccagttacttgggaggctaaggtgagagaatcacttgaatccagaaggtacgtgtcgcagtgagctatgatcactgcattccagcctgggcgacagagcaagatcctatctcgtaaggaaaaaaaaaaaccaaaaaccaaacaaacaaaacaaaacaaaacaaaacatttaccagagcccacgcagtaggcgctcactaaaatctgctgaagcatgggaaggacaaagggcagggccccagaaaggccccccgtcctcgaccctcctcacacctgtgctgacactggctgctgggcacctgcagctgcccacccagacccaggaggcagctctgctccccacggcctgactccctccggtacagctgctgcctcgacaggggtccctgacctggtggctcaggctgcagtgcgtgctgcctcccaatcgctgcctgtccctccacccccatctgccagcttccttgtccccttcggacagcactgcctccatgtggacatggctctgttctatccgtccagccccgaccactaccaccagcaacagtgcccctgtctcctgagccgctgtcggcgagacctctcctgtgggtctcctttcttcctttgaaggtgtcctggggcagttccaactctaggcctccactgcctcaaggtcacatggctgcacagccccggaaccccaacgtgctccatgctctaccaaatgcttggccgtgcgtctctcttctctgaaaaccttccacggccttctctgcccaatctttctctaaaggggaagttgaggccctcaggttctcagcattgatgaggcccctgtctacagacacacacagctccaggaaacaggccagtcatagtgcagagatcaaggagtatggacaggacttacaagttcttacaaagggaaatagagcaagaaccctaacctgggaaaatctgagagcaaaggcagctgcacacgccacaccttctgagactctgagcagacaacttcccttttcaggaaggaaagaaggtggggccgctccaactggccccaagtgcccagcctctcccaacggtccctcgtgccccgctgccttctcagggtccccaagaagacgctggctctgttgccatgtctctgtcctagccacaaggcctctggcttctcctgtgtgtggtcccgacccaccttccaccctaccccccttcaccccctcccctcttacctgctgctatcctttgccacctttccaaacagcagcttctggagacagccaatgaggtctctgatgcagaaggtaaccagagcattgaatgctgcaacgaaaaggcctggatgtactcacgggacagagaacgcaacagacagcctggatgccaggctccccccaagctcaccagcactgtccgtgacctggaatttgttggcctcagcactttcctggtcccctcgggtggtggccacagctgctcggaacgcctgtaccacttcatggaacagctttggagtgaggcgttgctgaaggagcaagagtaccaggggcgtcaggggagctgagactgcacttggcagagtggaaacggcagccccagagaaaggcaccctcaccctcaccctcagacatagggcagaggttggggggaggcacagagccccatactgataacaaaaatggaaacaaagtctagaattctctgggaagaggagggagtctggctcaggagccccaggaaaaggactgggagttccagatcctggactatggccacctccaggtggtatctggagctctccgtatccttgtccctggaaaaaaacactgtgagaggctcagaaggaccccagctccaccaaccaacaaaggcacagtccgtcccacccacagcgggactgactttggggagtggggcgccaacagagcccctggaatctacccaaaagtgaacacacagtcctggggcaaccaagcaagcaggaggagcaacgtgttgtcacttgcgctgaagaaggctccaagcgtcccctgcgtggagaacagcccctcccaccagcacagcctcaggcgcctcaggtgaggcaaggccagatctctgcctgggcacccagctgcccgcccctcgctgctgctcacctcaggtgaggcaaggccagatttctgcctgggcacccagctgcccgcccctggctgctgctcacctttgctgcctgcttccatctctcaaccatggcgacggtcacaggaacagaattcttcttccccttcagccctctggggactctgtccccatcttctccttcctccgctccatcctcctcctcactggcttcctgcacagaaaggctgagctgaaggagagtgtagagacaagtgccccccttctggtttggcccacgccctcacctccagcacatctggcagggagtggaacggcccctcttcctcctcagagctgtccgagtcgctgaagtttagcaggctctggtcattctcctgcaggaacttgtagaactcggggtctctgtccttcagccgagagagctggtctttgtgctcagaggcacggcctttacgccggctgaggaggcagaagtcagcgaccccagtgggaagtggaagtagagggggcggggagtggcctacagggtcagtctactcccttcacaagggttaccaactagcaagacaggattgccaggaggtacgtttttggcagactcacgtctcctacccaacaacctctacaacataccctcaaacacactacacaggccccccagccgcggtcttccctggacttgctgtgcctgcgccctgcgctacacaggcccccagccgcggtcttccctggacttgctgtgcctgtgccctgcgctacttttgcctgatggtggcttcacccttccagaggctcagactaaaggcaaatctctgtctctaatacccagcacgcaacttgtcatcagatctcatcagcaacaccttcaaaaccgttcgtgcctcctctcaaaccaccacatagttcaattctcagttaacctaaaggtctctctgtttccacccttgtcacctacaaggcactccaccgctcaaacccagaagtaactccctgttttacgaggcaatcttatgacggtctacggcacctggctcttcatcacccttctgggctcatctacccctattcaccccctcactcctgccgtagccacgtttacctctgtactctccccaaatgctcccactgcaaggcttttgctgttttctgctgcctgaaatcctaagacacgtttcccctactgtctgtgtggcctccttgttcgaggtctttattcagacgtcatcttctcaaacaaccacctccgcttttttttttttttttttttctcctgaggcggaatctcactctgtcgcccaggctggagtgcagtggcgcaatctccactcaccgcaacctccgcctcccgggttcaagcgattctcctgcctcagcctcccgagtagctgggacgacaggtgtgtgtcaccacgccaggctaatttttgtatcttttgatttctttctttttctttttgagatggagtctcactctctcacccaggctggaatgcaatggtgccatctcggctcactgcaacctccgcctcccaagttcaagcgattctcctgcctcagcctcccgagtagttgggattacaggtgcccaccacgcccggctaatttttatatttttagtagagacatgatttttccgtgttggtcaggctggtctcgaattcctgacctcaggtaatctgcccgcctcggcctcccaaagtgctggcattacaggcgtgagccaccgagcacagcctccgctccttctaacagagcaactcggctcccctgcaactctctcttcagcccctctgtccttcctttccctccccagcacttatctctcttctaccgaactgcaggcggtgatttcacccaagaacgtgagagttctcctagatcgggaagagatttttgcacaactcaccaacatacgctccctgcctaggacagagtttggcacggaacaggagctcagtaaacatcggatgaaagagtaagttaagctgaaaggactggggggcagaggtcggcgatccttaggccttggccctgagaccccaggcgaggtcagcaacccaaccggggtgggacaggacgagcaagaggttctgctcacgcatgtccccactaacctggccgaggggctcccgcccggcttatccggactccgggcagcctcgcgtgcttcccgtgtctccgcttgtggagaattttcggactcggattcggactcggagtcaaagcccgaagctaggaactcgtccaccgtcagctccgccaggcgcctgcgggtcacgcaggagtcacagctgcccgcacgcccagctcgccccagccccgctgagaggagcaagaaaagcccccttggatacagacacccaccgggaggccaaatcggccctcggacccgcggcttacctcttgcggctccccgcagctgccatgacaccaacccgaagcgtgcaccccacttccggccccagaatgccgcgcggctgcgcacttccgccgcccaggccccgcccctttccccgccccgccgcgccacgcccagccgagtggctctatggttctccgaccgcaacgccggcggcctcagggcgggagggcgcgttcgcgtgctcggtgcgggcagccccggtggggcccagatgcgcctcccgctcggcgcccggctccgtaggacgcggtgacgccggtgtccgccccggggaagaccgggagtcccgccgcgcccgcagcccacccggcgctccgaaggcacgcgcctgcgaggacgccagactgcaacggcggggctcctatgcaaagagctcccacaaatcaacaataaaaagcagggagtccagtggaaaacgcgaggggcagtgggaaccgcactgatgtcgccagctcgacaaaagacgggcgacccgagggccaggctggcttcgcctccgatccgcggagaccgggccagcgccacgaacaccacgcagggcgctccccgtccatggccctctgggtgccgaccgcggctcttcccggggacgccgcacgggacgaagacggtggggaggccggcgccttccttcccgctaccagcctgacacccgggcccccgggcctggacagccagaccccgcgacaagggcgccgcggggcgcaggcacggctcccccagccctggcgctgagggggcgcgtgaggcgaacacgggcggattggcctcggggtcccattcgacttcttggtgccgcggggccccggggctccccggaggagagcaagttagggggtcgggggagcggggatggcttccgggggaggaggagggcgaggcctggggggctcctcggaggaggaagagggcgaggcttaggggggctccttggaggaggaggagggcgaggcttaggagggctcttcggagaaacaggagggcgaggcctgtggggggcttcccggggaagaaggaaggcgagacctaggggggcttcccggaggaggaggaggaggagggctaggccgggggcttcccagaggaggaggatggcggggcctggggggcttctcggagaaggaagatggcgaggcctaggggggcttctcggaggaggaggagggcgaggcctggtggggggcttcccggaggaggaggatggcggggtctgggggtgcttctcggaggaggaggcggacccggggcgcagcgctggaagaatccgcgtccaacgtctagtccccgaagcctctcgggaggcggggcgggcggcgccgagaaacagcggctgcgggcgggagcggcgggagtgagcgacacagagcgggccgccaccgccgagcagccctccggcagtctccgcgtccgttaagcccgcgggtcctccgcgaatcggcggtgggtccggcagccgaatgcagccccgcagcgagcgcccggccggcaggacgcagagcccggagcacggcagcccggggcccgggcccgaggcgccgccgcctccaccgccgcagccgccggcgtgagtgggcgggggtcggggcgcggggggcggcctcgggacctgcgcggcccccgccctcgcgtccgctcgcagaaggggcgggggccgcttccgagggccgggggaggtcgggactcaggtgcggagcggggtcggcccggagtaggttccccacccgcgccccgcgcgcccaggacgcgactcccgctgcggtcccgagagggcggctagggacgcggaggagctgagctcgtgggggcgccgggaagcggggccggacgcggggctctgttcgcggctctgactacgccccaggggagcaggggcgcagcggaggcctggacacggcgcgctccggggcgggggtccttggcggaggtcaggcgagggctgccggcgcccccgtcgcaccaggggctgggtccccgcgggctgcccgggccccccagcggctccagggcgggcgggcggctccagcggggcgaagcctgacccgcccgcctcctgcagccccgaggcagagcgcacgcggccccggcaggctcggcccgcagcccccatggagggagccgtgcagctgctgagccgcgagggccacagcgtggcccacaactccaagcggcactaccacgatgccttcgtggccatgagccgcatgcgccagcgcggcctcctgtgcgacatcgtcctgcacgtggctgccaaggagatccgtgcgcacaaagtggtgctggcctcctgcagcccctacttccacgccatgttcacaagcaagtacccgcctgggcggcgctgggggctccgtgggtccctcgggtcagctcgtgtaacccgctgtccccgcagatgagatgagcgagagccgccagacccacgtgacgctgcacgacatcgaccctcaggccttggaccagctggtgcagtttgcctacacggctgagattgtggtgggcgagggcaatgtgcaggtgagggctccctcacccggatcccggtgtcccccgaccctgtgcctccctcacctgcctctcggtgccccgtagactctgctcccagccgccagtctcctgcagctgaatggcgtccgagacgcttgctgcaagtttctactgagtcagctcgacccctccaactgcctgggtatccggggctttgccgatgcgcactcctgcagcgacctgctcaaggccgcccacaggtacgtgctgcagcacttcgtggacgtggccaagaccgaggagtttatgctgctgcccctgaaacaggtaacagctggcgggcccagccctcgccccccaccccaccccaccccagtctttgtctttgactcccgaccccgttttgttcctgacacagccctgcccacaatccttagtgcctgctgtgtgtccccgagacctttctggatctgggccccccaggagcctcgtctgtggctcctgactctgctcggcccctcccagtatgaacactcagcccccacctgctaaccctccctcctaggcatcttcagggctccctgggtccacaggaccctccccagatctcaggtctgaggacccccactcccaggttctggaactggtctctagcgacagcctgaacgtgccttcagaggaggaggtctaccgagccgtcctgagctgggtgaaacacgacgtggacgcccgcaggcagcatgtcccacgggtgaggcgcggccgcggggggctcccacagcatccaggagggcatgcaggtggctgagggcctggtgcaccctgaccttccccgagttcagggactccgtgggggtggtgcccccacctgtctgaagaagaatccatcacacaggtggtacgggcatctggggggttgtctcagccctgacgcccagtgtgcccgagggtcccgcctgaccttggcgttccctgcaccccagctcatgaagtgtgtgcggctgcccttgctgagccgcgacttcctgctgggccacgtggatgccgagagcctggtgaggcaccaccctgactgcaaggacctcctcatcgaggccctgaagttccacctgctgcctgagcagaggggcgtcctaggcaccagccgcacacgtccccggcgctgcgagggggccgggcctgtgctttttgctgtgggtatggccccccgcccgtttccctcttgccctgtgccttctactccccaccagcacaagcccaccccacctgtgccggtcaggtcctgacctgcccctccgcccctccattcaggggcctctccaggagcctggggtgtggcccagcagtgggatccactcacgagtcccgtctccacctgccctccccaggcggcgggagcctgtttgccatccacggagactgtgaggcctacgacacgcgcaccgaccgctggcacgtggtggcctccatgtccacgcgccgggcccgggtgggagtggctgcggtggggaaccggctctatgctgtgggcgggtaagcctggaggctggacttgggtcgggtctggcacgtgcccgccaggccagtcttgacctgcagtggcttaattccgctagctatgatgggacctcagacctggctaccgtggagtcctacgaccccgtgactaacacgtggcagccggaggtgtccatgggcacaaggcgaagctgcctgggtgtggccgccttgcatggactcctgtactcggccggcggctatgacggggcctcctgcctgaacaggtagttggggttggggccccagtggctttgtacagtccatctgcaagaggcaagtttgtgtcaccatcacaggggtcgtatctgatggggtgttaaaggaggtgatccgcgaggccgtttcaccccaggccactgccacactgggcctgaactcttggctttgctgccccagtgccctttcctctctcgggtccttacccccagtccagaggctgggcccaggtgggtgtgcacccagggttgttcaggcagccagggtcctgtgcccaccagcgggccctgcctggtaggactttgcggtctgagtttgactcctagggtaagatttcagccattccgctggggagggcaggtcctggggccgggacgcctttctgtctctgctgagctgtggctgcggtcctggtgcccacagtgctgaacgctacgaccccctgaccggaacgtggacgtccgtcgctgccatgagcacccggaggcgctatgtgcgagtggccacgcttggtgggtgatggggcctgcctggggggcatccccaccttcccccaccgtggagaccccactcccagcaggagtgccacgggtgtgttgacttccggcagatgggaacctgtatgctgtgggcggctacgacagctcctcacacctggccactgtggagaagtatgagccccaggtgcatagtgcacccctcctggccaccccctcccgtgcgccgcggggccctcctccctctgtttacccacatcccccccattcctgacaccccaccctggagtcggggctgcggcagaggagggatgccagtggcgggtctgcgtccagcccacgccctcgcccccaggtgaacgtgtggtcgcccgtggcgtccatgctgagccgacgcagctcagcgggcgtggccgtgctggagggtgccctgtacgtggcagggggcaacgacggcaccagctgcctcaactcggtagagagatacagtccaaaggctggagcctgggaaagcgtggcgcccatgaatatccgcaggtccgcagtggggctgcggggaggggggcgcgggtccgcagtggggctgtgggaggggtccgcgcgtccgcagtggggatgtgctgcggggaggggggcgcgggtccgcagtggggatgtgctgccgggaggggggcgcgggtccgcagtggggatgtgctgccgggaggggggcgcgggtccgcagtggggatgtgctgccgggaggggggcgcgggtccgcagtggggatgtgctgccgggaggggggcgcgggtccgcagtggggatgtgctgccgggaggggggcgcgggtccgcagtggggatgtgctgtgagaagggagttctcccaacctcagcgagcatgtcccgccaccacccctttttgtggtgcagcccctccccccgcatcccttcctgcagccaggggctcaccccgccttccccccaggagcacgcatgacctggtggccatggacggatggttgtacgccgtggggggtaacgacggtagctccagcctcaactccatcgagaagtacaacccgaggaccaacaagtgggtggccgcatcctgcatgttcacccggcgcagcagtgtgggtgtggcggtgctggagctgctcaatttcccgccgccatcctccccgacgctgtccgtgtcctccaccagcctctgacccacctaccaccagaggcctgcagcctcccacatgccttaaggggaccgtggcccccaccagggacgtcctgcgccatccgttcacgtctctgcatccattccttcatgtctttatttagttgtttatttatttagttatttatcttatttattgaggggtgaggagtgccacggctgcccgtttacacctttagcgtctggtcctcctgcgtgtcctcccctccactgcctgcatggggggcgcggggagtgaccaggcgggggcctcaccgccccagggccgttgcctgctcagaccttgcaggctgtggagcaagaggccctgggtctctccaagcagctgcagaccccagctcgaattttgcacatggcggggtcccgggaagggtggggagcagttgtccttcctgtcgtcgtctgccgtgtgccatctttcctggatcttgtagtgggtgcacacgcgtgcactgggaccccacacagcaatacgagtccaacttaataaacacatttctggggttcctcaggctgagcatctctctctggcatgtggggcagctgcgcaactttgggtcctgtctggggtccagggtgaggggtgtgggggggtgccctgagatgcgcaggcatctgggagctgcaaggcagagctgtgcgtccagggagggtgggggccgtgcagttcctgtggaccagcgtcccagtgtgggtggcgtttgcctgggctgggtactgaggccgaggtccccgccacatcgtgggctctggggttagggctggggaggacagccttgcccccgagtgcgctgactgtcttggccgtctagggggcatgtggcctccctgagtccccttaagccttggggaccctgactcgggtctgtggcgagggggcccaggcaggaggggaggctgcggtggctttggccgccgtctcctgtgctggaactcctgcctcagccctccctgcagtcaccggtgactcgggccggccagagtttagatggaaacaggatgtgtgggcacgttgtcccggggggcctggaaggtcgccccgggttcaccaagccggagcacaagcaggtggggtacctctgcacactggaggcctcgtctgggccagaggggtgcttgccccaaggctggcctctcgagtggagggcccagggcagagacctgcacggctcaggtaggggccaggcctcttccagaaaggctccaccctcgcccaggccctggtgccgggcgggacgtcccggagccccgcctgcccgcgggaggcgggggcaggaggctgtggacagggacccagacttgccgacctgtacgactctggccatggggaacagccactgtgtccctcaggcccccaggaggctccgggcctccttctccagaaagccctcgctgaagggaaacaggtgagcggggcgtgggtgcggccacctgggcgcagggctcccccacccgctccggggccaagccacgagaccccttgccttgtccccagagaggacagcgcgcggatgtcggccggcctgccgggccccgaggctgctcgaagcggggacgccgccgccaacaagctcttccactacatcccgggcacggtgagcgcggcgtgcacggtggctgtggtctgggagcgtggctctgcccgcgcgtgtgtgccgtgtgtccgtgcagctcagggtcttcccctcgcccccggggcgttcagaccccggtaggtgaggagccgacgctgactgccccgccctggggagctcatccggccgaaagtctgagcggagagcgaaaccgcgacgcaggactgagtcagtcgggagagagctgggcggggcgggccgcgggcggggcctcccgggacctcctcccgcaggggaccagcgcacgtgtctctgtcgctgcagtggggcttggggtcgtgccggcaggtagtgtcacttgagagtaaggggcctcagatgagcagcgagccagccggtcacctacaccggcctttctccctgggtgtcccgcaggaagttgccgctgggtatggccgcctggtccacagcaatccctctgtgcacgcgccggcctcctcccagcttgccaaggccatgcagcaaggaggtgtctcccaagcacacactaggccacctctccgtcaaaggagcagaagaccacccccatgcccaccccccccccagcccctgtgggactaagggtcttcacagggtagatcccagcccctttcagatgtgtctggtgctgggatgagggaacaggaccaggaacctgggcttcagggcagacaggaacccccactgcacccccgtcaggcagcctggatgggtgggctccgctatgtgcaggccctaggagcatctgcgggagaggacgcctgccctgcactcctgggtccagcagctggcatggccgtgcagacccctttgccaacatgcccccgccaggcaggaagctcgtgccataccctctcctgacctccagagtttcagggctccctgcagacaagtactggtttcggaaaccacgctgcctcagaggagtgggcagggagagggagccgggctgggttaggggtggggtccctgtggctgcatctcagacaccactccctctgtccaggcccaggacatgcagtgtgaccctggggggtcctatgaggtgtggtgggtggccgtagtggtcctcccttgccaggacatggtagccacagaggcaacaacctgctgaacctcgggaaatggggctgggggaggagctctgggccagtcctagagccagtgctccgcggccctgtacctgggctctgcacccagtgctgtgagctggctctactacggctccaagctgagtcctccccggggccccgaggctgagctgcgctgcagggccagctgtgtggcccttcctggtctgtggcctatttttcatgggtgccaacccggcatcagttcccacgctgggtgtgggtacaggaggccccacccagaggcagaaggccgggaaagccatgcgtctgtctgttcacattcctgggcctgctcaggggcagctaagcttggccagggcacagcagctctgcaggtagctctcgccagctcctagaaggaggaggacaccttcccacttggccctgagcctgtggatcacagaggtctccagccccaggttcacacccgtc

SEQ ID NO: 443 - DNA, 11004 bp, Homo sapiens
agccacaactatttatactatttgaatatctagttagtctctccatataattgggagggaaagaagtttggttgtaggcagtcaccaaagccttgagtgttaaaacatgaggtaatgcatatgaagtgcttagaatagtgactgacaatagaacaaatgctaacaaagttttgttctacttataatttaaagagttggggtctcactttgttacccaggctgaacaggcacagtcatgttgcactccagccttgaactcctgggttcaagtgattctcctgtctcagcctctaactggcttatttcacttagcataatgtcctcaaggtttacccatactgtagcatgtgtcagaatttcatttctttttaatgctaaataacatcctattgtatgtatataccatgttttctttatccattaatccatggatagaaatttggattgtttctaccttttggctattgggaataatgctgctatgaacattggtgtataaataatctttttgagttcctgcttcaattcttttgggtgtgtactcagaattggaattgcaggattgtgtggtaattttttgtttaatttttatgttaaatttttaccaattttaattttgtaattttgtgttaaactattttgtgttaaattttgtgttaaactgctttccacagcagctgtaccatgtatatttccatcagcagtgcactgtgttccaatttcttcacatcctcaccaacacttactttctgatttattgacagtatccatcccaatggttgtgaaatggtatcattgtggttttcatttgcacttcccaatgattagtgatgtggaacattttcccacaggcttattgactatttgcatgtatttgaagaaatgtctattgagatcctttgcccatttcagtcaggttttttgggggtttttttgttgttgagttgtaggagttatatattttgtatgataatcccttgtcagatacatgattcacaactgttttctcccattctgtgagctactttttcactctcttgataatagtgtcctttgatgcacaaaagtctttaattttgatgaagtctgttttatctcttttcttttgttgcctgtgtttttaatgtcctatcaaagaaatcattgccaagtctgatcatcggactgtattttcttctaagagttttctagttctagctcttatgtttaggtctttgatctattttgaattaagttttctatatggtataaggtcagggccctactttattcttttgcatgtggacatctagtttttcctagcaccattgttgaagaatgtcctttccccattgaatggtgttggctcccttgtccataactatttcactgtgtatgtgaggatttatttctggtctcctctattccattagtctgtctgtatgctactgcctcaccatcaggaactatgacccttccaactttcttcttttttaagattgttttgtctattcgtggtcccttgagattccatatgaattttaggatggatttttctatttctgcaaaaaaaaaagattattgatattttcatagagattgcattgaaactgtagattgctttgggtaatattaatatctcaataatattaagtcttccaattaatgaatgcaggatatctttccatttatttgtgtctttaattttttttcagcaatgttttgtagttttcagtgtacaagtcttactcctccttggttaagtttttctttttaattttttaaattttttttgtttttttatatatttttctttttattgttttggttaagtttattcctaagtattttttctttttgatgccattgtacatgggatttttaaaaaaaattttatgccattgtacatggaatttttttttttattattatactttaagttctggggtaaatgtgcacaacatgcaggtttgttacatatgtatacatgtgtcatgttggtgtgctgcacccattaactcgtcatttacattagatatacctcctaatgctatccctcctccctccccccaccccacgacaagccccgatgtgtgatgttccccaccctgtgtccaagtgttctcattgtttagttcccacctataagtgagaacatgcaatgtttggttttctctccttgcaatagtttgcttagaatgatggtttccagcttcatccatgtccctacaaaggacatgaactcatcttttttatggctgcagagtattgcatggtgtatatgtgcatagtattccatggtgtatgtgtattaatccagtctatcattgatggacatttgggttggttccaagtctttgctattgtgaatagtgccgcagtaaacatacgtatgcatgtgtcttcatagcagcatgatttataatcctttgggtatatacccagtaatgggatggctgggtcaaatagtatttctagttctagatccttgaggaattgccacactgtcttctacaatggctgaactagcatgtagtcccactaacagtgtaaaagtgttcctatttctccacatcctctctagcacctgttgttccctgattttttaatgatcactattctaactgctgtgagatggtatctcattgtggttttgatttgcatttctctgatggccagtgatgatgagcatttttttcatgtgtctgttggctgcataaatgtcttcttttgagaagtgtctgttcatatcctttgcccactttttgatggagttgtttgattttttcttataaatttgtttaagttatttatagattctggatattagccctttgtcagatgagtagattgcaaaatttttctcccattctgtaggttgcctgtttactctgatggtagtttcttttgctgtgcagaagctctttagtttaattagatcccatttgtcaattttagcttttgttgccattgcttttggtgttttagtcattttgtccatgatgtcctgaatgatattgcctaggtttacttctagggtttttatggttttaggtcttaggtttaagtctttatttcatcttgagttaatttttgtataaggtgtaaggaagggaaggggtccagtttcagttttctgcatatggctagccagttttcccaacaccatttatgaagtaaggaatcctttccccattgcttgtttttgtcaggtttgtcaaagatcagatggttgtagatgtgtggtgttatttctgaggcctctgttctgttccagttgtctatatatctgttttggtaccagtaccatgctgctttggttatggtaaccttgtagtgtagtttgaagtgagacagcatgatgcctccagctttgttctttttggttaggattgtgttggctatttgggctgttttttgattccataagaaatttaaagtagttttttccaattctgtgaagaaagtcagtggtagcttgatggggatagcattgaatctatacattactttgggcagtatggccattttcacaatattgattcttcctatccatgagtatgcaatgtttttccatttgtttgtgtcctcttttatttccttgagcagtgatttgtagttcttgaagcggtccttcacatcccttgtaagttgtattcctaggtattttattctcttagtagcagttgtgaatgggagtttgctcatgatttggctctctgttcttggtgtataggaatgcttgtgatttttgcacattgattttgtatcctgagactttgctgaagttgcttatcagcttaaggagatttggggctgagatgatggggttttctaaatatacaatcatgtcatctgctaacagagacaatttgacttcctcttttcctatttgaataccctttatttcttcctcatacctgattgccctggccagaacttccaatactatgttgaataggagtggagagagagggcatccttgttttatgccgtttttcaaagggaacgcttccagttttcgtccattcagtacgatattggctgtgggtttgtcataagtagctcttattattttgagatacgttccatcaatacctagtttattgagagtttttagcatgaaggagtgttgaattttgttgaaggccttttgtgcaactattgagataatcatgtggtttttgtcattggttctgcttatgtgaatagattacgtttattgatttgcgtatgatgaaccagccttgcatcccagataagaagccaacttgatcatggtggataagctttttgatgtgctgctggattcggtttgccagtattttattgaggatttctgcatcgatgttcatcagggatattggtctaaaattctctttttttgttgtgtctttgccaggctttggtatcaggatgatgttggtctcataaaatgagttagggaggattccctctttttctattgattggaatagtttcagaaggaatggtaccagctcctctttatacctctggtcgaatttggctgtgaatccgtttggtcctggactttttttggttggtaggctattaattattgcctcaatttcagaacctgttattggtctattcagggattcatcttcctggtttagatgtgggagggtgtatgtgtccaggaatttatccatttcttctagattttctagtttatttgtgtagaggtgtttatagtattctctgatgttagtttgtatttctgtgggattagtggtgatatcccctttatcattttttattgcatctatttgattcttctctcttttcttctttattagtcttgctagtggtctatcaattttgttgatcttttcaaaaaaccagctcctggattcattgattttttttgaagggttttttgtgtctctatctccttcagttctgctttgatcttagttatttcttgccttctgctagcttttgaatgtgtttgctcttgcttctctagttcttttaattgtgatattagggtgtcaattttagatctttcctgctttctcttgtggacattaagtgctataaatttccctctacacactgctttgaatgtgtcccagagattctggtatgttgtgtctttgttctcatggtttcaaagaacatgttaatttctgccttcatttcgttatgtacccagtagtcattcaggagcaggttgatcagtttccatgtagttgagtggttttgagtgaatttcttaatcctgagttctagtttgattgcactgtagtctgagagatagtttgttaaaatttctgttcttttacatttgctgaggagtgctttacttccagcttcgtggtcaattttggaataagtgtgatgtggtactgagaagaatgtttattctgttgatttggggtggagagttctgtagatgtctgttaggtctgcttggtgcagagctgagttcaattcctcgatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccagtatgtaatggccttctttgtctcttttgatctttgttggtttaaagtctgttttatcagagactaggattgcaacccctgcttttttttgttttccatttgcttggtagatcttcctccatccctttattttgagcctgtgtgtgtctctgcatgtgagatgggtctccggaatacagcacactgatgggtcttgactctttatccattttgccagtctgtgtcttttaattggagcatttagttcatgaacatgtaaggttaatattgttctgtgtgaatttgatcctgtcattatgatgttagctggttattttgctcattagttgatgcagtttcttcctagcctcgatggtctttacaatttggcatgtttttgcagtggctggtaccggttgttcctttccatgtttagtgcttccttcaggagctcttgtaaggcaggcctggtggtgacaaaatctctcagcatttgtttgtttgtaaaggattttatttctccttcatttatgaagcttagtttggctggatatgaaattctgggttgaaaattcttttctttaagaatgttgaatattggcccccactgtcttctggcttgtagagtttctgcttagggatccactgttagtccgatgggcttccctttgtgggtaacctgacctttctctctggctgcccttaacattttttccttctttcaactttggtgaatctgacaattatgtgtcttggggttgctcttcttgaggagtatctttgtggtgttctctgtatttcctgaatttgaatgttggcctgccttgctaggttggggaaagttctcctggatgatatcctgcagagtgttttccaacttggttccattctccccatcactttcaggtacacgagatgtagatttggtcttttcacatagtcccatatttcttggaggctttgtttgtttctttttactcttttttctctaaacttctcttcttgcttcatttcattcatttgatcttcagtcactgataccctttcttccacttgatcaaattagctactgaagcttgtgcatttgtcatgtagttctcgtgccatggttttcagctccatcaggtcatttaaggacttctctacactgtttattctagttagccatttgtctaatcttttttcaaggtttttagcttctttgcaatgggttggaacatcctcctttagcttggagaagtttgttattaccgatcgtctgaagccttcttctctcaactcatcaaagtcattctctgtccagctttgttccattgctagtgaggagctatgttcctttggaggagaagaggtgctctgatttttagaattttcagcttttctgctctggtttctccccatctgtgtggttttatctacccttggtctttgatgatggtgacgtacagatggggttttggtgtggatgtcctttctgtttgctagttttccttctaacagtcaggaccctcagctgcaggtctgttggagtttgctggaggtccactccagatcctgtttgcctgggtatcaccagcggaggcttcagaacagcagatattgcagaacagcaaatgttgctgtctgatccttcttctggaagcttcatctcagaggggcacccagctttatgaggtgacagtcggcccctactgggaggtgtctcccagttaggctactcggtggttagggacccacatgaggaggcagtctgtccgttctcagatctcaaactctgtgctgggagaagcactactctcttcaaagctgtcagacagggacgtttaaatctgcagaagtttctgctgccttttgttcagctatgccctgcccccagaggtggagtctacagaggcaggcaggcctccttgagctgcggtgggctccacccagtccgagcttcctggctgctttgtttacctactcaagcctcagcaataggggacgcccctccccagccttgctgccgccttgcagttcagtctcagactgctgtgctagcagtgagcgaggctccgtgggcgtgggaccctccaagccaggtgcaggatataatctcctgatgtgccatttgctaaggccattggaaaagcgcagtattagggtgggagtgtcccgattttccaggtaccgtctgtcacggcttccctttgctaggaaagggaattccccgaccccttgcacttccagggtgaggcgatgccccacctgctccgtgggctgcacccactgtctgacaatccccagtgagatgaacctggtacctcagttggaaatgcagaaatcacctgtcttctgcattgctcacgctggaagctgcagactggagctgttgctatttggccatcttggaacctcctccggaatttttttaaataccctttaagaattgttctttattggtatatagattagtatgtagaaacacaacttatttttgtgtgttggttttatctcctgcaactttgctgaatttattctaaaagtgttttttagaatcttagtgatggtcattgtccagtgcaagagtttgatgtggatccttctggtactattttgctttcttgatgagtagatacataaacttcgatctacattaatgctcaagatagtcatatatgcataatcataattgaattctacatatctttcccttttttgacttctcaactttctttattattattattattattattattattattattattattattagatagggtctcataacctgtcacccaggctagaatgcactggcacaatcacggctaactgcagccttgaccttcctgggctcaagcaatcctcccatctcagccttacaagtagctgggactacaggtacctgccaccatgactggctaatttttcgtattctgtagagacagggttgctcaggctggtctcaaactcctgggttcaagcagtgcaactgcctttgcctcccaaagggctgggattataggcttgagctgctgtgcctggccaactttctgacttttaaaaatattatatgtatttgtgaaatgcaaaaaaaacataaaggatagtacagaagacatttctatcatgtcatacatatttaggaagagcccctcgtatggcatagttaagaggtttttgtttgtttgtttgttttattgatcattcttgggtgtttctcccagagggggatttggcagggtcataggacaatagtggagggaaggtcagcagataaacaagtgaacaaaggtctctggttctcctaggcagaggaccctgcggccttccgcagtgtttgtgtccctgggtacttgagattagggagtggtgatgactcttagggagcatgctgccttcaagcatctgtttaacaaagcacgtcttgcaccgcccttaatccatttaaccctgagtggacacagcacatgtttcagagagcacagggttgggggcaaggtcatagatcaacagcatcccaaggcagaagaatctttcttagtacagaacaaaatggagtctcctatgtctacttctttctacacagacacagcaacaatctgatatctctatcttttccccacatttcccccttttctattccacaaaaccgccatcgtcatcatggcccgttctcaatgagctgttgggtacacctcccagacggggtggcggccaggaagaggggctcctcacttcccagaaggggcggccgggcagaggcgccccccacctcccggatggggcggcggctgggcgggggctgccccccacctccctcccggacggggcggctggccgggcgggggctgccccccacctccctcccggacggggcggctggccgggcggggggctgccccccacctccctcccggacggggcggctggccgggcgggggctgccccccacctccctcccggacggggcggctggccgggcgggggctgccccccacctccctcccggacggggcggctggccgggcgggggcggccccccacctcccgggcggggcggctgccgggcggagacgctcctcacttcccagacggggtggctgccgggcggaggggctcctcacttctcagacggggcggctgccgggcggaggggctcctcacttctcagacggggtggctgccgggcggaggggttcttcacttctcagacggggcggctgccgggtagaggggctcctcacttctcagacggggcggctgccgggtggaggggctcctcacttctcagacggggcggccaggcggagacgctcctcacctcccagacggggtcgcggccaggcagaggtgctcctcacatcccagacggggcggcagggcagaggcgctccccacatctcagatgatgggcagccgggcagagacgctcctcacttcccagatgggatggcggccgggaagaggcgctcctgacttcccagactgggcggccgggcagaggggctcctcacatcccagacgatgggcagccaggcagagacgctcctcacttcccaggcagggtggcggccgggcagaggctgcaatctcggcactttgggaggccaaggcaggtggctgggaagtggaggttgtagctagccgagatcactccactgcactccagcctgggcaacattgagcactgagtgaacgagactccgtctgcaatcccagcacctcgggaggccgaggctggcagatcactcacggttaggagctgcagaccagcccggccagcatagcgaaaccccgtctccaccaaaaaaatatgaaaaccagtcaggcgtggcggcacacgcctgcagtcgcaggcactcggcaggctgaggcgggagaatcaggcagggaggttgcagtgagccgagatggcagcagtacagtccagcttcggctcggcatcagagggagacagtggaaagagagggagagggagaccatggggagggggagggggagagggagagggagggagagggagagggagagggactagttaagagttttttaagaaaatattcactcagtttttatctactcatatcttaaggaattgaagtggtccaggaaatctttgtacaggaataggcccaacataagatgggtggaagaaaacaacaatacatacaatcataggaaagaaaaaagacttggtataacattaaatttaaaatacagtgaggaaaaagaagaaattgctgtgggaacactcccagaatataggaagaagtttcaaaagagatgaaaaatctggcatcaaagatattataaatagcttataaaaatacaatcttgaatcataggctttcctaaagaagaaaacagaagtaataatatatcaagtttcatagaa

SEQ ID NO: 444 - DNA, 8216 bp, Homo sapiens
agccacaactatttatactatttgaatatctagttagtctctccatataattgggagggaaagaagtttggttgtaggcagtcaccaaagccttgagtgttaaaacatgaggtaatgcatatgaagtgcttagaatagtgactgacaatagaacaaatgctaacaaagttttgttctacttataatttaaagagttggggtctcactttgttacccaggctgaacaggcacagtcatgttgcactccagccttgaactcctgggttcaagtgattctcctgtctcagcctctaactggcttatttcacttagcataatgtcctcaaggtttacccatactgtagcatgtgtcagaatttcatttctttttaatgctaaataacatcctattgtatgtatataccatgttttctttatccattaatccatggatagaaatttggattgtttctaccttttggctattgggaataatgctgctatgaacattggtgtataaataatctttttgagttcctgcttcaattcttttgggtgtgtactcagaattggaattgcaggattgtgtggtaattttttgtttaatttttatgttaaatttttaccaattttaattttgtaattttgtgttaaactattttgtgttaaattttgtgttaaactgctttccacagcagctgtaccatgtatatttccatcagcagtgcactgtgttccaatttcttcacatcctcaccaacacttactttctgatttattgacagtatccatcccaatggttgtgaaatggtatcattgtggttttcatttgcacttcccaatgattagtgatgtggaacattttcccacaggcttattgactatttgcatgtatttgaagaaatgtctattgagatcctttgcccatttcagtcaggttttttgggggtttttttgttgttgagttgtaggagttatatattttgtatgataatcccttgtcagatacatgattcacaactgttttctcccattctgtgagctactttttcactctcttgataatagtgtcctttgatgcacaaaagtctttaattttgatgaagtctgttttatctcttttcttttgttgcctgtgtttttaatgtcctatcaaagaaatcattgccaagtctgatcatcggactgtattttcttctaagagttttctagttctagctcttatgtttaggtctttgatctattttgaattaagttttctatatggtataaggtcagggccctactttattcttttgcatgtggacatctagtttttcctagcaccattgttgaagaatgtcctttccccattgaatggtgttggctcccttgtccataactatttcactgtgtatgtgaggatttatttctggtctcctctattccattagtctgtctgtatgctactgcctcaccatcaggaactatgacccttccaactttcttcttttttaagattgttttgtctattcgtggtcccttgagattccatatgaattttaggatggatttttctatttctgcaaaaaaaaaagattattgatattttcatagagattgcattgaaactgtagattgctttgggtaatattaatatctcaataatattaagtcttccaattaatgaatgcaggatatctttccatttatttgtgtctttaattttttttcagcaatgttttgtagttttcagtgtacaagtcttactcctccttggttaagtttttctttttaattttttaaattttttttgtttttttatatatttttctttttattgttttggttaagtttattcctaagtattttttctttttgatgccattgtacatgggatttttaaaaaaaattttatgccattgtacatggaatttttttttttattattatactttaagttctggggtaaatgtgcacaacatgcaggtttgttacatatgtatacatgtgtcatgttggtgtgctgcacccattaactcgtcatttacattagatatacctcctaatgctatccctcctccctccccccaccccacgacaagccccgatgtgtgatgttccccaccctgtgtccaagtgttctcattgtttagttcccacctataagtgagaacatgcaatgtttggttttctctccttgcaatagtttgcttagaatgatggtttccagcttcatccatgtccctacaaaggacatgaactcatcttttttatggctgcagagtattgcatggtgtatatgtgcatagtattccatggtgtatgtgtattaatccagtctatcattgatggacatttgggttggttccaagtctttgctattgtgaatagtgccgcagtaaacatacgtatgcatgtgtcttcatagcagcatgatttataatcctttgggtatatacccagtaatgggatggctgggtcaaatagtatttctagttctagatccttgaggaattgccacactgtcttctacaatggctgaactagcatgtagtcccactaacagtgtaaaagtgttcctatttctccacatcctctctagcacctgttgttccctgattttttaatgatcactattctaactgctgtgagatggtatctcattgtggttttgatttgcatttctctgatggccagtgatgatgagcatttttttcatgtgtctgttggctgcataaatgtcttcttttgagaagtgtctgttcatatcctttgcccactttttgatggagttgtttgattttttcttataaatttgtttaagttatttatagattctggatattagccctttgtcagatgagtagattgcaaaatttttctcccattctgtaggttgcctgtttactctgatggtagtttcttttgctgtgcagaagctctttagtttaattagatcccatttgtcaattttagcttttgttgccattgcttttggtgttttagtcattttgtccatgatgtcctgaatgatattgcctaggtttacttctagggtttttatggttttaggtcttaggtttaagtctttatttcatcttgagttaatttttgtataaggtgtaaggaagggaaggggtccagtttcagttttctgcatatggctagccagttttcccaacaccatttatgaagtaaggaatcctttccccattgcttgtttttgtcaggtttgtcaaagatcagatggttgtagatgtgtggtgttatttctgaggcctctgttctgttccagttgtctatatatctgttttggtaccagtaccatgctgctttggttatggtaaccttgtagtgtagtttgaagtgagacagcatgatgcctccagctttgttctttttggttaggattgtgttggctatttgggctgttttttgattccataagaaatttaaagtagttttttccaattctgtgaagaaagtcagtggtagcttgatggggatagcattgaatctatacattactttgggcagtatggccattttcacaatattgattcttcctatccatgagtatgcaatgtttttccatttgtttgtgtcctcttttatttccttgagcagtgatttgtagttcttgaagcggtccttcacatcccttgtaagttgtattcctaggtattttattctcttagtagcagttgtgaatgggagtttgctcatgatttggctctctgttcttggtgtataggaatgcttgtgatttttgcacattgattttgtatcctgagactttgctgaagttgcttatcagcttaaggagatttggggctgagatgatggggttttctaaatatacaatcatgtcatctgctaacagagacaatttgacttcctcttttcctatttgaataccctttatttcttcctcatacctgattgccctggccagaacttccaatactatgttgaataggagtggagagagagggcatccttgttttatgccgtttttcaaagggaacgcttccagttttcgtccattcagtacgatattggctgtgggtttgtcataagtagctcttattattttgagatacgttccatcaatacctagtttattgagagtttttagcatgaaggagtgttgaattttgttgaaggccttttgtgcaactattgagataatcatgtggtttttgtcattggttctgcttatgtgaatagattacgtttattgatttgcgtatgatgaaccagccttgcatcccagataagaagccaacttgatcatggtggataagctttttgatgtgctgctggattcggtttgccagtattttattgaggatttctgcatcgatgttcatcagggatattggtctaaaattctctttttttgttgtgtctttgccaggctttggtatcaggatgatgttggtctcataaaatgagttagggaggattccctctttttctattgattggaatagtttcagaaggaatggtaccagctcctctttatacctctggtcgaatttggctgtgaatccgtttggtcctggactttttttggttggtaggctattaattattgcctcaatttcagaacctgttattggtctattcagggattcatcttcctggtttagatgtgggagggtgtatgtgtccaggaatttatccatttcttctagattttctagtttatttgtgtagaggtgtttatagtattctctgatgttagtttgtatttctgtgggattagtggtgatatcccctttatcattttttattgcatctatttgattcttctctcttttcttctttattagtcttgctagtggtctatcaattttgttgatcttttcaaaaaaccagctcctggattcattgattttttttgaagggttttttgtgtctctatctccttcagttctgctttgatcttagttatttcttgccttctgctagcttttgaatgtgtttgctcttgcttctctagttcttttaattgtgatattagggtgtcaattttagatctttcctgctttctcttgtggacattaagtgctataaatttccctctacacactgctttgaatgtgtcccagagattctggtatgttgtgtctttgttctcatggtttcaaagaacatgttaatttctgccttcatttcgttatgtacccagtagtcattcaggagcaggttgatcagtttccatgtagttgagtggttttgagtgaatttcttaatcctgagttctagtttgattgcactgtagtctgagagatagtttgttaaaatttctgttcttttacatttgctgaggagtgctttacttccagcttcgtggtcaattttggaataagtgtgatgtggtactgagaagaatgtttattctgttgatttggggtggagagttctgtagatgtctgttaggtctgcttggtgcagagctgagttcaattcctcgatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccagtatgtaatggccttctttgtctcttttgatctttgttggtttaaagtctgttttatcagagactaggattgcaacccctgcttttttttgttttccatttgcttggtagatcttcctccatccctttattttgagcctgtgtgtgtctctgcatgtgagatgggtctccggaatacagcacactgatgggtcttgactctttatccattttgccagtctgtgtcttttaattggagcatttagttcatgaacatgtaaggttaatattgttctgtgtgaatttgatcctgtcattatgatgttagctggttattttgctcattagttgatgcagtttcttcctagcctcgatggtctttacaatttggcatgtttttgcagtggctggtaccggttgttcctttccatgtttagtgcttccttcaggagctcttgtaaggcaggcctggtggtgacaaaatctctcagcatttgtttgtttgtaaaggattttatttctccttcatttatgaagcttagtttggctggatatgaaattctgggttgaaaattcttttctttaagaatgttgaatattggcccccactgtcttctggcttgtagagtttctgcttagggatccactgttagtccgatgggcttccctttgtgggtaacctgacctttctctctggctgcccttaacattttttccttctttcaactttggtgaatctgacaattatgtgtcttggggttgctcttcttgaggagtatctttgtggtgttctctgtatttcctgaatttgaatgttggcctgccttgctaggttggggaaagttctcctggatgatatcctgcagagtgttttccaacttggttccattctccccatcactttcaggtacacgagatgtagatttggtcttttcacatagtcccatatttcttggaggctttgtttgtttctttttactcttttttctctaaacttctcttcttgcttcatttcattcatttgatcttcagtcactgataccctttcttccacttgatcaaattagctactgaagcttgtgcatttgtcatgtagttctcgtgccatggttttcagctccatcaggtcatttaaggacttctctacactgtttattctagttagccatttgtctaatcttttttcaaggtttttagcttctttgcaatgggttggaacatcctcctttagcttggagaagtttgttattaccgatcgtctgaagccttcttctctcaactcatcaaagtcattctctgtccagctttgttccattgctagtgaggagctatgttcctttggaggagaagaggtgctctgatttttagaattttcagcttttctgctctggtttctccccatctgtgtggttttatctacccttggtctttgatgatggtgacgtacagatggggttttggtgtggatgtcctttctgtttgctagttttccttctaacagtcaggaccctcagctgcaggtctgttggagtttgctggaggtccactccagatcctgtttgcctgggtatcaccagcggaggcttcagaacagcagatattgcagaacagcaaatgttgctgtctgatccttcttctggaagcttcatctcagaggggcacccagctttatgaggtgacagtcggcccctactgggaggtgtctcccagttaggctactcggtggttagggacccacatgaggaggcagtctgtccgttctcagatctcaaactctgtgctgggagaagcactactctcttcaaagctgtcagacagggacgtttaaatctgcagaagtttctgctgccttttgttcagctatgccctgcccccagaggtggagtctacagaggcaggcaggcctccttgagctgcggtgggctccacccagtccgagcttcctggctgctttgtttacctactcaagcctcagcaataggggacgcccctccccagccttgctgccgccttgcagttcagtctcagactgctgtgctagcagtgagcgaggctccgtgggcgtgggaccctccaagccaggtgcaggatataatctcctgatgtgccatttgctaaggccattggaaaagcgcagtattagggtgggagtgtcccgattttccaggtaccgtctgtcacggcttccctttgctaggaaagggaattccccgaccccttgcacttccagggtgaggcgatgccccacctgctccgtgggctgcacccactgtctgacaatccccagtgagatgaacctggtacctcagttggaaatgcagaaatcacctgtcttctgcattgctcacgctggaagctgcagactggagctgttgctatttggccatcttggaacctcctccggaatttttttaaataccctttaagaattgttctttattggtatatagattagtatgtagaaacacaacttatttttgtgtgttggttttatctcctgcaactttgctgaatttattctaaaagtgttttttagaatcttagtgatggtcattgtccagtgcaagagtttgatgtggatccttctggtactatt

SEQ ID NO: 445 - DNA, 1434 bp, Homo sapiens
attctcttgaacagcaagagaaggaaacagtttagtaagttagataggcagaagtagacctagtacttgtgaaatgtgtgccaaaactcttcagtaactattttccttctgctttctgtagaaaatatttaaagttgaaatgaaagcatttcctgaagtgatacgtgaattactacaagcaatatgtacaaaacatgaaaaacagaggtgatatttagtttggaattgtcatattcaaaatcagaaataaaattttcattctgatagagcagtgagtttgattttattctcagattaaattacagaatggattattaatcagatgtgttttagatgattaaaatagcagttcatgtttttgatagcattagctattcaggatcaaatgaatatctgattaaatatgtattttgagttcaataatgccttttacaaagcactttaaaccctatagacaaacgtggcttgatggcagtgtagtaaggaatatttataggtgattgaaaagctatatctaaagttttaactagtgagctatcatcaaagtgcatagaactttagaggcatattgccatactttgaacttgccaatgtatgtttcatcaatactttactagtaatgtgaatgaagaattaaaggcttgctcctcaacttctgaatggctcaaacatggtaaaataaagttgacataatgaatgagaagtatagattacagtagatgtgaaaaatacaaaagaaccaaagaatgaaattaaagagacaaatataaaatctaacatttgcttcaattgcataagactttgtgggctactagtttgatagtgtttattttaaaaatatttttaaaattttatttgaccttaaatttagcataaggcagtattaaaaatcacctaataaaaatgatacagcctccaattttatttaaaaagtgtataatttatatcaattgaggaaactgattatttagactgtgttcacaggagaatgacaagtattttgagggacagaaaatcatatctttggaaaaagtttgaaagcttgtcatagggcagatctatttagattgataacataatgtatggatgacaaaactaaaacatctaataaagagtacagggaagcaggtattgattcattataaaatcaaagttttataataattagaatatttcaaatgcaaaattttcatcttagaaaaagcaactggacttggtgtaatgttaaaataatgcatgtaaaacacatgatacttggtatatagtaagcactaactaaatgcatactattaatcttaccaatataatgttcttagcattatattcaagaataaattagatctttagttgttacatataatcatttattttagattaaatttagagtaaatgtatttcaatttgtctaagcttctaagattcagtgattatatt

SEQ ID NO: 446 - DNA, 13859 bp, Homo sapiens
ctcatacatgccaagattttttgctagacttattgtggatatgtaaaatggacccccaaatcttaaagcttagtaaagtaaataaaatctttgaaatacacaaagaaacactaaaaaaatcagtcttaaagcagttcagagaaagaaaaattcatcatcagtcagaatgagagagaaatactctctttcacaaaacactgaagttgctaagtatgtacttacaggagacatatctagatccctatttcatcaattgtccgtgaatttctattgaaattctctaaatgagagaccacaatatacttggatgccatctcagcatatagaccttgtagctgtagtccacataaatatgatccaggtgttactaataagatagagttgccttatttaaaaaaattaaactatcttcccaaaatatgtataagcctcctatagttgactatagttggtgagactattttaccatattatttcattataatggtgcatctgaacacaggtacaattgtagtttcgataaaaattgcagtcactaaagaattagcattttaatacacagtagataatataaatggccttagtttccaaatgattagcaagcatacatttcctactgcaaagaattttactcattaaaatacactttatgggagtaatagatatgtactatgtgtttgttagcgaccacaaatataatgtactgaacaccttgtcaacaaatcgcatacatactccttccagctatttacactatcgacttggtaaaactatttgtatcacaaattataactttatataaatcccatgtatcatgggcttctttgtgaagctcagaataatccaaaattcttcacaactccagctagactgttactaaactcatttcattctgatgtgccttttaaaaactccataatattttatgttgccttacaaattcaggagctacaggtcatttattccagtgctctgacagttctcatgaactatctctttactatttgaattacagtttagtcaacttcaagttataactatggtgaacattgattaaaattagtcatttttcaaatcacaacattcaactcatagatgtgagcactttggctcatctatttgatccttcattcaagggatgatgaaacagattggaagtatgcctctaagaaactgagcttcagagcaaaacaaactctctaccccaaagcatcattaatgtgtcctaaactgtgtatattaaagaatgaaaagtccttagatttttaagcaccatgactttccaaaaatcaagttagtttaataaggcaaaaactacctttagtaaagacataaagaagtattgagcacttacactgtattctagaagaacacaacatcatgtggggtagattaaacgttagcatcaaatgttacagactgaaactcaggcagaggttaagtcacttgctcccaaccacagcaggagttctgtcacggtcaagagcagcatggccttcttacactttcagtccaggcccaagattaatctttcaagaggaaaggatttaatggagaaagcttgtaaatattcatgaagtaatagcaaactaaatattacagaaatctcggataacgtttaaatgctcaaaattgccacctacataaatggaaccaagattctcaaaagaatgtaaaacatgagagtttgtgtaattaaaagttaaagaagcaaaaagactcctgagtcacattgtcgtgatgtggcattaaagtacttgtgtgggaagggttggtcaaatcctaagattgtcccaagaattgctatttattaaagttcttattactagattaaccacaggaaaacttaattggccattagctttaaagaaaaacatctatggaagcaaaataccttattaaatatttaacaggacatggcctacatattgcttaatttagataatctaattatagcaagctaatgcacttagctcatcatcataatacttgaaattatttacctgaatttggctcatcctgactttggttcctatgttatatttcttatgcaattgttttaccataaaatgtctttacttaaacaatttttcaatacaggatcatgagtgcttaaactatatatatctagtttgaacatgtacatagagtagtatatatatatatatatatatatgtattagttttttgtgaaaagacttgtggttctagttggcacttcatctaacaatttagcatgtaaaattaatacagatacttaaaaaatgtacactactatggaatttacaaaaatgttacagaagtgaattcaacaatgtacagacaggtacactatatggatacatttaaccaaaaaaaaaagtaatattctaaacagaaaacatcagcacagagggcagattaaattaagtgcgagaggcaataaagtttacatcagaatgggcaagtaatgcccaaggaaaatttgatcattaaaagggaaacaggtgtaaggacagagtccaagcacagatcacgcctgtaatcctagcccattgggaggccgaggcagatggatcacgtgaggtcaggagttcaagaccagcctgcccaacatggtgaaatcccgtctgtactaaaaatacaaaaattagcttggcatggtggtgcgtgcctgtaatcccagctacttgggaggctgaggcaggagaagctcttgaactctaggactctaggaggtggaggttgcagtgagccaagatggtacactacactccagcctgggcaacagagcgagactctgtctcaaaaaaaaaaaaaaaaaaaactcacaccttgttgatattggtcctattccaggagataggtaaaatgtacattaattttcaggtagattaatttgtattgttcttacatgtcctattcatcagtttattgttcaactaattctgaattctgcacaattgactcttaatagcacattgccttgcaatagcagcccacacttcctacctgcgaagtcatcagtctcaataacttagtctatggaaggtagttttggagcaaggtgcccatcaagattaggtttcttccctcccagggaaaccaatagataggggtgcttcttccttgatgattacatttcagaaatggttcccagatccttgagaaagatattcctgggtcataaagctaagaggcttatttcacttcaaagagactgaaaattgattcacaagtttgttcttttttaaaagtaaatgctctaaaaaaaaaaaaaaaaagaagtaatggggggatggagtctctccccttattttcaacagggaggacgaggcctcttattttccatttgtctttgcctgtacagtcttcaccatacagcacataactcaaagcttcacatacacaagtcaaataacatctattaaaatgagattttatcccatcttacgtgccttgtaaatgtgtatattcttcagaaaatacagacattttggaaacacatttgtgtaagtttaatgatttaatttatgtttctttattttcactttttttaaactgaaaggtcttgctaaatgagaactggcataaattactgtctcaggactgtgctgagaattaggttctgggaatgataagaaaggaaatttttttctaagtgattataatgtcattttcaagttatgcatttcaggtaaattcaattacttttttcccatatctcaaatttatgagtaatttttcaaataattatattaacatgaaaattctgttaaaacagacaatttgtacttttcagaacagacaatttcggagtggcaactgcatatttcagttgttaattcacaacaatgtatatgtgattatccatagtgatggtgagatttgggttccaacacttcaaggaaactcttgcatagattcatttatttgctttacaaggaggaatgactcaaacacagtcctttggagctagaatcagtctatcaaaaagtcatttctccatagaccagggatgttttaaccaatgccacttcacagagagggactttggaaaaagtagtacataagtgcacacattgctcagaaatatttccagagatttcagtattgatgcgtgaatgttgggtatgtgctggcctatcaaaacaatggcctttcttgattttataactatttcctatttaacattcttcaaggcttaaatatattttcctctggtaatgagcagaggaaaggatattttcctctggtaatgagcaggccatggaatctttaaaatactttgtggcccagtgagctttatatttcttttactgttttcctctaatccagaattagagtccctatacacactgactatatttcagtataattttaactacaaggaaaaagctgtgggtctggactttcagagcttggactctgaaaataacaagctaatagaggaccaggtaagtgcacacttcctccccagcaaggcagacagggtaagtgctcacattaaggattaaacaaatgtctgactcagacatttgagggccttagaaacacaatgaaagtttagttgggagtaaaaccatccctataaactttaagcaataaatccggaaagaagagagggaaagaaacaaaaatacaccaagctcgcagcacattcagcattatcattaggtcagcatactctccggcatgcttcctcacagtcatttggagcctattgtcccagagtcatgtggaccctagattatagttccccttaactgctatatggataacaacctgaacattacgagacattaagttttccctctgagatattcattcagcacctgcataccagtgaaactactgatgtcagctgatatgaatgtctccatgaagagctgtctcaacaaagaatgcagtttccacatcctgatgattccatcctcctcacctcaaccaagcaatgacctcaactttccagccactcaccctccatgatcctcataaaaaccgactcaaactcattggagagatggagttgagggtgtcctcttatcaacaccctcagctgtcctacgatcattaaactctttctctgctgaaaactctgctgtctcagtatattggtatgttactgcactaccacataggaacctgttggtcctataacagaagtgacaagtttagagctgtgctctaaaatgaccttatcagcatctcctaaatatctctaaatggtctctccattatccccaccactgtgtctcctctctaccactcttaccacgccaacccatgtctctattctgaatgactcagcagatttctggtcaatctctgcttccccttgcctttctccagtcagttctccatacagcaaccagaatcatgctttaaaaaaaatcttactatgcatttccctgcttacagtaattcaataacttcccactgcattaaaaacccaagctgtcatcctggcctctgagccactcaccactactcatgagtacacaggccaaggcccttggcttcctgaagtttcgctgaaaaattaactcacaaaaggcgggttaattggagaaaaaaatacaaatttatttaatgtgtatacacaggagccttcagaatgaagacccaaacatataggagaaatggtttatgtttatgcttaggctcaacaaagtacaaatcgctatgcagaaatatgattgaacaaaaagggtacgatctaatgctaacaaactaagggggaaaaaacagcaaggcctatctgtctagattttacttgacctctctgggcatgcatttcttccttctgggtgtgggaaaggaccctcttggaaatgaggatcttatgacctacagtcaaacaagataagtcagataatttctttatagccaaattttacaaaggatctggggaaaattagagtaatatttttaggtattgtggttggctttggggaaataggttctggtttctgtgaccagcattggggaaagggattctaatttctatggctagcctttgggaagaatgagactgggaggcagaagggcagaagaaggtcgggaaaaaacctctgaggctgtttatgaggccttcattttgaggtattgttttctgagtccccacataagccttctggttcctcctcctacatgccaagttcattcattctctagggcctttgcatagagctgtctcctcttccagaaatgctcttctctgcaaaacatggctcgattctattcatttagatctcagcttatctatcacatcccaaaagagatcaactctattcaccacaaggagtcactaagtcactttccatcacctacttgcaattttattttttagtgttttggtgacctataagccttctgaccaaaatttaagttccatggaagcagtatcattgtctgtcttgttcagtattatttctccagcaccagcaaattgcttggtacataataggccctcaataaatattttttaaatgagtgaacatacaatagccttatttgaagagttgaaaagcaaaactataaataaggaagcaattactgagataccattactgagatactcctggaagaagtaatgaaagtttgatgtagaattatgatagaaaaggaaaaagtgaactgatgtgagagttgttttgtaggaacagcggtacatggaaaacgttttagcatggggataaagactttcctttaaatagatatacgttaaacaggaaagtatagagggtgcatcatactaaagattatagagaaatgataaaaaagcgtttgtgttaaataaataatcaattgatcattggtggtctcagagactatattttcagcagactgaagaataatcaggactgatatgtaaccaatacacattagtatgacctatatattttaaaattactcctagctacaagcatgatttctactggtgaagaaatgtttttaaaaaatttaagcagcaggcatagaaaaaccatttttcaagaagttcgatgatgacatacagcatggttttctgtgaaatattgtatgagtggccagggatgacttttttcattatttcagtaggttttttgggaaacaggtgtttggttgtgtggataacttctttagtggtgatttctgagattttggtgcacccatcaactgagcagtgtacactgtacccactgtacccagcaattatcttttgccccccttctccctgagtccccaaatttcactgtacaattttaatgcctttgcatcctcatagcttagccaccacttataagtgagaacatacgacatttggttttccattcctgagttacttcacttagaataatggtttccaattccatccagtttgctgtgaatgccattatttcatttcctttttatgtctgagtagtattccatggtgtatatataccacatttttttttaatcaactcattgattgatgggcatttgggctggctccatattttgcaattgtgaattgtgctgctataaacatgtgtgtgtgtcttttttgtataatgactttttttcctctgagtacatacccagtagtgggattgctggatcaacagtagattttctattagttttccatactagatccatactagtagaattgctagatcaagtggcagatctactattggttctccacactgctttctgtagtggttgtactagtttacattcctaccagcagtacctactagtttacattcctaccaccacatccatgagaacatctattatttttttattatggtcattcttgcaggagtaacgtggtattccattgtggttttgatttgcatttccctcataattagtgatattgagcattttttaatatgtgtgttggccatttgtatatcttcttttgagaattgtctattcatgtctttagcccactttttgatgggattctttgggtttttttcttgctgatttgtttgagttcactgtagattctggctattagtactttgctgaatgcatagttttagaagactttctcccactctgtgggttgtctgtttactctgatgattatttcttttgctgtgcagaagcttttgagttttaagtctcatctgtttatctttgtttttgttgcatttgcttgtgggttcttggccatgaagtctttgcctaagccaatgtctcaaagcattttccaatgttctagaatctttatggttttaggtcttagatttaagtctttgatccatcttgaattgatttgtgtataaggtgagagatgaggatccagtttctttcttctacatgtggctagccaatcatcccagcaccatttgttgagtagggtgtcctttctgcacttaatgtttttatttgctttgtcacaaatcaattggctgtaagcatttggcattatttctgggctctattctgttccattcatctatgtgcccattttgatgccagtaccatgctgttttggtgactatagccttgtagtatagtttggggtaaggtaatgtgatgcctccagatttgttctgtttccttagtcttgctttggctatgtgggctcttttttggttttatatgaatttgagaattgatttttctagttatgtgaagaatgatgacagtattttgatgggaattgcattgaatttgtagatcccgtttggcagtatggtccttttcacaatattgattcttcccatccatgagcatgggatgtgtttccatttgtttgtgttgtctatgatttctttcagcagtgttttgtagttttccttgtagaggtctttcacttcattggttaggtattcttaagtattttattttacttttgcaactagtataaaaaggggttgagttcttgaattgattatcagtgtggttactgttggtatataacagtactactgatttgtgtatatgaattttgtatcctgaaactttactgaatgcatttatcagtactaggagctttgtggatgagtctttagagttttctaggtatacgatcttctactccatgatcagtgacagtttgatttcttctttgctgatttggatgtcattatttctttctcttgtctgactgctgttcctagggcttccagtactatgttgaatagaagtagtgaaagtgtgcatccttgtcttgttccagttctcatggagaatgcattcagcttttccccattctgtataatgctggctgtgggtttgtcatagatggcttttattaccttaagtatgtcctttctatgccaattttgttgagcattttaatgataaagggatactggattttgtcaaatatttattctgggtctattgagatgatcatgtgattttttgtttttaattctgtttatgtggtatattattatttattgccttgcatatgttaaactatctctgcatccctaggatgaaacccacttgatcacggtgaattatctttttgatatgctgttagatttgcttagctagttattttattgaggatttttgcatctatgttcttcagggatattggtctgtagttttctttttttgttatgtcttttcctggtttttgtattagggtgatacttgcttcatagaatgatttagggaggattccctctttctcttatcttttggaatagtgtcagtagaattgctaccaattcttctttgaatgtctaatataattcagctgtgaatccagctggtcctgaactttttttgttgataacttttttaattgccatttcaatctcactgcattattggtctcttcagagtttctatttcttcctgatttaatctaggagagttggatatttacagaaatttatccatctcctctaggttttctagtttgtgcacataaatatattcatagtagccttcaatgatcttttgtgtttctgtggtatcagctgtaatatctcctatttcatttccagttgcgcttatttggatcttctcttttctttcgttggttaatctcactaacggtctatcaatttgatttatcttttcaaagaaccagctttttaatttatcttttgtatttcttttgtttcaatttcatttagttctgctctgatctttgctatttcttttcttctgctgggtttgggtttagtttgttcttgtttctccagttccttgatgtgtgaccttagattgtctatttgtgctctttcagactttttgatgtaggaatttcatcctgtgaacttcctcatagcatgacttttgctgtatcccagaggttttgataggttgtatcactattatcattaagttcaaggaatttttttatttccatctttatttcattgttgacccaacaaacattctggagcagattatttaattttcatggacttgcatggttttgaggattccttttggagttgttttccaattttattccactgtggtctgagagagtacttgatataattttggctctcttaaatttattgaaacttgtgttgtagtctatcatatagtctatcttggagaatgttccatgagctgataaatgagtatatattctgcagttgctgggtagaatgttctggaaatatctgtgaagtccatttgttctagggtacagtttaagtccattgttctttgcagactttctgtgttggtgacccttctagtgctgtcagtggagtattgtagtcccccactactattgtgttgccatgtatctcatttcttatgtctagtagtaattgttgtataaatttgggagctccagtgttaggtagatatatagttagaattgtgatattttcttgttggactagatcttttatcattatataacgtcatcctttatcttttttttactgttggtgctttaaagtctattttgtctgagatagaaatagctactcctgctcacttttgctgtccatctgcatggaatatctttttccacccccttaccttaagtttatatgagtctttatgtgttagatgagtttcttgaagacaatagatacttgtttggtgaattcttatccattctgccattctgtatcttttaagtggagcatttaggccatttacattcagctgtagtattgagatgtgaggtactattctattcatcatgctagttgttgcttgaatactctttttttttccattgtgttattattttatatgtcctgtgaggtttatgctctaagaaggttctattttggtgtattttgaggttttgtttcaagatgtagagctcctttttaacagttcttgtagtgctggcttggtagtggcaagttctctcatcatttgtttgtctgaaaaagactgtatctttccttcatttataagactttgtttagctggataccaaactcttggccaacaattgttttgtttaaggaggctaaacatagtacccccatctcttctagcttgcagggtttctgctgagaaatctgccgttaatctgataggttttcctttataggttacctgatgcttttgcctcacagctgttaagattctttcattctttctttcatcttcattttagttaacttgatggctatttgtctagttggttatctttttgcaatgaatttcctgggtgttttttgagcttcttgtatttggatgcctaaatctccagcaaggcaagggaaatttattgagggaattagtccctcaaatttggtttccaaacttttagatgcatcttctttctcgggcatagcaattgttcttaggtttggttaacaaaatcccagccttcttggtagctttgttcatattttttttaattcttctttctttgtctttgtcagatgaaattaattgaaaagccttgtcttcaagctctgaagttctttcttctacttgtttgattctattgctgagaccttccagtgcattttgcatttctctaagtatgtcctttatttccagaagttgtgattgttttttatttacctgtagcattttaaaatttctttatgttgatatttacctttctctggttcctctctgagtagcttaataatcgaacttctgaattctttttctggcaattcagatatttattcttggtttggatccattcctggtgagctagggtgatcttttgggggtgttaaagagccctttttgtcatattatcagaattgtttttctgattccttctcatttgagtagactatgtcagaggaaagatctgggactcaaaaactgctcttcagattcttttgtcccacagggtactcccttgatgtggtgcttcccctagggatggggcttcctgagagccagattgcagcaattgatatttctcttctgggtctagccaaccagcggagctgcctggctctaggctgctactagggagtgtctacaaagagccccatgaggttatcatcctcgggtctctcagctgtggataccagcacctgctctgttggaggtaggagtggagtgaggtggactctgtgtgggaccttgactttcgttttgtttagtgcacttgttttctcgtatgctggttgtgctggcagtaaagttgtcatgtagacatactgaggatctctggttagacaagatgttacaggtggtaaagttagctgttgtttttctcctttgtggggcagggttgttcttttatgagttgctgtaatggcttgagttggttggcctccagccaagaggtgatgctttcaagacagcatcagctgtggtagtatagaagggatacaagcttgccctaaggtcacctggataagtactcaggtttctcaggtggtgggtgtggccacagagctcccaagagattatgtcttttgtcttctactatcagggtgggtactgaaaaaccatcaggtgagggcagggttaggaatgcctgaactcagactctccttgggcagggcttttggggtgtggttctcaggcctatggagttatgttcccagggggattatgactgcctctgctgcatcctacaggtcaccagtgaagtgggggaaagctggcagtgccaggcctcacccagctcccatacagccagaaaggccagtctcctgctgtgcccctccagcagcactgagtttatatccaggcagccagcgagcagggctgggactttgccgcaagctaccagtctctctgccgagaaatcaagcagggctttcagcttcacctctccctactatggcttctgtgctcatatctgcacttcccatttgccctccacccccagattctgccctgaaaaattttcactcagttgaaattactacaaagttcagctgaaagtttccttcttcctgtagtctttccccagttccactggcaacgctccccaagggcccctgtgagatacggtctggaatgggtccctgagcttccctgaggaccaggagtgcctacagggctcttccctgctgctgcttctacttttatattttactcagctctctaaatttatttcagctctaggtaaggttaaatccttctcccatgatctggattttcaggcttcctagtaaggatgtgtgttcactggcagactttccccctctcacaccttggacactcccagttttttggctatctctcagaatttgcagtggcaaaccacttctttcaaagggtctgaattcttttggttttcctagtatgtccctctggtatttcttggagcaaaagttcacagtgtaagtctccatacactgttctgtccagcttcagggatgatttttaagcagctatgagatgtagatgtacaaagttgtaattatttctttacagttgcacccaacttagttcacaagtgtttgtttgtactgatggagaaaagtgcatcttatcaatttaaaggaattcagtta

SEQ ID NO: 447 - DNA, 15099 bp, Homo sapiens
ctcatacatgccaagattttttgctagacttattgtggatatgtaaaatggacccccaaatcttaaagcttagtaaagtaaataaaatctttgaaatacacaaagaaacactaaaaaaatcagtcttaaagcagttcagagaaagaaaaattcatcatcagtcagaatgagagagaaatactctctttcacaaaacactgaagttgctaagtatgtacttacaggagacatatctagatccctatttcatcaattgtccgtgaatttctattgaaattctctaaatgagagaccacaatatacttggatgccatctcagcatatagaccttgtagctgtagtccacataaatatgatccaggtgttactaataagatagagttgccttatttaaaaaaattaaactatcttcccaaaatatgtataagcctcctatagttgactatagttggtgagactattttaccatattatttcattataatggtgcatctgaacacaggtacaattgtagtttcgataaaaattgcagtcactaaagaattagcattttaatacacagtagataatataaatggccttagtttccaaatgattagcaagcatacatttcctactgcaaagaattttactcattaaaatacactttatgggagtaatagatatgtactatgtgtttgttagcgaccacaaatataatgtactgaacaccttgtcaacaaatcgcatacatactccttccagctatttacactatcgacttggtaaaactatttgtatcacaaattataactttatataaatcccatgtatcatgggcttctttgtgaagctcagaataatccaaaattcttcacaactccagctagactgttactaaactcatttcattctgatgtgccttttaaaaactccataatattttatgttgccttacaaattcaggagctacaggtcatttattccagtgctctgacagttctcatgaactatctctttactatttgaattacagtttagtcaacttcaagttataactatggtgaacattgattaaaattagtcatttttcaaatcacaacattcaactcatagatgtgagcactttggctcatctatttgatccttcattcaagggatgatgaaacagattggaagtatgcctctaagaaactgagcttcagagcaaaacaaactctctaccccaaagcatcattaatgtgtcctaaactgtgtatattaaagaatgaaaagtccttagatttttaagcaccatgactttccaaaaatcaagttagtttaataaggcaaaaactacctttagtaaagacataaagaagtattgagcacttacactgtattctagaagaacacaacatcatgtggggtagattaaacgttagcatcaaatgttacagactgaaactcaggcagaggttaagtcacttgctcccaaccacagcaggagttctgtcacggtcaagagcagcatggccttcttacactttcagtccaggcccaagattaatctttcaagaggaaaggatttaatggagaaagcttgtaaatattcatgaagtaatagcaaactaaatattacagaaatctcggataacgtttaaatgctcaaaattgccacctacataaatggaaccaagattctcaaaagaatgtaaaacatgagagtttgtgtaattaaaagttaaagaagcaaaaagactcctgagtcacattgtcgtgatgtggcattaaagtacttgtgtgggaagggttggtcaaatcctaagattgtcccaagaattgctatttattaaagttcttattactagattaaccacaggaaaacttaattggccattagctttaaagaaaaacatctatggaagcaaaataccttattaaatatttaacaggacatggcctacatattgcttaatttagataatctaattatagcaagctaatgcacttagctcatcatcataatacttgaaattatttacctgaatttggctcatcctgactttggttcctatgttatatttcttatgcaattgttttaccataaaatgtctttacttaaacaatttttcaatacaggatcatgagtgcttaaactatatatatctagtttgaacatgtacatagagtagtatatatatatatatatatatatgtattagttttttgtgaaaagacttgtggttctagttggcacttcatctaacaatttagcatgtaaaattaatacagatacttaaaaaatgtacactactatggaatttacaaaaatgttacagaagtgaattcaacaatgtacagacaggtacactatatggatacatttaaccaaaaaaaaaagtaatattctaaacagaaaacatcagcacagagggcagattaaattaagtgcgagaggcaataaagtttacatcagaatgggcaagtaatgcccaaggaaaatttgatcattaaaagggaaacaggtgtaaggacagagtccaagcacagatcacgcctgtaatcctagcccattgggaggccgaggcagatggatcacgtgaggtcaggagttcaagaccagcctgcccaacatggtgaaatcccgtctgtactaaaaatacaaaaattagcttggcatggtggtgcgtgcctgtaatcccagctacttgggaggctgaggcaggagaagctcttgaactctaggactctaggaggtggaggttgcagtgagccaagatggtacactacactccagcctgggcaacagagcgagactctgtctcaaaaaaaaaaaaaaaaaaaactcacaccttgttgatattggtcctattccaggagataggtaaaatgtacattaattttcaggtagattaatttgtattgttcttacatgtcctattcatcagtttattgttcaactaattctgaattctgcacaattgactcttaatagcacattgccttgcaatagcagcccacacttcctacctgcgaagtcatcagtctcaataacttagtctatggaaggtagttttggagcaaggtgcccatcaagattaggtttcttccctcccagggaaaccaatagataggggtgcttcttccttgatgattacatttcagaaatggttcccagatccttgagaaagatattcctgggtcataaagctaagaggcttatttcacttcaaagagactgaaaattgattcacaagtttgttcttttttaaaagtaaatgctctaaaaaaaaaaaaaaaaagaagtaatggggggatggagtctctccccttattttcaacagggaggacgaggcctcttattttccatttgtctttgcctgtacagtcttcaccatacagcacataactcaaagcttcacatacacaagtcaaataacatctattaaaatgagattttatcccatcttacgtgccttgtaaatgtgtatattcttcagaaaatacagacattttggaaacacatttgtgtaagtttaatgatttaatttatgtttctttattttcactttttttaaactgaaaggtcttgctaaatgagaactggcataaattactgtctcaggactgtgctgagaattaggttctgggaatgataagaaaggaaatttttttctaagtgattataatgtcattttcaagttatgcatttcaggtaaattcaattacttttttcccatatctcaaatttatgagtaatttttcaaataattatattaacatgaaaattctgttaaaacagacaatttgtacttttcagaacagacaatttcggagtggcaactgcatatttcagttgttaattcacaacaatgtatatgtgattatccatagtgatggtgagatttgggttccaacacttcaaggaaactcttgcatagattcatttatttgctttacaaggaggaatgactcaaacacagtcctttggagctagaatcagtctatcaaaaagtcatttctccatagaccagggatgttttaaccaatgccacttcacagagagggactttggaaaaagtagtacataagtgcacacattgctcagaaatatttccagagatttcagtattgatgcgtgaatgttgggtatgtgctggcctatcaaaacaatggcctttcttgattttataactatttcctatttaacattcttcaaggcttaaatatattttcctctggtaatgagcagaggaaaggatattttcctctggtaatgagcaggccatggaatctttaaaatactttgtggcccagtgagctttatatttcttttactgttttcctctaatccagaattagagtccctatacacactgactatatttcagtataattttaactacaaggaaaaagctgtgggtctggactttcagagcttggactctgaaaataacaagctaatagaggaccaggtaagtgcacacttcctccccagcaaggcagacagggtaagtgctcacattaaggattaaacaaatgtctgactcagacatttgagggccttagaaacacaatgaaagtttagttgggagtaaaaccatccctataaactttaagcaataaatccggaaagaagagagggaaagaaacaaaaatacaccaagctcgcagcacattcagcattatcattaggtcagcatactctccggcatgcttcctcacagtcatttggagcctattgtcccagagtcatgtggaccctagattatagttccccttaactgctatatggataacaacctgaacattacgagacattaagttttccctctgagatattcattcagcacctgcataccagtgaaactactgatgtcagctgatatgaatgtctccatgaagagctgtctcaacaaagaatgcagtttccacatcctgatgattccatcctcctcacctcaaccaagcaatgacctcaactttccagccactcaccctccatgatcctcataaaaaccgactcaaactcattggagagatggagttgagggtgtcctcttatcaacaccctcagctgtcctacgatcattaaactctttctctgctgaaaactctgctgtctcagtatattggtatgttactgcactaccacataggaacctgttggtcctataacagaagtgacaagtttagagctgtgctctaaaatgaccttatcagcatctcctaaatatctctaaatggtctctccattatccccaccactgtgtctcctctctaccactcttaccacgccaacccatgtctctattctgaatgactcagcagatttctggtcaatctctgcttccccttgcctttctccagtcagttctccatacagcaaccagaatcatgctttaaaaaaaatcttactatgcatttccctgcttacagtaattcaataacttcccactgcattaaaaacccaagctgtcatcctggcctctgagccactcaccactactcatgagtacacaggccaaggcccttggcttcctgaagtttcgctgaaaaattaactcacaaaaggcgggttaattggagaaaaaaatacaaatttatttaatgtgtatacacaggagccttcagaatgaagacccaaacatataggagaaatggtttatgtttatgcttaggctcaacaaagtacaaatcgctatgcagaaatatgattgaacaaaaagggtacgatctaatgctaacaaactaagggggaaaaaacagcaaggcctatctgtctagattttacttgacctctctgggcatgcatttcttccttctgggtgtgggaaaggaccctcttggaaatgaggatcttatgacctacagtcaaacaagataagtcagataatttctttatagccaaattttacaaaggatctggggaaaattagagtaatatttttaggtattgtggttggctttggggaaataggttctggtttctgtgaccagcattggggaaagggattctaatttctatggctagcctttgggaagaatgagactgggaggcagaagggcagaagaaggtcgggaaaaaacctctgaggctgtttatgaggccttcattttgaggtattgttttctgagtccccacataagccttctggttcctcctcctacatgccaagttcattcattctctagggcctttgcatagagctgtctcctcttccagaaatgctcttctctgcaaaacatggctcgattctattcatttagatctcagcttatctatcacatcccaaaagagatcaactctattcaccacaaggagtcactaagtcactttccatcacctacttgcaattttattttttagtgttttggtgacctataagccttctgaccaaaatttaagttccatggaagcagtatcattgtctgtcttgttcagtattatttctccagcaccagcaaattgcttggtacataataggccctcaataaatattttttaaatgagtgaacatacaatagccttatttgaagagttgaaaagcaaaactataaataaggaagcaattactgagataccattactgagatactcctggaagaagtaatgaaagtttgatgtagaattatgatagaaaaggaaaaagtgaactgatgtgagagttgttttgtaggaacagcggtacatggaaaacgttttagcatggggataaagactttcctttaaatagatatacgttaaacaggaaagtatagagggtgcatcatactaaagattatagagaaatgataaaaaagcgtttgtgttaaataaataatcaattgatcattggtggtctcagagactatattttcagcagactgaagaataatcaggactgatatgtaaccaatacacattagtatgacctatatattttaaaattactcctagctacaagcatgatttctactggtgaagaaatgtttttaaaaaatttaagcagcaggcatagaaaaaccatttttcaagaagttcgatgatgacatacagcatggttttctgtgaaatattgtatgagtggccagggatgacttttttcattatttcagtaggttttttgggaaacaggtgtttggttgtgtggataacttctttagtggtgatttctgagattttggtgcacccatcaactgagcagtgtacactgtacccactgtacccagcaattatcttttgccccccttctccctgagtccccaaatttcactgtacaattttaatgcctttgcatcctcatagcttagccaccacttataagtgagaacatacgacatttggttttccattcctgagttacttcacttagaataatggtttccaattccatccagtttgctgtgaatgccattatttcatttcctttttatgtctgagtagtattccatggtgtatatataccacatttttttttaatcaactcattgattgatgggcatttgggctggctccatattttgcaattgtgaattgtgctgctataaacatgtgtgtgtgtcttttttgtataatgactttttttcctctgagtacatacccagtagtgggattgctggatcaacagtagattttctattagttttccatactagatccatactagtagaattgctagatcaagtggcagatctactattggttctccacactgctttctgtagtggttgtactagtttacattcctaccagcagtacctactagtttacattcctaccaccacatccatgagaacatctattatttttttattatggtcattcttgcaggagtaacgtggtattccattgtggttttgatttgcatttccctcataattagtgatattgagcattttttaatatgtgtgttggccatttgtatatcttcttttgagaattgtctattcatgtctttagcccactttttgatgggattctttgggtttttttcttgctgatttgtttgagttcactgtagattctggctattagtactttgctgaatgcatagttttagaagactttctcccactctgtgggttgtctgtttactctgatgattatttcttttgctgtgcagaagcttttgagttttaagtctcatctgtttatctttgtttttgttgcatttgcttgtgggttcttggccatgaagtctttgcctaagccaatgtctcaaagcattttccaatgttctagaatctttatggttttaggtcttagatttaagtctttgatccatcttgaattgatttgtgtataaggtgagagatgaggatccagtttctttcttctacatgtggctagccaatcatcccagcaccatttgttgagtagggtgtcctttctgcacttaatgtttttatttgctttgtcacaaatcaattggctgtaagcatttggcattatttctgggctctattctgttccattcatctatgtgcccattttgatgccagtaccatgctgttttggtgactatagccttgtagtatagtttggggtaaggtaatgtgatgcctccagatttgttctgtttccttagtcttgctttggctatgtgggctcttttttggttttatatgaatttgagaattgatttttctagttatgtgaagaatgatgacagtattttgatgggaattgcattgaatttgtagatcccgtttggcagtatggtccttttcacaatattgattcttcccatccatgagcatgggatgtgtttccatttgtttgtgttgtctatgatttctttcagcagtgttttgtagttttccttgtagaggtctttcacttcattggttaggtattcttaagtattttattttacttttgcaactagtataaaaaggggttgagttcttgaattgattatcagtgtggttactgttggtatataacagtactactgatttgtgtatatgaattttgtatcctgaaactttactgaatgcatttatcagtactaggagctttgtggatgagtctttagagttttctaggtatacgatcttctactccatgatcagtgacagtttgatttcttctttgctgatttggatgtcattatttctttctcttgtctgactgctgttcctagggcttccagtactatgttgaatagaagtagtgaaagtgtgcatccttgtcttgttccagttctcatggagaatgcattcagcttttccccattctgtataatgctggctgtgggtttgtcatagatggcttttattaccttaagtatgtcctttctatgccaattttgttgagcattttaatgataaagggatactggattttgtcaaatatttattctgggtctattgagatgatcatgtgattttttgtttttaattctgtttatgtggtatattattatttattgccttgcatatgttaaactatctctgcatccctaggatgaaacccacttgatcacggtgaattatctttttgatatgctgttagatttgcttagctagttattttattgaggatttttgcatctatgttcttcagggatattggtctgtagttttctttttttgttatgtcttttcctggtttttgtattagggtgatacttgcttcatagaatgatttagggaggattccctctttctcttatcttttggaatagtgtcagtagaattgctaccaattcttctttgaatgtctaatataattcagctgtgaatccagctggtcctgaactttttttgttgataacttttttaattgccatttcaatctcactgcattattggtctcttcagagtttctatttcttcctgatttaatctaggagagttggatatttacagaaatttatccatctcctctaggttttctagtttgtgcacataaatatattcatagtagccttcaatgatcttttgtgtttctgtggtatcagctgtaatatctcctatttcatttccagttgcgcttatttggatcttctcttttctttcgttggttaatctcactaacggtctatcaatttgatttatcttttcaaagaaccagctttttaatttatcttttgtatttcttttgtttcaatttcatttagttctgctctgatctttgctatttcttttcttctgctgggtttgggtttagtttgttcttgtttctccagttccttgatgtgtgaccttagattgtctatttgtgctctttcagactttttgatgtaggaatttcatcctgtgaacttcctcatagcatgacttttgctgtatcccagaggttttgataggttgtatcactattatcattaagttcaaggaatttttttatttccatctttatttcattgttgacccaacaaacattctggagcagattatttaattttcatggacttgcatggttttgaggattccttttggagttgttttccaattttattccactgtggtctgagagagtacttgatataattttggctctcttaaatttattgaaacttgtgttgtagtctatcatatagtctatcttggagaatgttccatgagctgataaatgagtatatattctgcagttgctgggtagaatgttctggaaatatctgtgaagtccatttgttctagggtacagtttaagtccattgttctttgcagactttctgtgttggtgacccttctagtgctgtcagtggagtattgtagtcccccactactattgtgttgccatgtatctcatttcttatgtctagtagtaattgttgtataaatttgggagctccagtgttaggtagatatatagttagaattgtgatattttcttgttggactagatcttttatcattatataacgtcatcctttatcttttttttactgttggtgctttaaagtctattttgtctgagatagaaatagctactcctgctcacttttgctgtccatctgcatggaatatctttttccacccccttaccttaagtttatatgagtctttatgtgttagatgagtttcttgaagacaatagatacttgtttggtgaattcttatccattctgccattctgtatcttttaagtggagcatttaggccatttacattcagctgtagtattgagatgtgaggtactattctattcatcatgctagttgttgcttgaatactctttttttttccattgtgttattattttatatgtcctgtgaggtttatgctctaagaaggttctattttggtgtattttgaggttttgtttcaagatgtagagctcctttttaacagttcttgtagtgctggcttggtagtggcaagttctctcatcatttgtttgtctgaaaaagactgtatctttccttcatttataagactttgtttagctggataccaaactcttggccaacaattgttttgtttaaggaggctaaacatagtacccccatctcttctagcttgcagggtttctgctgagaaatctgccgttaatctgataggttttcctttataggttacctgatgcttttgcctcacagctgttaagattctttcattctttctttcatcttcattttagttaacttgatggctatttgtctagttggttatctttttgcaatgaatttcctgggtgttttttgagcttcttgtatttggatgcctaaatctccagcaaggcaagggaaatttattgagggaattagtccctcaaatttggtttccaaacttttagatgcatcttctttctcgggcatagcaattgttcttaggtttggttaacaaaatcccagccttcttggtagctttgttcatattttttttaattcttctttctttgtctttgtcagatgaaattaattgaaaagccttgtcttcaagctctgaagttctttcttctacttgtttgattctattgctgagaccttccagtgcattttgcatttctctaagtatgtcctttatttccagaagttgtgattgttttttatttacctgtagcattttaaaatttctttatgttgatatttacctttctctggttcctctctgagtagcttaataatcgaacttctgaattctttttctggcaattcagatatttattcttggtttggatccattcctggtgagctagggtgatcttttgggggtgttaaagagccctttttgtcatattatcagaattgtttttctgattccttctcatttgagtagactatgtcagaggaaagatctgggactcaaaaactgctcttcagattcttttgtcccacagggtactcccttgatgtggtgcttcccctagggatggggcttcctgagagccagattgcagcaattgatatttctcttctgggtctagccaaccagcggagctgcctggctctaggctgctactagggagtgtctacaaagagccccatgaggttatcatcctcgggtctctcagctgtggataccagcacctgctctgttggaggtaggagtggagtgaggtggactctgtgtgggaccttgactttcgttttgtttagtgcacttgttttctcgtatgctggttgtgctggcagtaaagttgtcatgtagacatactgaggatctctggttagacaagatgttacaggtggtaaagttagctgttgtttttctcctttgtggggcagggttgttcttttatgagttgctgtaatggcttgagttggttggcctccagccaagaggtgatgctttcaagacagcatcagctgtggtagtatagaagggatacaagcttgccctaaggtcacctggataagtactcaggtttctcaggtggtgggtgtggccacagagctcccaagagattatgtcttttgtcttctactatcagggtgggtactgaaaaaccatcaggtgagggcagggttaggaatgcctgaactcagactctccttgggcagggcttttggggtgtggttctcaggcctatggagttatgttcccagggggattatgactgcctctgctgcatcctacaggtcaccagtgaagtgggggaaagctggcagtgccaggcctcacccagctcccatacagccagaaaggccagtctcctgctgtgcccctccagcagcactgagtttatatccaggcagccagcgagcagggctgggactttgccgcaagctaccagtctctctgccgagaaatcaagcagggctttcagcttcacctctccctactatggcttctgtgctcatatctgcacttcccatttgccctccacccccagattctgccctgaaaaattttcactcagttgaaattactacaaagttcagctgaaagtttccttcttcctgtagtctttccccagttccactggcaacgctccccaagggcccctgtgagatacggtctggaatgggtccctgagcttccctgaggaccaggagtgcctacagggctcttccctgctgctgcttctacttttatattttactcagctctctaaatttatttcagctctaggtaaggttaaatccttctcccatgatctggattttcaggcttcctagtaaggatgtgtgttcactggcagactttccccctctcacaccttggacactcccagttttttggctatctctcagaatttgcagtggcaaaccacttctttcaaagggtctgaattcttttggttttcctagtatgtccctctggtatttcttggagcaaaagttcacagtgtaagtctccatacactgttctgtccagcttcagggatgatttttaagcagctatgagatgtagatgtacaaagttgtaattatttctttacagttgcacccaacttagttcacaagtgtttgtttgtactgatggagaaaagtgcatcttatcaatttaaaggaattcagttacttctgattttcaaaaatggttcatgtagggatttaaacagttaaaggtttcccacctcccagggatgatgcatagtcttagcttgctgacactgggtgaaggatatctgttcgcatcctgtacttgacccaccagcccactgagcagagctgcgctcctctcccttgggcttgtgtgtgatgacagtggatggtctgtggtcttgagatttacacagtccggattctccgaatatttaggcttctctgtggttattttatgatgtcttaggtcaggttgcctagaaacagactcagattcatttgcgttcaatttaacagggaatgccctaaagatcaatccccatgtgaagtagtgcaggaaagaggattgaacactgggtgtgataacaatagaggcctcaggggagttctgcagctgtcctgaattaaccccctttcgggcaaggtggagaggcctttataaccagcacctcctattggctggctactggaacagagttgggctcagggcaattccagagagacactcagcaaggagagccctcaaacaccaatactcccagcacctaaaaaatttagggcctcagttctgaaggagaactcaggatggcacagcacggcattcattgcagttagactcaattcatcagaactgtgcctttgcactctgctcgaacccttcaccaccctcagacccaaaccagggctaaggagctcttagcattcaggaattagtaactctatatgcatatctatctttatatgttacattaagtcttcttcactaagactgataaattcatgaggacaaatatttttgtttaaatcactttcaagtacccagtacctttatacattttactggtagcacataatagatttttattaaatatttaatctattaatacagaaatcttgttttcaatgttagctatgtaaatgctagtcagtggtgaggcagcactcaaattacctagcactttgtaaaaaacatctatttctgaatcctaaactagacctactgaaccagaatttccagggctgatcttagaaaaacaggtatatttgtaacaagctacctatttgagctacagtgcagcattgacccaagaaatttctactgggtttcagctttcatgactcctcacatattggaaataataattttcaattattgaatcgagtaatattcaattattcaaataaaggaaccaaagttcctttttatatcattgtc

SEQ ID NO: 448 - DNA, 6973 bp, Homo sapiens
ctcatacatgccaagattttttgctagacttattgtggatatgtaaaatggacccccaaatcttaaagcttagtaaagtaaataaaatctttgaaatacacaaagaaacactaaaaaaatcagtcttaaagcagttcagagaaagaaaaattcatcatcagtcagaatgagagagaaatactctctttcacaaaacactgaagttgctaagtatgtacttacaggagacatatctagatccctatttcatcaattgtccgtgaatttctattgaaattctctaaatgagagaccacaatatacttggatgccatctcagcatatagaccttgtagctgtagtccacataaatatgatccaggtgttactaataagatagagttgccttatttaaaaaaattaaactatcttcccaaaatatgtataagcctcctatagttgactatagttggtgagactattttaccatattatttcattataatggtgcatctgaacacaggtacaattgtagtttcgataaaaattgcagtcactaaagaattagcattttaatacacagtagataatataaatggccttagtttccaaatgattagcaagcatacatttcctactgcaaagaattttactcattaaaatacactttatgggagtaatagatatgtactatgtgtttgttagcgaccacaaatataatgtactgaacaccttgtcaacaaatcgcatacatactccttccagctatttacactatcgacttggtaaaactatttgtatcacaaattataactttatataaatcccatgtatcatgggcttctttgtgaagctcagaataatccaaaattcttcacaactccagctagactgttactaaactcatttcattctgatgtgccttttaaaaactccataatattttatgttgccttacaaattcaggagctacaggtcatttattccagtgctctgacagttctcatgaactatctctttactatttgaattacagtttagtcaacttcaagttataactatggtgaacattgattaaaattagtcatttttcaaatcacaacattcaactcatagatgtgagcactttggctcatctatttgatccttcattcaagggatgatgaaacagattggaagtatgcctctaagaaactgagcttcagagcaaaacaaactctctaccccaaagcatcattaatgtgtcctaaactgtgtatattaaagaatgaaaagtccttagatttttaagcaccatgactttccaaaaatcaagttagtttaataaggcaaaaactacctttagtaaagacataaagaagtattgagcacttacactgtattctagaagaacacaacatcatgtggggtagattaaacgttagcatcaaatgttacagactgaaactcaggcagaggttaagtcacttgctcccaaccacagcaggagttctgtcacggtcaagagcagcatggccttcttacactttcagtccaggcccaagattaatctttcaagaggaaaggatttaatggagaaagcttgtaaatattcatgaagtaatagcaaactaaatattacagaaatctcggataacgtttaaatgctcaaaattgccacctacataaatggaaccaagattctcaaaagaatgtaaaacatgagagtttgtgtaattaaaagttaaagaagcaaaaagactcctgagtcacattgtcgtgatgtggcattaaagtacttgtgtgggaagggttggtcaaatcctaagattgtcccaagaattgctatttattaaagttcttattactagattaaccacaggaaaacttaattggccattagctttaaagaaaaacatctatggaagcaaaataccttattaaatatttaacaggacatggcctacatattgcttaatttagataatctaattatagcaagctaatgcacttagctcatcatcataatacttgaaattatttacctgaatttggctcatcctgactttggttcctatgttatatttcttatgcaattgttttaccataaaatgtctttacttaaacaatttttcaatacaggatcatgagtgcttaaactatatatatctagtttgaacatgtacatagagtagtatatatatatatatatatatatgtattagttttttgtgaaaagacttgtggttctagttggcacttcatctaacaatttagcatgtaaaattaatacagatacttaaaaaatgtacactactatggaatttacaaaaatgttacagaagtgaattcaacaatgtacagacaggtacactatatggatacatttaaccaaaaaaaaaagtaatattctaaacagaaaacatcagcacagagggcagattaaattaagtgcgagaggcaataaagtttacatcagaatgggcaagtaatgcccaaggaaaatttgatcattaaaagggaaacaggtgtaaggacagagtccaagcacagatcacgcctgtaatcctagcccattgggaggccgaggcagatggatcacgtgaggtcaggagttcaagaccagcctgcccaacatggtgaaatcccgtctgtactaaaaatacaaaaattagcttggcatggtggtgcgtgcctgtaatcccagctacttgggaggctgaggcaggagaagctcttgaactctaggactctaggaggtggaggttgcagtgagccaagatggtacactacactccagcctgggcaacagagcgagactctgtctcaaaaaaaaaaaaaaaaaaaactcacaccttgttgatattggtcctattccaggagataggtaaaatgtacattaattttcaggtagattaatttgtattgttcttacatgtcctattcatcagtttattgttcaactaattctgaattctgcacaattgactcttaatagcacattgccttgcaatagcagcccacacttcctacctgcgaagtcatcagtctcaataacttagtctatggaaggtagttttggagcaaggtgcccatcaagattaggtttcttccctcccagggaaaccaatagataggggtgcttcttccttgatgattacatttcagaaatggttcccagatccttgagaaagatattcctgggtcataaagctaagaggcttatttcacttcaaagagactgaaaattgattcacaagtttgttcttttttaaaagtaaatgctctaaaaaaaaaaaaaaaaagaagtaatggggggatggagtctctccccttattttcaacagggaggacgaggcctcttattttccatttgtctttgcctgtacagtcttcaccatacagcacataactcaaagcttcacatacacaagtcaaataacatctattaaaatgagattttatcccatcttacgtgccttgtaaatgtgtatattcttcagaaaatacagacattttggaaacacatttgtgtaagtttaatgatttaatttatgtttctttattttcactttttttaaactgaaaggtcttgctaaatgagaactggcataaattactgtctcaggactgtgctgagaattaggttctgggaatgataagaaaggaaatttttttctaagtgattataatgtcattttcaagttatgcatttcaggtaaattcaattacttttttcccatatctcaaatttatgagtaatttttcaaataattatattaacatgaaaattctgttaaaacagacaatttgtacttttcagaacagacaatttcggagtggcaactgcatatttcagttgttaattcacaacaatgtatatgtgattatccatagtgatggtgagatttgggttccaacacttcaaggaaactcttgcatagattcatttatttgctttacaaggaggaatgactcaaacacagtcctttggagctagaatcagtctatcaaaaagtcatttctccatagaccagggatgttttaaccaatgccacttcacagagagggactttggaaaaagtagtacataagtgcacacattgctcagaaatatttccagagatttcagtattgatgcgtgaatgttgggtatgtgctggcctatcaaaacaatggcctttcttgattttataactatttcctatttaacattcttcaaggcttaaatatattttcctctggtaatgagcagaggaaaggatattttcctctggtaatgagcaggccatggaatctttaaaatactttgtggcccagtgagctttatatttcttttactgttttcctctaatccagaattagagtccctatacacactgactatatttcagtataattttaactacaaggaaaaagctgtgggtctggactttcagagcttggactctgaaaataacaagctaatagaggaccaggtaagtgcacacttcctccccagcaaggcagacagggtaagtgctcacattaaggattaaacaaatgtctgactcagacatttgagggccttagaaacacaatgaaagtttagttgggagtaaaaccatccctataaactttaagcaataaatccggaaagaagagagggaaagaaacaaaaatacaccaagctcgcagcacattcagcattatcattaggtcagcatactctccggcatgcttcctcacagtcatttggagcctattgtcccagagtcatgtggaccctagattatagttccccttaactgctatatggataacaacctgaacattacgagacattaagttttccctctgagatattcattcagcacctgcataccagtgaaactactgatgtcagctgatatgaatgtctccatgaagagctgtctcaacaaagaatgcagtttccacatcctgatgattccatcctcctcacctcaaccaagcaatgacctcaactttccagccactcaccctccatgatcctcataaaaaccgactcaaactcattggagagatggagttgagggtgtcctcttatcaacaccctcagctgtcctacgatcattaaactctttctctgctgaaaactctgctgtctcagtatattggtatgttactgcactaccacataggaacctgttggtcctataacagaagtgacaagtttagagctgtgctctaaaatgaccttatcagcatctcctaaatatctctaaatggtctctccattatccccaccactgtgtctcctctctaccactcttaccacgccaacccatgtctctattctgaatgactcagcagatttctggtcaatctctgcttccccttgcctttctccagtcagttctccatacagcaaccagaatcatgctttaaaaaaaatcttactatgcatttccctgcttacagtaattcaataacttcccactgcattaaaaacccaagctgtcatcctggcctctgagccactcaccactactcatgagtacacaggccaaggcccttggcttcctgaagtttcgctgaaaaattaactcacaaaaggcgggttaattggagaaaaaaatacaaatttatttaatgtgtatacacaggagccttcagaatgaagacccaaacatataggagaaatggtttatgtttatgcttaggctcaacaaagtacaaatcgctatgcagaaatatgattgaacaaaaagggtacgatctaatgctaacaaactaagggggaaaaaacagcaaggcctatctgtctagattttacttgacctctctgggcatgcatttcttccttctgggtgtgggaaaggaccctcttggaaatgaggatcttatgacctacagtcaaacaagataagtcagataatttctttatagccaaattttacaaaggatctggggaaaattagagtaatatttttaggtattgtggttggctttggggaaataggttctggtttctgtgaccagcattggggaaagggattctaatttctatggctagcctttgggaagaatgagactgggaggcagaagggcagaagaaggtcgggaaaaaacctctgaggctgtttatgaggccttcattttgaggtattgttttctgagtccccacataagccttctggttcctcctcctacatgccaagttcattcattctctagggcctttgcatagagctgtctcctcttccagaaatgctcttctctgcaaaacatggctcgattctattcatttagatctcagcttatctatcacatcccaaaagagatcaactctattcaccacaaggagtcactaagtcactttccatcacctacttgcaattttattttttagtgttttggtgacctataagccttctgaccaaaatttaagttccatggaagcagtatcattgtctgtcttgttcagtattatttctccagcaccagcaaattgcttggtacataataggccctcaataaatattttttaaatgagtgaacatacaatagccttatttgaagagttgaaaagcaaaactataaataaggaagcaattactgagataccattactgagatactcctggaagaagtaatgaaagtttgatgtagaattatgatagaaaaggaaaaagtgaactgatgtgagagttgttttgtaggaacagcggtacatggaaaacgttttagcatggggataaagactttcctttaaatagatatacgttaaacaggaaagtatagagggtgcatcatactaaagattatagagaaatgataaaaaagcgtttgtgttaaataaataatcaattgatcattggtggtctcagagactatattttcagcagactgaagaataatcaggactgatatgtaaccaatacacattagtatgacctatatattttaaaattactcctagctacaagcatgatttctactggtgaagaaatgtttttaaaaaatttaagcagcaggcatagaaaaaccattt

SEQ ID NO: 449 - DNA, 1336 bp, Homo sapiens
acgaagactctaccaaaactttagaaaccaaaatgtctgaaagaggtttatgacgggaaaagaatcatgggatttgtggatcgacttggttcttagggaacacctactacaaccctacaacccactcatttcacatataaggaattagaggccagaataagggaagggatttgcccaaggaaggtcatatggcaaatgacagcagacccagcaccaagtcccgggcctcctgacttccaggcaatggccccacgttcaggaagggccaacctgtcagaatcagcagagacaaaaattctctaaaaatagcactccaaacacaaacacttcttaaatggaatcatgcagattttatttttgaaaccagtgagcacacaaaggctctttaaaaatattaaaatagcatactttttaaagaatgatgaggaagtggtcatatgtttggtactataaaacgagatcacaactcaatctccaaaaatacaaaaaaaaaaaaaaaaaaaaagagagagagagagagaaaggaataacattgcgggaatgtggcttcccttctcagaagtcacacagtcttcccgccaggatcagattggtaatcagtcaccactgaccacaggaaccagcagtaaagagccagtggactgatgcctctgtctgccctcagacccttccctttgggcctctaagacaatggatgggaagacaaagcaggggagaaggggctgttgctctgcttcctgaaaaatcccaaaggatcatagagcttctggttttctgacaaaaagtagaagtggaaaaccttttgaaaagtcattttcttcacatgttggggaataggttgaagtgaggaaaagtgggagtgggggacataagttatctccagacatgaacactaatagcttggctttcaattccagacaggcaagctcagctttgtcaactgaagacttgtcctactacttcagaggaataagactgataatttagggatttaaaaagctaactctggagtcagcattactaattatatgaccttgggcaaattactcaaccactggcagacctcctttctaaatctgataagtgcaattcatattgtatccacctcgtagggctgcagtgaggattaaatggattgaggcataaaaagtacttgttaggacagtgcctggcacatagtaagccttaactttcaaaagatataaacaccttcatagaaacataaggtatgatgaggaggagcgtattatctcatccattctctagtgatcccccaggaaaggttaacttataaagtactgtgtctagctgcaaaggtgctagtaggattatatac

SEQ ID NO: 450 - DNA, 3309 bp, Homo sapiens
gcctcctcataagactagcaacctcaaaactttgaaatataatgcaaatgtgacccaaattctgtttttaaaaaacattaaaaaatatatatatatatatacacacacacagacagacagacatacatacatacatacatacatacatacatacatacatacgggagaggatgttcataagcaaagaaaaaaagacaaaaaatactgaaataaatccattaaaatattaagaataattatttctgagtggtaaattacattcattttccttttttgcctatctatattgcctagttttcctacaatgctgtattacttactcatccttatattagttgagtaaaaagagttaaaaattgaaactagccacacagcaaaagtgctgaaattatcatcagggaggcctccctgctggtcgtgtaagcagaagctgacctttctgcccacttctctcctcctgtactgcagagggcattatcagatcactcaccgtgttgatcagcctgagctgagtgctagaattgcttcgtttacaagttttagtataatcttttaaaatccttttatacaacaagaagatgaaagccataaagaaggaagacagcacagtatctagaaagtgcaactgacctggtagctaggacacctgtgttctggacctgtctctctgacttgctcactgggtgacccttcccctttctgggcctcagtttccctatttgtaaagggaaagagttgtactagatcagtagttcacatggaccacagacttctccactccatgggcaggctgcatctcaatcgactgggaagctttttgaaagacagattccacactggtcaggagtcagaaaaagttcctcaggtgactgggatgtgcagaaagttcctcaggtgactgggatgtgcagtcaggtttcagacccaagaaccagacttgtagactataactccatatggatgaggactgtttttaccttgtcctcgtctgcttccctgtgctccacagcagtaggttctcaagagatattgcttgaataacaaaaatataaattaataaaatccctcccagcaattatgcaggtatgctagtagctcctagcagttgctctaaactaacagcagatggtgctgttgtaccaacaatggctctctctaactgacaggtttaataaaatttgttgagttccaaagctgcctcaccttcctttcctccatgctcagcaggaacacgcattccctgagagatggcctcttttttcccctaaccatctggtggcattgcccacaccctgctgaggaagcgagctgcgttccaggcactcaggcaactctgcctctgccctagtgcagcctcatccataaacattcatgcagccgtttcctggacctagagccacaggggctcctggcacctcaaagggcctcaggcagccaaaggccagggcctttggtctctgggtcttcagccaaaaacacccacctcgacatgcatgtgggttcccaactccagaggtgagacttgcccaaatcttacgaaagtgaagcactgaagaaaggctgacctgggagcctgaggccagggctctgacagtaacctcaggaaaaaggcttggttttgatttcctaaatcaaggtcagtgtgcctcccagggacactggactcccaggcaatagaggtgtcaccctccaggtcctccagtgtaggtaagagacaggactagggccaggtgatgtccacccagcaataaccatttcagcagcgtggcagagacaaagcagctgtagtctccaaaggcggctccctccacagagacaagcctgagcttcctaaggcaggtctgccctccaacttcgtgcctggctgcctccccaggctttcggccctaggagcagtcacacatctcagggtgtgctgccccaggcatgctgagctctcacccttacgtcacaacagaggatttctagggagtacgaagactctaccaaaactttagaaaccaaaatgtctgaaagaggtttatgacgggaaaagaatcatgggatttgtggatcgacttggttcttagggaacacctactacaaccctacaacccactcatttcacatataaggaattagaggccagaataagggaagggatttgcccaaggaaggtcatatggcaaatgacagcagacccagcaccaagtcccgggcctcctgacttccaggcaatggccccacgttcaggaagggccaacctgtcagaatcagcagagacaaaaattctctaaaaatagcactccaaacacaaacacttcttaaatggaatcatgcagattttatttttgaaaccagtgagcacacaaaggctctttaaaaatattaaaatagcatactttttaaagaatgatgaggaagtggtcatatgtttggtactataaaacgagatcacaactcaatctccaaaaatacaaaaaaaaaaaaaaaaaaaaagagagagagagagagaaaggaataacattgcgggaatgtggcttcccttctcagaagtcacacagtcttcccgccaggatcagattggtaatcagtcaccactgaccacaggaaccagcagtaaagagccagtggactgatgcctctgtctgccctcagacccttccctttgggcctctaagacaatggatgggaagacaaagcaggggagaaggggctgttgctctgcttcctgaaaaatcccaaaggatcatagagcttctggttttctgacaaaaagtagaagtggaaaaccttttgaaaagtcattttcttcacatgttggggaataggttgaagtgaggaaaagtgggagtgggggacataagttatctccagacatgaacactaatagcttggctttcaattccagacaggcaagctcagctttgtcaactgaagacttgtcctactacttcagaggaataagactgataatttagggatttaaaaagctaactctggagtcagcattactaattatatgaccttgggcaaattactcaaccactggcagacctcctttctaaatctgataagtgcaattcatattgtatccacctcgtagggctgcagtgaggattaaatggattgaggcataaaaagtacttgttaggacagtgcctggcacatagtaagccttaactttcaaaagatataaacaccttcatagaaacataaggtatgatgaggaggagcgtattatctcatccattctctagtgatcccccaggaaaggttaacttataaagtactgtgtctagctgcaaaggtgctagtaggattatatac

SEQ ID NO: 451 - DNA, 5865 bp, Homo sapiens
attctgtataggctacccttactcttataagattctccactcccacagtaaaacatcacagaccaacttcctgcacttttcatgaactcatgaagaaacttatggaagactgtaatcccagcactttgggaggctgaggtgggtggatcacagggtcaggagatcgagaccatcctggctaacatggtgaaaccctgtctctactaaaaatacaaaaaaattagccaggcatggtggcaggtgcctgtagtcccagctactggggaggatgaggaaagagaatggcgtgaacctgggaggcagagcttgcagtgagcccagatcacaccattgcactccagcctgggcgacagagcgaaactctgtctcaaaaagaaaaaaaaaaaaaagactgaacaaaaagcagcagaaaactctgcagacttaaatgtccctgtctgacaactttgaagagagtagtggttctcctagcacagagtttgagatctgagaatggacagactgcctcctcaagtgggtccctgacccccaagtagcctaactgggaggcacctccaagtgggggcagactgatacctcacacagccagttacctctcagagatgaagcttccagaggaacgatcaggcagcaacatttgctgttcagcaatactcgctattctgcagcctctgctgctgatacccaggctaacaggttctggagtgttaactccagcaaactccaacagaccagcatctgaaggtcctgactgttagaaggaaaactgaaaaacagaaaggacatccacaccaaaaccccatctgtacgtcactatgatcaaagacaaaggtagataaaaccacaaagatggggaaaaaacagagcagaaaagccgaaagttctaaaaatcagagcacctctccccctacaaaggagtgcagctcctcaccagaaatggaacaaaactggatggagaatgactttgacaagttgagagaaggcctcagatgatcaaacttctctgagctaaaggagaagtttaaacccatcgcaaagaagctaaaaaccttgcagaaagattagaccaatggctaactagaataaccagtgtggagtagtccttaaatgacctaatggagctgaaaaccaaggcacgagaactacgtgacaaatgcacaagcctcagtagccgattcgatcaactggaagaaagggtatcagtgattgaagatcaaatgaatgaaatgaagtgagaagagaagtttagagacaaagagtaaaaacaaacaaacaaagcctccaaggaatatgggactatgggaaaagaccaaatctacgtctgattggtgtacctgaaagtgacggggagaatggaaccaagttggaaaacactctgcaggatattatccaggagaacttccccaacctagcaaggcaggccaacatttgaattcaggaaatacagagaatgccacaaagatactcctcgagaagagcaactccaagacacataattgtcagattcaccaaagttgaaatgaaggaaaaaatgttaagggcagccagagagaaaggtcaggttacccacaaagggaagcccatcagactaacaatggatctctccgcagaaactctacaagccagaagagggtgggggccaatattcaacattcttagagaaaagaattttcaacccagaatttcatatccagccaaactaagcttcataagtgaaggagaaataaaatactttacagacaagcaaatgctgagagattttgtcaccaccaggccagccctaaaagagctccttaaggaagcactaaacatggaaaggaacaatcagtaccagccactgcaaaaacatgccaaattgtaaagactatcaaggctaggaagaaactgcatcaactaacgagcaaaataaccagctaacatcataatgacaggatcaaattcacacataacaatattaaccttaaatgtaaatcggctaaatgcgccaattaaaagacacagactggcaaattggataaagagtcaagacccatcagtgtgcggtgttcaggagacccatctcacatgcagagacacacataggctcaaaataaagggatggaggaagatctaccaagcaactggaaaacaaaaaaaaggcagggcttgcaatcctagtctctgataaaacaaactttaaaccaacaaagatcaaaagagacaaagaaggccattaaataatggtaaagggatcaattcaacaaggagagctaactatcctaaatagatatgcacccaatacaggcggacccagattcaaaaagcaagtccttagagacctacaaagagacttagattcccacacaataataatgggagactttaacaccccactgtcaacattagacagatcaatgagacagaaagttaacaaggatatccaagaattaaactcagctctgcatcaagcagacctaatagacgtctacagaactctccaccccaaatcaacagaatatacattcgtctcagcaccacatcacacttattccaaaattgtccacatagttggaagtaaaacactcttcagcaaacgtaaaagaaagaaattataacaaactgtctctcagaccacagtgcaatcaaactagaactcaggattaagaaacccactcaaaactgctcaactgcatggaaacagaacaacctgctcctgaatgactactgggtacataacgaaatgaaggcagaaataaagatattctttgaaaccagtgagaacaaagacatgacataccagaatctctgggacacatttaaagcagtgtgtagagggaaatttatagcactaaatgcccacaagagaaagcaggaaagatctaaaattgacaccctaacatcacaattaaaagaactagagcagcaagagcaaacacattcaaaagctagcagaaggcaagaaataactaagatcagagcagaactgaaggaaatagagacacaaaaaacccttcaaaaaatcaatgaatccaggagctggttttttgaaaagatcaacaaaattgatagaccgctagcaagactaataaagaagaaaagagagaagaatcaaatagacgcaataaaaaatgattaaggggatatcactaccgatcccacagaaatacaaactaccatcagagaatactataaacacctctacgcaaataaactagaaaacctacaagaaatggataaattcctggacacatacaccctcccaagactaaaccaggaagaagttgaatccctggatagaccaataacaggttctgaaattgaggcagtaattaatagcctaccaaccaaaaaaatccaggatcagatggattcacagtcgaattctaccagaggtacaaggaggagctggtaccattccaatatccctgatgaacactgatgcaaaaatcctcaataaaatactggcaaaccaaatccagcagcacatcaaaaagcttatccaccataatcaagtgggcttcatccctgggatgcaaggctggttcaacatatgcaaatcaataaacgtaatccagcatataaacagaaccaaagacaaaaaccacatgattatctcaatagatgcagaaaaggcctttgacaaaattcaacagcccttcatggtaaaaactctcaataagttaggtattgatgggacatatatcaaaataataagagctatttatgacaaacccacagccaatatcacactgaatgggcaaaaactggaagcattccctttgaaaactggcacaagacaggaatgccctctctcaccactcctattcaacatagtgttggaagttctggccagggcaatcaggcaggagaaagaaataaagggtattcaattaggaaaagaggaagtcaaattgtccctgtttgcagatgacatgactgtatatttagaaaaccccatcgtctcagcccaaaatctccttaagctgataggcaacttcagcaaagtctcaggatacaaaatcaatgtgcaaaaatcacaagcattcttatacaccaataacagacaaacagagggccaaatcatgagtgaactcccaatcacaattgcttcaaagagaataaaatacctaggaatccaactcacaagggatgtgaaggacctcttcaaggagaactacaaaccactgctcaacgaaataaaagaggacacaaacaaatggaaggacattccatgctcatggataggaagaatcaatatcgcgaaaatggccatactgcccaaggtaatttataaattcaatgccatccccatcaagctaccaatgactttctccagagaattggaaaaaactactttaaaattcatatggaaccaaaaaagagcccgcattgccaagtcaaccctaagccaaaagaacaaagctggaggcatcatgctacctgacttcaaactatactacaaggctacagtcagcaaaacagcatggtactgggactaaaacagagatatagactaatggaatacaacagagccctcagaaataataccacacatctacaaccatctgatctttgacaaacctgacaaaaacaagaaatgcggaaaggattccctatataataaatggtgctgggaaaactggctagccataggtagaaagctgaaactggatccctttcttacaccttataaaaaattaattcaagatggattaaagacttaaatgtcagacctaaaaccataaaaaccctagaagaaaacctgggcaataccattcgggacataggaatgggcaaggactacatgtctaaaacaccaaaaacaacggcaacagaagctaaaattgacaaatgggatctaattaaactaaagagcttctgcacagcaaaagaaactaccatcagagtgaacaggcaacctacagaatgggagaaaatttttgcaatctacccatctgacaaagggctaatatccagaatctacaaagaactcaaacaaatttacaagaaaaaaacaaacaaccccatcaacaagtgggtgaaggatatgaacagacacttctcaaaagaagacatttatgcagcaaacaggcacatgaaaaaatgctcatcatcactggccgtcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaactattgtggaagacagtgtggcgattcctcaaggatctagaactagaaataccatttgacccagccatcctgttactgggtatatacccaaaggactataaatcatgctgctataaagacacatgcacacgtatgtttattgcggcactattcacaatagcaaacacttggaaccaacccaaatgtccatcaatgatagacaggattaagaaaatgtggcacatatgcaccatggaatactatgcagccataaaaaaggatgagttcacgtcctttgtagggacatggatgaagctggaaaccatcattctcagcaaactatcgcaaggagaaaaaaccaaacgccgcatattctctctcataggtgggaattgaacaataagaacatttggacacaggaaggggaacatcacactctggggcctgtcgtggggtggggggaggggggagggataacattaggagatatacctaatgtaaatgacgagttaatgggtgcagcacaccaacatggcacatgtatacatatgtaagaaacctgcacgttgtggacatgtaccctagaacttaaagtataataaaaaaataaataaaataaaatggtaattgta

SEQ ID NO: 452 - DNA, 40686 bp, Homo sapiens
agaggtttgtatctatgatatcatattgagattaattcacttaatggtagcagtgcagcaatcgataaatgctttgactttgtactaagatgaaagtcttacttggataaaaacttacagagctgattttgttaccttaggaaaggcggaatgatttaagcttggcaaatgcatctaaaataagtgttcattattctatttaggtaaagctggagggatttatctggtgatgtgctttatgactgtccttggctctgtctacctcaacaatttaataaataacagaatgaggacattggttgcagagtgatcatatttatgctctatccattcacttacacagaaattcatatttacagagtacctcctatgtgtgccaggcactatcttaggacatgaaatgcagcagtgaacaaaacacaaaaaatgtattgccttcatagatttttacattaaaatgtggaaagagagtcactcacacacaaaaaggacaaacaaaacatataccatattagagataggcactgtataccatattggtgataggcactattaataaaacgaatgaagtgggtagaaagtgccaagggttcacaatttttaatagggtagtcaggtaaggcctcgggagttgttgacatgtgactaagacttcacagatgagggagtacattatttagatatatgggggaagagcagagggaacaagtgcaaaggcctgaggcaagaaacatcaagtgtgactggagctaagtaagccagatgtgatgtcagagaggaacagagtgaggccgtacccgcagagctttgcaaatcatgaaaagatgttggctttacttgtgagttagtcaatgaagtattcagaacaaaggtgttacatgactttacttgttttttagatggtgtgattctagttgatagggtagaaaaccaattgtaggaaaaataaatgatggaagtaaggagagctactacagtaatgcatccaaaaggtgatgataacagtaattattgaggtggtagctcaatttctggatatttgttcattattgaggtaaaatttacattattcatactgtgtaccaggcactgttttttatgatatattatggtttaaaaaagacttaacatgaggtctacaatcttagcaaatatttcagtgtacagtacagtgttgttaactataggcacaacgttgcatgcagatctctaggacgtattcatcttacataactgaaattttacactcattgaacagcaatctcttatttccccacctctctttcagcctccagcaaccaccattctaccctctgcttctaggagttttactattttagattcctcatataagtatctgcccttttctgcctggcttatttcaccctgcgtaaggtgttcagagttcattcatgttgtcacatggataggatttccttcttttttaagtctacataatattccattgtatgtatatcacatgtttttcctactcatccatcaatggacctttaagctgttttcacatcttggctattataagtaatgttgcaatggacatgtgaggtcaaatatctctttgagatccctattttaattcttttggataaatgcctagaaatgggatatttggattgtttggtacttataatttttcaaggaacccccacactgtttgccatagaagatgcactgttttacattcccatccacagtgtacaagagttccaatatctccacctctttatcaatacttgttattatttgtttcttggtaatagacatcctaataggtacaaggtaatatatgaataggttttaatttacctttcctgatgattagtgatattgagcatcttttcatatacacggtgttcatgtgtatatcgtctctgaagaaacatctattgaaatcctttgcccatattttacttgggtgaaatatggcaagaggtgtggctatttatttgtagtgattccttatatattttagatgttaaacttttattggatatatagtttgtaaaaattttctctcattcaagacatttccatacagtagatttctttcactttgttgattatttcctctgttctgcagaagcttcttagtttgatatagtcttacttgtctcttttagtgtttaatgtctgtgtttttggtgtcatatccaataactcattgcctagaccaaatatcaaggagcttcctccctatgttttcttctaagggttttacagtttcaggtattccatttaagctattaattcattttaagttgatttttgtctatcatataagatagggtttaatttcaatcttttgcatgtggatactagttttcctaccaccatttgtttaagaggctattctttcctgattagatacactggcaatcttgtcaaagatcagttgaccacatatggatgagtttatttctggactctctgttttgtaatattggtttatatgtctatctttatgccagtaccatactattttgattattttaacattgtcatgtattttggaatcagtaagtactgtattttgaagtctgaggcctcaaaatttatttttctttctcaggattgattttggcttttcatggcctgttgtgggtttctagtgaattttaggattatatttcctatttctgtaaattatgccattggaattttgatagggattgcattgattctgcatattgatttgggtggttggacattttaacaatattaagtcttccagtctttggacttttgatgtctatttgctgtgttttttaaaatttctctcatcaatgcagtgtttttttgtaaacaagtctttcacctccttagtttattcttacatattttattctttgtggtgcacctgtaaatgacactgtttgcctaattaccttttcagatagttttttgctagtatacagaaatgaaactgatttttgctggttgattttgtatcctgcaactttactaaatgaatttatttgttctaacagtgctttttctggagtctctaatgttgtctaagatcatttgtctatgtgtctatagactttagtgttgtctatgtataagattatgtgtatatatgaatacatatatacgatcatgtaagatggagtcggaatattttagttctttctgtttttgatgtcatcagtttctttttctggcacagttgctctggagagaacttctagtaatattctgaaagaagtggtgagagtggcattcttgcctcattcctgattgtagagacaagctttctgttcttgttaagtctgatattagttgtggacttttcatatatcactcttgttatattcaggtaatttcctttacttctcattttcgagggtttttatcataagaaggtgttgaattttgccaaattctttttgtgcatatgttgagatgatcctgtgatttttatcctttattctgttgatttgctgtatcacgttaactgatttgggcatgttgaacatccttgcatcacaggaataaatgccgcataatcatcatctatgatccctttaatgggctgtgggattccatttgctagtattttttgaaaatttttgcatctatatccatcatagatattggtgtgtagttttcttgtggtttctttgcctggctttgatatcaggataattaccagcctcaagaattgagtttgtaaatgttccctcattttcttttttttttttttccaacagcacattgaaacaatattttactattatcgagtgcagtttatcccagggatgtaaagataatttgacacaggcacatcaataaatgtgatgcatcacattaacagaaaggacaaaaaccctctgatcatttcaaaagacacataaaaagtatttgacaaaattcagcatatactcataataaggaaaaattgtgtacttgattaaatggtttctgctgcttttttctcttttctttttaaaaataatttcaacttttattttagtttcagggagtgcatgtacggattttttgcatgggtatattttatgatgctgaggtttgaggtacagatgaccctgtgtgatgagcataataaccagtaggtagtttttcaccccacatctccttcttccctcctttagtagtccctagtgtctgttgtttgcatatttatatccaagtgtactcaacatttagctcccacgtatcagtaagaacatgtaatttttggttttctgttcttgcattaatttgcttaggataatggcctccatctgcatccgtgttgctgcaaaagacatgatttcattctttttcatggctgcataatattccatggtgtttatgtaccacattttctttatccaacccaccatgagtgggcacctagattgagtccgtgtctttgctattgtgaatagcgctgagatggacatgcaagtgtatgtgtatttttggtacaatcatttattttcctttgggtatatatccagttccctcattttctatttcatattttaaatatttggtagaatttagtagtgaagtcatcttatcctgggcttttattttttgagaggtgtttgattactgattctatttctttatgatgtagttttgatatgtgtgtttctagcaatttgttcatttattctggattatgtaatttgttagggtataatttttcatactagtctcttatgtgatctaacatatgaaatactctggagaaagatgcatgtctgagaagagtgtgtattctgctcctgtttggtagaatgctctttaaatgtcaggtccattttttctttaatgttattcagattatctgttttcttatcgatctgtctggatgttgtgtccattattgaaaatgaggtgtgaagtctcctgctattattgtattgtggtctatttctcctttcagttctgtcaatgtttgctttatatatcgaggtgctctgatgttgagtgcatatatatgtttatcatggccctatcttcttgacgcattgacccttttatcattataaaagctttttctttgtctctgaaatagtttttgacttaatggtcatttgtctgatgtacccctactctcttttggttatgatttataatatatgggatatcattttctatcccttcactttcagccaatgtgtgtccttaaatctaaagtttcttttttttaatctgttcagtcactctatgtcttttgattagagagtttaatccatttaaagtaattattgataggaaaggatttgctattgacattttgttagttgtttcttattattcttacagtacttttgtatgtcttcctctcttgttttccattgggttttgttggggttttttttggtattgttatgcctcaattagttttttgttcttgttgttttgtgtaaattttacagatttgtatgtgtgtgtgtgtggttaccttgctacttacataaaatatcttacaactgtctactttatgctaataagttgaattgcatacaaaaacttacaatttaacttcctccccagaacatactttatgttattattttcaaaatctattcatattatttatcttttaataattgtgtttgtatctttatagttttcaaaataattttttcttttaacttttatgctagaattaaatgtgttttacccaccaccattacaataatacaatattttatatttgtgtatatatttacttttctcaaccagttttatactttcttatgctgtcatgttgctgtttaatgccttttcattttgaattgaagaacaccacttaacatttcttgtaaggcaggtccggtgttgatgatctccctcaatttattttgtttggaaaagtctttatctctctttcatttttaaaggacagtttttgccaggtggagtattatttgatgacagttttatttttctttttccttcagcactttgaatatatcacctcatcttctgccctacatggtttctgttgataaatttactcatagtctcatggatatttccttgtatgggactggtcacattttcttgatgaattcaaaattctcgtttgtctttgacttttgataatttgattataatgtgcctcagtgtgtatttctttgaatttgtcttattgatgttctttggatttgtggatatggatgttcattaacttccccagatttgtgaagccttcaacaattatttctttgaataagttttctggttgtttttctctattatcattaagagacttccataatttgtatattggtctgcttgctggtattccataaatttcttaagctttctttaaatttttttctattctttttttctctttttactcctccgagttatttccagtgacttctattccagttcgctgatactttcttctgcttgatctagtctgctgctgaacccctttagtgcatttttcaggtcacttgtgttcttcagcttcatgattttggtttagtactttgtaatattttctctttctttgttgaaattcttactttcattgggctctcaaccttatgaaagttatttttaattcattgtcaggttaaccatttcattagggttgatttctggaagtttatcttgttcctttttttggagcatcttagtcggattcttcatttttcttgactctctctgttggtatctgcacattagacaaagcagacacctctatcagtctttactgacttgacttgtacagaaggctcccaccaatcaacctacccagggattctggtggcctctatcaactcttttcctcccacaggaagggaaggcttttgtcagcttactctgtgataaactgaagctatggtgtctataacccactgtttctatttttcctcaggtggctagattgtgccatctccatcagagcttcaggactcacaaggcagaagctagttgtttaggaagccctagagatattgtagcattggatacacagatcaactctttcctttccaagaagaaagctgaaaaaaaattgggattttttttgtttgttcgtttgctcactctgtgctgagcagtggggagtatcaatggcctgtaccagcccaagatgttgcctgcattcttcctcaggtgtctagactgtgctgggcccatcagagcttcaaggctagcaaggcaaaggccagttctctgtgtccccccgccccgactccccaccctgcttccttggaaatgcaagggaactgaacatgggatccaagcccttacctcccctgggtgaaaccaggagcttgggcatctctttctgatcttagggaaccacactgagacaagggtgtctggtgagagggtgtttcatatctctctgtcagcttcagtgagtctggttttgcattctcccaggatgcaggaacctttcaattagtttctgatttcccacacagggaattcttccatcaattgtggctgaatcgatatgcttgtatgaagaaggagagtctaggatttcctgttctgccatcttgctgacatcactctgctacattcttgtatgattagttttgtaggcatatgtttttatgtctcttgggtaaatactaggaatacaattgttggcatacagagtaggcatgtatttaacactgtaaggtatcttccagtttttcaaaatgtttgattttcagtctgactagcaatatatgagatgtcaagttgctctgcattctagctaacgtgttgtgttgtcagcctttttaatgtcagcagtagtgctatgtgtgaagtaaaattttaatgaggtcttaattagcattttctggatttattttttatggacattgagtaggtttatgatgattggatattgtttcaagggaaagagtggtaaaaaggatggcacaagggacatttggccttatcaattaaaaagtagtattgtccattaacagaaatggggatgactgaaatatatgcaggtgggggcaggaaaaggaatataaaaaattcagtattaggtgtgttaattttatattcctattagataagttcaagtagagatgtcaagtaggaggttggctatatgagtttaagttcagggaaatatctatttgaaaatcatcagcatatagatgttaataaagccatgagatttggtgagatcactaagggaggaattttaagtagaaaagagctgagaactaagccctggactcctccataattggacccattaaaagaaaccagaaaaagattttgagattaagtagccagagaggacagaagaaacgagagaatgtgacactcagaagcccaataaaggagagttttcaatagagaagtagtgattaattgtgcctgatattgcccaaagggaggattctgctacattcttagggaacaaaaggttgtggtcagagggtgggatgcttgaagctataattatattcagttctagttattagtaatgtaaaggtctggagaatgatgattgagacagtggctctattaggctgaaggacaagatcacaggaagaaaggaatttaagagacaggtcagtttgttggaagcatgttggaacaagtgatatgcaattggaaaagctttttaaaaatgtgtgtgtgtatgtatttgacaagcaagaataataggctaaatctgtcaatatgtcatttactaagattaaaaaaggaagttttgtattgaggtgtaatatattaaatgcatcagggaaataattatttaacgttaggctatatatatggaatttaatggatttagttgactgtgaacttagtaaagctttgccattagattcttaatgatttccaataaattttttcaaaaaggacttacaaaaaacatggttagtccttatctgtattaaataatttcagcaaccaaagtaagaaaggctgctcctctttacaagcataggtcagccacaccttaaatgtcatgtgccttcacatattctatattgagcatatcaaaggaagagagactaggattatgagcgaagttcaagccttatcacatgactatagtgttatcagacagacaatttcatatatttcccttgagaaaaaaaaattaaggaaaagtaaatgagtggcattttatattcctccttgagcagtagtgacaggagaatgtagagatacccctgcttggcagtattaagaatttttatattttagtgattgatagcactgcttaatcagcaatgtaatccttaaaaaattttgaaaatcagtaaacgagttaactttatggtgaagacatcacattttctggattctaagacaccatcagttacaccatataccattattttatgtagcaaactgccattataattatgatatgccttcatttttaaaactcattctgatttcagaaatattaaaatgtgaaaaaagggttttggtatgtatagtgatatgtagcaattaaaaactgtagctcctcaactttttgttttgaataatgttggtgtcttagtgtgctatgtatctttcacataatccaaatctacaaaaatatatttttgaaaacacatactttttactaaatatcaaatgcttttttatataaaatattatattttattatagttagaagatagctaatgccttctctgaataacttttcaaagcacgttcagctcttagagatcagtaacaaaattcttattgggttaatatcagtttttcagataaaacgttattcttcatttgcttcactgatgccatgtcttttgactattagtaacaaaattaagtctacataaagaatatgttagagataccatgtatcctaattactccacctggggttccttcagcagtttgctctaagttgctcttttggctgtgttgtaaagtagttcacacacttgtaccttctggtttatgggtgaattttgtcagtgcattctatctttatttgtaagagttcttccttgaagtcagattaggctatcgcgggaacagcatgcttctaagatgtttgtgtaatgttgattaatgtgacattgtattgtaactttatggtaataattctttatcatttaaaagcatcttgaattcaagatgtttttactttaatgcagattttcttatgaaggatcctaaaaacttggatgcaataatactgctgaaaaaaacattgtttttgtttttgtttttgtttttttgtgtgaatatgcaccagaaagctggactttaaccttaagtaaatttagtggagagcaaagaagtggcacttcacgaaagtgctatgaagcagctatttctaacatcaaaacatccggtaacttgtaagcttcatagttttctaattactgaatgccggctacatgtaaccatagccattatataatcatgtttaaagatgagagtaaaggaagtggtaaagatctagataatatgtaatcttatttagttaatgtttatgaatgatgcagaaaaaataatttaagaaaaacactaagccatagatatactctttcacagatagccaagtagtgaaggcattaggtacagatcattttggaagtatgtacaggagaatacgggatggatataaaattctgcttatttcttaaagtaattagctataaaatgcttttttactttgaattattaacctttctaattatttgccttcccaccaagaaaggcatgagaggtaaaggtgggatgaatcaatttcatatttttcaatagcaaatttgaagtgaattcaattttggttaaggtagaaaaacttatttcatagaaaaattctgtggggaggtccaggagaaaaattaatattgtatttgcatgccataggtaggatcacagatgaatttcagtggtacccaattacctatatctaagcaaaaggtaaagccatccttcctaaatgatctgtttgattgatagcatctttctcaatatttttgattgtacaggaagaacgcagcaaggcaaaatggtcagcacaggcaatgaatgagacagaaagctgacctgagcatctgcctgtgttctactctgttgtaattttagttgcatcggtataattccatattggcatcatgccgtctttcactttattttgcattgtcatataaagctaccattaaggcatatactctgtcctaaatctcatttgatctctaagtaaaaggtcttaacatatgtaacaaacctgcacgttgtgcacatgtaccctaaaacttaaagtataataataataataaaaaaagaaaatatgtagatgtaattggttattacattcaaattaagttcacattatttcattatgatttatgatttaacttgtgttatgcagtgattcaatagcttttcttattttgtgcctagattcattatattattttttataatcatataatatttattcaattttataaaatctgtcattataacatcacattgagtaaactcccatgtgcagacattaaaacagttaaagcagaaaaaaaaaaaaagctatcaggaaagatggcataccttaggaggtttgctaactaaactaaggaaatctggttctctttctcctcaagatacagccctgtagatagctgcagatttttttcaactgaggtctttgtgacatcagagtattagagtattttctttccttcttgtattctggaggtttaaacagagccctggggataaggcatgatgctatcataggaatagattcttgtcacaagggcagaaggttcatatgtcttttctttcaggtctttttctttagaactgatactctcatttatttatatccaaccttaatttaaaaagaggaggtatggctaaaaatatgcacacattgcaataacataaaatgaattaaaaaatcggaataaaaaggaaacaacactaggaaactcaaatgaagccgagattaaatttagaaagtagaaagggatgctctgcaatgtaaattggaatattgcaagtattgtctttaaataattttttcacttctaaatgaagagaaaacaaatgattataagatttgaagtggtcatgctattaatactaatacctcgggagaaaacaaaaacaatttttgcattccagttctcgtagggagcactgtggtgaggttaacggcatcctcaatgataccctctccagtgagtacaataaaaattattgtaggcattcttcttattgtctacatgtaatataagcccaggagtgacagcaacatgaaaactcagtaaaaagcacgtttataaaacagtgatcatctgaaaacagcaatctctgaggacagaggtctataattgtgtcattttgttactgggataaaaacttagaatatatagaggagtaaattggcaaagtcatcctgtacaggccggagtaaatattttggttttggaggtcatatgttctccatctctacctctcaattctgcctttgtagcatgaaagaaaccataggtaatgtgtaaatgaatgggtgtaccaataaaactttaagcagttagatggtgagccagatttggttcatggactgtcgtttgccaaatctgatctagagaaataggattttattcacattagagattcatctagtctgtaacttctcagagcaaatttttaataaatatttgaaaacaaagattagaaattcaagtacatctttgaaattaaagacctgaaagacattctattaccatgtaagggtactatatgatatagctccccaaccagaaagtggttgatatcttcatttaaaaagtaaaaaatttaaccagagttacctcacctctgaataaggaaggatgaatgagtgtaattaatcggggaacatttcccccttgccccaaattctgcattctccagaacaaatgtatgttcctatgtgactcatggaaagtacaataataaatcatgtgcacctgggaatgatcacccacctaccagatctgtgaacatgagcaagtttttctcacctatttttaactaaatctccttatcaggaagttgggcataataatttattcctcacagggttgctataaggcaaaatgtttagccattggatgaatgattgatatgaatcgatagatcatagtttgggccctaaagaacatgccagaactcccaaactcttgcatatgggactgtatctaactcacagacgtatttgctttgtcctgtgaaacatggactgtataagcatctgtgatgcaaatgagaaaaaaaatggtaactttacatgaaaaaatacattttagggaaaagaaaaacaagtagatctgactgccctgggcctgctgcattgaattaaaacagtccatgtgagcaaggcatgtggcctccagtgtgcacagctgctaccagacacctgtcaccctggagctcagactgggctctgctaccattcacagcccagcttgtcctgctgtgttgctttagtagtgtccataagaaacaaatccttcttggtcccatgtatatatcttttctttttcttttgtatacctggcctgctttgttttttttctattatgttgttcttgttaggatcccagagtaacgtaaagtcagggggttattagtagctctgtgataaatgaattctctagttaagtaagcttaggtatgcttaaggaagcaaagaaaacaggtgtcttctgtgggcctctcattatcgtttaatatattaatgaacagtttcagtttccaagataagagtacaccatacagcaatctcaaactcattttgacaaatacatttttaaaaattttattttaatgccctatatgtcatgaccacttaactactgaccacatttttcccatggaatgtggtttggaaacaatgctctttaaatcctcacagatcttgtaattttaaaataaacatcccagatatatttgttgcaaatggtatccaccaattacctgataattgaacctactttataacattagtggataataatagtatcaagagtaatatacttaagatttattgaaaacttataggcaacaggtaagcacttagctaggttattttatttaatctgcacaaaaattctgtaaagtggattgtcttatccctcttccataaatgataaaaatgaggtagagtgaagctaaataacttgctggcaagtaagacaactaaagtcttttacccttactcttagctgctggatttcactgccttgacttcatgcagtaagagttggaaacatatgctctaaattatatctaaattagattgatcttggaccgtgtttcttcctgtagtaatgatatataaatatcaactgcctgttgaaaatcacttgagcttttaaatgtaaaaccttaatacaagtagaaaagtatacgttagatttattttgtatttgctggaacatatggctggctaattcagtagattcaccaatttataagatttacaaagaagaggtcatgaaacttgatgcttttcagttttaaaaccgtatactatttgatgaaagtttttctaaagaaactgatactcatggttctattaaggcacagatttcttttaccagtccctgagggtactgattagtcctaaactgttctatatttaaggacagtgaaggctaaataaagatcaataaaagctaaaccgaatgttcctgaaatcttttctgcaaacggatagaaatttaaccgtggttagtagagaagtagatatgcctaaactccctttgaactcatgtaatcactcctcaccttgccctgccatcttgtgtataatgttgcccaagaggtacaaacttttaatttattaaggggaaaaaatatgacagagtgttgagacgattttcagtgaggtccagcaatgatctgtaagttgtaagaagccatttgttttccagtaggttgatggagaagaaatacacaaaataattataaaatatcaccacccataattgatgattatactatgtaagtatatatatttatagtatatagtacataggtatatctatacataactaaatatatgtatacatacatgttgtatttcactgataccaagatactattaattataataatacacatcattgatgcaatcagagtttttcagaaagaagataagcatatcaaacaggccaatttttggaagacacgttcagatttcaggaactatcagaattgaaatgtgtcttatgattaagtctgtctggattgctcactattcagatgtaggggttgatacaatgaaagaaaaagataagtttttctaggtagctaggtaaagggcaagggttggtagatctgggaagcaaattaatattttagcatgctgtgaagtttattttagaagctctaaattatgcgggtcaagttccaagccttgttgaattagttggggttgcctttaaatgggtcaccctctaatcatgccttatttgtccctctggtatatttacaggtactgaagatggatggggatcattaggtttctcttattatattgtcccacaaatatcttaaccgtgagtttttcagagtaatatttttccatttgtgtctacagggtaatatatatttgaagaactcatgaccatacatcagtgttcatgtttcactaagattgtttcattttcatccagaaaaaagttttattttatgtaaataatatgtatttttctggctctgaaaatgatgcatggtattgaagacaacttggaaaatgttggtacaaaatagattacttaaagtcacccataatagcccatttacctataatgacataatttgaactgtccattcgtctgctttacatgttttttgatataaagttgagatcacgtagtatatatatatttttaattatttccatttaaaatgaacattgtgaacatgttatctttaaaacaagatgtttagtctgggtagataagcaagcatatgttcaatagttttattcagtgaaataattgctgcttttatacaagttagactcaaattatccatgttattagactgacttcagagaggagagttttataggctatcgttttaaaggaaatttattgtcatataaagctcaacaaggggaaagtagaactaattatcatatttgtaacttgtcactgcattttgtgatactgtattaccatgagctcaggtggtcctagatgcttggaaattttaacaaaggaaattgtacaaattccaatggataatagcaacctcaaatttcatagtatttctgaaaacagcagaaagactccccataattttaaatcattgtcacaagtttacattttcttgagagtctctggtccttaaagtttaataagatagtccaaattgataaaactctttgcccctggttgaagaagtttccatagcatgatggtttattattctcttcccccaaagtatctggtgtctacattcatgttaaaaaacaacaacaacaacaacaaaacagaaaggaaataaatataagagaattgcatagaatttttagaaattaatttaatacacttgcttgtagccaaaaggccaataagtgattagaaattaatttagttaaaattatctgtagtataaatcatttttcctgtgattttaatctctattgtgataagtgttaggcatcacatttcaaaataaggttccttttttagctctgttatttagaattatatctagtataaatgtaagctgttactggattgccgaggtacctggaaattcactgcctttagccattggattaatgtgttaaaggtcaccttaaaaattcctggtgctgtgcaaataataggtgctcagtgaatgcttgactgactctctgatggaagacagctctaataggctcctgaaaggaggatggaaatctagagcattggaggggagaaggaggcaggagcttaggacaacatgattacgtgggtgagagagaaagccactgagaccaaaaaaagaaccaaaaataaattccaaaatgtaaagagtagctaattcttgtttttcccagagacagtattcttttttcatactattttttggtgattttcctttttctgatattatatcctagatagtttatgaaccttaagaggtttttgcatagatgtgcatttgttgcgcattcatagcaatatctaagactgtcatttcagagatttgtatcagtcatctagtgattgataaaaaaatgacatggaacctacttttgagattggatgatgacataataaagtagcttctcattttaattctcataatgactttgtggtcttagttatgttataagtaaatattgacctcctgaatcatatactaccaaatggcaggaactgggctctttagcctgttttatcctttcctctatatagttggatgactcagaaacactcaaaactgcaaggagataccactgcattttaaaacaaagttgattgcctaatcaatgttaagagacattgagagagagagagaaatctaagactcgactttggttaattggattgtccagttgttatcataatgcaggatactgattcatcaatatcactggccttttaggatgagtgatcacagtcttccatgtgcattactttattactgcctttcacactagacgatgcagctatgatgctgtcatacttgcttggtctgaaaatgttgacaagtattgattttctacaaaataatggtacctattaatctcatgttttattaatttctaattttaaaaagcatgggttcagttgaaacattacactggaaaagatgttttatttttgtttataattgtgaaagagaagattttatagcacctgcaactgtctatcacaatatgcagcttcattgtcttttcttgatttccagtagctacctcaataaatcacttatttttaatgtcattcatgaagagtatataaattattgctcttccagttaaacacagcattaatgggaaattgttaatgggaacttgaatcatataaagtatctagaatttcaaaatgacaaatctattatttgttatgaataatagtcctgcagattaatatagctacttcttttttccttttacaaaatgttaatcattcagcctaattctttgcacaatagaagaggagacaaatgttaaacaagacaaaactgtgaattttgaaagatgtctcctactcatttctacatataggatcatttctcactttgtgaaccatagcagaatagaattaaaaataaataattattagtattacgcctgtctttgtattgttttttcttctttgtgtctcttatgcatcactgcatgatttagtaaatattgttctcctgaatcaagatatgcagatgatatttgctttggaagtattacagaggtagaggttgatggatctgaactgttcatcattgtgtgcagttggctattcttttcagtgtggccactatcgccttttcctctatgtacttgtaactagagctaatattgtagagtccatttctgcacttattcaaataacaggtcataggtaaatatgaacttgaataagtgcacaaatttcattgtgtcactgaaaaattattttcaatttgattgacatttgcaaataggaggccgtacttatttgaacatcacctatagatgagtcttgttctacctgctgggttgccaagtctaaatatttttaaataacagtggctatacaggatatagataaaagtcctttccataaataaacaaatgtatacaagagtatgtttgattattttatgaggattttacaatagcttttcaggattcagtttcaagtcagttctctctttctgtctctgggggcttgcatgtataaacatacatgcacacgagtgcacactgtggatgtggattatttcattttacctgcatgaaacattgtctgtagtggccattactctgttcctctttattctcttctataaatctcaaattactctttaatatgtgtttatgagacatcaatttttatctgctccatattttaagaaggcaaacacagttaagtcaaaatgactaatgggatggtagggaaaagtatgggctgataaaaattaaatagggcacaaatgattcccctccagagccatccttttaatatggccaattattatgaataaaaaacagcattctaaaacatttcttttaattaaatgttgtaataaagatatatacccctctgctttccaagccacatgttatctgtactatgcttcagcaggcactaacaattcaagagcagttttaagctctagaaccttttacagaagcataggagtcttatttcacaggtttttaaagtgttatgcataatttttgccagaacacaaaagataatcattggaaaaaatctactgtgttttcatcctcttctgtgaacattatttcacctcactactctcccctgacaacactgcattctcaggagcattcacaagccacttgtcatccttcctttgttcccttccaggtcacactcccctagagttcttgaagtgtttcgctcttggctcatcatcaccctcttcaccactactcttgttttaattactgatgatttcaacattgtggtagattatctttctaattatctggcttctcgggtgggtctccctgacccactgcccttcaattttctgtccttcatcctaactcaggcacccagcccatgatcatttcctgcaaccactctgtattctcaatttcaaattgcctaatttccacccacaatactgtctgtctatctttctccctctaatactctagctccaaaaatatttcagtcacacctggaatctaatcctatcatgttttcgcttcctcttgtcctcaccttgtagcaaatatgccacagttccctagtccattgtatttcctacttatacagtagacatttttttcttgactattcaaatctctgccatctcttccttcattctccctcttacttggctaacttggttcttgcctcactgagaaaattgaaggtattctaaaactttcacaaactttcatcatcacatttaaacatctatctgcaacttaactctatctactattgatgaattgtccatggtcttattgaaagccacctcttccaaatgtcaatgagaaccaatcatccctactggaggacactgatttagccgttcagtattgcccaatccttcattacagagagacaaatagctgggcactgtagctcacacctgtaatcccagcattttgggaggccaaggtgagaggatcacttgagcccagtctgggcaacacagtgacatggcaacatggtgaaaattcaatgcaagcctgggcaacatggcaaaaccctgtctctacaaaaaatacaaaaattagctgggtgtggtagcatgtgcctgtagtcccagctactctggggactaaagcgagaagactgcttgagaccaggaagttgaggctgcagtgagccatgccactgcactccagcctgggtgacagaatgagaccctgtctcaaaaaacaacacaatagacgtgctcctgagttatttttaaaaatcaagatcagtttcacagctatgaaggatgatatgatatgatatgtttctgaattagaataatacatatatatatagagagagagagaagaaaatgttatataagtaagttctgaattatgtgttatagacttaacatttgggcatcagtgatgtaagaactattcagaaatgacttccaggtaagacttgagctgtgcattcatggatggagagattctgatatgtggaaagaaaaagcagctgtcccaggcaagagaacacaacacgagcatgtgtgcagacgtacaaatgagctggtatagtcacggttcagaggggaagactgactacctagtataaaggcttcacaagattgttcggaaagagaggtcatagagaaggattcttagaacctgcttcatgatggccttgactttgaggcctaatattagagatgacagtagaatagtcacatggaaatatttactagttaattttgtattttcagaactgagattggataatagaatacactgagtttcatgtcttctttgtttttatacttagaatcttccaaactgagttcacatgccatattttaggatggaggaaaaagacatattgagggctttgaggctgatggtttggtgagcagaggggaaaagcctgggcacatccaaacttctactcactcattaagtgagatgcaggagggacaggcctggtcagcaaaggaggctgtccctgtgagcaggctcacactcaggttcagtttacatttccgccaacctgggcttcaaggtatcaggaggagacagaaggccccatcaggagagtgaggaggtcgatggttgctattcccgttttttttttagatggagtattgctcttgttgcccaggctggagtgcagtgcgcgatcttggctcactgcaccctccgtcttcttagttcaagtgattctcctacctcacactcccaagtagctgggattataggcaagtgccaccatgcccaactaatttttttgtattttttgtagagatggggcttcaccatgttggccaggctggtctcaaactcctgacctcaggtgatccgcccaccttggcctcccaaagtgctgggattacaggcgtgagccaccgtgcctggcccatggttgctattttatgtgttggcagttgggagacctgacagtcatttttctcctaacaaaccaggtcttcacctcacctaaggacatctgatgctgttgttagcatagaaatctcatacctgcattatggtgcagttgaaattttctgatgatggaaatgttctataatatagatagctattgagcacttacaatttcgctagtccaactgagaagcgaagcatttcattttattttaatttatttgaatttaaatctaaatagtcacatgtagttatgggctactaaatttgatagggcaactatagagctaacctctatttaatatttattgggtgtgtcatgtgcctggcctaatctaagaactttatatgtacccttaatattaactatttgaatttccataataatcacaaggattaagcattcaaattttccccattatagtaatgagtgaactggagtagagagaggtttagcataggaaggaaatagcaaggttgggatttaaacctagttagtatatttacagagcttacacaactgtgtctccccatctttaagttctaagttaatcttgctcttctttcttgctgacattcatacatttattcctgtatgttattactatgttcatttatctataaaatatgtcaatctttcttcttgaggtgttatatttttctcccttaccactgccactaaaagagtgcagattcacttaacgtgtgaatgtctgaatacgtttctgatcatcatcctaccacccctctaaacaagtgccagtgaaactttggtgtgcacagaatcacatggaatacagcgtggttgtttctgatacacgaggctcagggtgaggcctgagaatttgaatatctaataagtctccaggtgacagtaatactgcttgcctgtctggagccaccctttgcgaccctgtactctgccttgcaagtctactgccaggctaattgactttaagatagaattgtcagtacgttttggattctttcactgaaagacataacttttcatcattatttgtgtttttgtatgttgtagaaatattaaattatctttttgtcaagagttgaaaatccaactaaaaataatacaggaaagaaggaggagaaagggaagaaggaagggaaagaagcaagaaaaaaaggaaaattggtttatgtaactgaaagcccagatgtagatcaccctctaagatttatgctgagaatgccatcaggtgcccatcaggacagatgtgcctacaaagctatggagaccacaataatatttgaaaacattaaatgcaaatggctattattggaatgtcttcattttttcacaaaggacatcaatgtttcacatgtattgttttacacatttatatcacccccctcagttgaagatttagagtttgctactccagaattaggacaacagcaaatggcattaaggttttgtcactcgtttcttttctccttctgaacagcaatcttttttttttgagacgaagtttcccttttgttgcccaagctgaagtgcaatggcgcaatctcagttcactgcaccctctgcctcctgggttcaagagattctcctgcctcagcctgccaagtagctgggattacaggtgcacgccaccatgcccagctaagtttttgtatttttagtagaaaagggatttcaccatgttagccaggctggtcttgaactcctgacctcaggtaatctgcctgcctcgcctcccaaagtgctgggattataggcgtgagccaccccacctggcactgaagagcaattttttaaacttttttataatgtacttatctcatgtacaatatggtagtgatgatagttttctcagcttcagacttacatgatttagtttctgcaatctaagtgaaaagagcattgctgttttccaatatagtaaaatttcatgattaattctagtgggctcagctttagtctcatgcttacccctctaaagtagctgcggttaggataagggagtatttcctagagggaaactgtgagaaaggtggctacccaaggtagaatttggatcccattacccaggcaaagggggtggtattttggacaacaaaagcaccagagatctgctccacagggtatgaaccaaaatcatgttttgaactgcaactttgataatgttcttttcatctgaaacacagtggccttatgattacctcatcagaaagggctatcaataattcctgttgcgtctcaaaaacctcatccatgaaaactgtaacaacatctgcccctaattaatgtttttcattttaactactgtgacattttattaaaatatttctcatctgtactagataataaaataattgtaaatatgtatatttgctctttttctcttgtatttgcatgcatttgtagataggaattattttaatgcattactatatcatataggtatggtaagtgaatttaatgtttgcccttattttttttttttttggtagaatgttaatctttagtgtgtaaatccaatacttaagatcgatcttcatgctcgttttcactttgtttgaattagtttttgacggaagtaatcacctatcttttaggatgatttttttaaagaaaataattgtgtttatgtaaaaatgaataaagtaattacctggagagtagaaaacaatttatctgttccaggtcatgatggatagaaagtggatataggggatcccatctgggatgtaaagtcaggaaaattcccatggtagcaaaacacaaaaccaaactgctcattcaggtagcaacaagggacgtgtgcactccaacactgcgcagtcctgtcttggcctggtgtctgttgaggtcctattaaattttgctgaagacagtcaatactaacaaagacacacaaagaactgctagctattactttccatgatgtttagaatatcctaaagttataaatcagaattactttaccctccacgagaaacttctgagttgagttttgttgttgttgttgtttgtttgtttttttgatacagtcttcctctgtcacccaggctggagtgcaatgacatgatcttggctcactgcaacctctgcctctggggttcaagtgatcctcctgcctcagcctcctcagtagctaagactataggtgcatgccgccacgtctggctattttttgtattgagttgggttttaaaatagtatctggctttaccaggagaagatggtgaataggaggcaggattaacatgcatctcccacttggccagacagaacagtgtatagaaattcacactgtgaactttgttccgagaaccaccacaggaatgtaccaggaaaaccaaaagaattcagatcctttgaaagaaatgccatgctactgcaaaatcagcgagacaggcaaaaaactgtgagttcccaaagtgtgagaagggaaaaacctgcctccaaacacacatctccactggggaatctgaaaatccagatcacagaaggatttaaccttacctagagctggaatggatttagggagctgtgtgaaatataaaagtagtagcagcagtggaaagagccttgtaggcactcctagtctccagcttgagcccagggaaggcatccctgactatgtctcacagggttccttggggtaggcaaccagaggaattagggagggcttgcagggtaaaagaagcttccaggtgaattttatgatcacttctactaggcacacacttccttgagcagaaactgggggatgaatgggaactgctgcaaacctgagcaaaggagccactgccattgtgagcagatggggagggaggagaggtgtggcctgaaagccatgcttgctttctcagaagggaagcttatggcctggggcaggtttgagttctgcctgcaggctgcctgaatcaaaactcagcactgttaatggggcactgcaggagcaagattgaccttgccaactgaatgagagctgggtgaggcctttcactaccagctatcccccacttctttggtgaactatactgcacagcagaggcagccataatcccctttggaacataaacccattggcctgagaaccatacccctgtcccccacagtggctacaacaagctctctccaaggagagtctgagctcagacccacctgaccctgcccaaattaatggtatttctctacctgccccagtagctgaacacaaaagacataaattcttgagagctttatggccctgcccatcacctgataaaccagaatacttcccctgggtaacttagggcaacctcaaatcccactgctaataccacagctggtgctctcttgaaagaaccacctcatggctggaagccaaccaactcaggccattacagcaactcatgacagaataacactggtcccgggaaagagaaaacaacagttaataccactgcctacaacatcctggctaaccggaggtcctgagtctgtccatgtgaaaacttcactgctggcataaccaacatttgggaaggccaacacaataaacctagctacaaccaaagattctcacagaatctacatcacccccagccacctccaccagggcaggtgttaatatccacagctaggagacctgaggactggtcacatcacaggactctttgcagatgtttcctggcaccaacacagagcctggtagccccactgggtgactaggcctggaagagcaataataatcactacagtctggctctcagggagccccatctctaggggaagggggagagcacaccacatcaaggtatcacaccatgggacaaaagaatctgaacagtgggcctcaagttccatgtcttttggctggtgagtcatttctcgcaacagggacacaattgcagtactgggcgcaggagggaaagtctgcacctctaccccaatagaccagcttctgtgatcatgaagggccttggagaaggggtacttattccctccaggtactccactaaagacacagttggggcttgccccacaggaaagcagcatggaggtacctatagtcaaccttcctagaacaattcagggtgactggaggtacaccttccagattcaggcctgcatgagaggcagagtcaccgttcctccctacttgggacatgaacagtcctatagatgaaaagaggtgcctgtctgatctgaatacctgaaacactaggacagaagtgaggctgtgaggtaaatggctttcctgctgacctggcaaggggagctgaagtagctcccactcttcactctgatagaacctcagcacatctaattgagagctcccccagccaccctgctcaagactgggacctcggcccactgttagatattacatctacccacctgccttagccacaactagtgcctacccagggatatattccctattggcttgaagcccagatcatcaactcaataaataaacaccagaaaaaaaattaaataaataaagtatacaccacaagagaacaagataagcttctagagatccccatcattacaactccataggagacagtgaacttacccacacttcaagaatataactgctacaagtagcatcaggcaaaatcagcacagaagactctataactaaggaactcatagagtcttcacccctagagcactaataatcaaattaggctaaaataaacattaaagtctgatccttacgaggggaaaaaagaaatttaaattaaaaaaaatacagtccaattaaaaataaattcaagaacagtttgaagaaatagcctactcaaatgagaaggaaccaaaaaagtagttttggcaatatgacaaaacagagttctataacacccccgaaagatcacactatctccccagcaactgatctaaacgaagaagaaatccctgaattaccagataaagaattcagaaggctgactattaagctacttgagataccaagaaaaaggtgaaaaccaactaaaagaaattaaaaaaaaaaaaattaaggatgttggtgaaaattttccagagaaacagatatcattgcttttcctaaagacaaaacagtcacaacttctggaaagaaaagacacacttagggaaatacaaaatgcagtgaaaagattcaacagtagactagaacaagtggaagaaagaacttcagagcttgaagacaaggctttcaactaaccccatcagacaaagaacaaagcctcaaagaaatttgggattatgttaaatggccaaacctaagaataattggtgttcttaagggcacggtggctcatacttataattccagcactttgggaggccaaggcgggtggatcacatgctcaggagttcaaggctagcatggcaaatatggtgaaaccctgtctctactaaaaatacaaaaattagctgggcatggtggtacatgcctgcagtctcagctacttggtaggctgaggcagaagagttgcttgaacccagtaggcggaggctgcagtgagccagaattacaccactgcactccagcctgggcaacagagcgagactccatctcaaaacaaatacaaacaaaaagtttggtaaacttatttgagggaataattgaggaaaacttccctggctttgctagtgatctagatatccaaatacaagaagctcagagaactcctgggaaattagttgtgaaaagattatcacctaggcatatagacatcaggttatctaaagtcaagatgaaggaaaaaaatcttaagagctgtgaggcaaaagtatcaggtaacctataaaggaaaccctatcagattaaccgcagatttctaggcagaagtcctaaagtccagagggattggggtcctatctttagactcctcaaacaaaacaattggcagccagtcagccaagaattttgtatccggcaaaagagagagaaggtcacaaacaaatgctgagagaattcgccactaccaagccagcctaacaagaaatgccaaagggagttctaaatcttgaaacaaaacctcaaaatacaccaaaatgaacctccttgaaccgtaaatctcacagagtctataaaacaattacacaatgaaaaaaaaaaactgtttaggcaacaactagcatgatgaatagaacagtacctcaaatctcaatactaatatttaatgtaaatggcctaaatgctccacttaaaagatacagaacggcagatggaaaaaattccaccaaccaagtatctgctatcttcaagagactcacctaacacataaggactcacataaacttaaggtaaaggggtggaaaaagatattccacgcaaatgaaaaccaaaatcaagcaggagtagctattcttatatcacacaaaacagactttaaagcaacgatagtaaaaaaaaaaaaaaaaaaaaagaagacattatataatgataaaagtattattccaacaagaaaataccacaattctaaatatatatgcacctaatactggagttcccaaattcataaaacaattattatcagaaatttaagaaaattgaaatcatatcaagtgtcatctcagaccaaagtggaataaaaccgtaaattaactccaaaaggaaccctcaaacctatataaatatatgaaaattaaataaactgctgttgaatgatccttgagtcaacagtgaaatcaagatggaaatttaaaaattatttgcacagaacagtaatagtgacacaacttaccaaaacctctgggatacagcaaaaacgttgctaagaagaaaggccatagcattaaatgcctacatcaaaaagtctgaaagagcacaaatagacaacctaatgtcacacctcaaggaaatagagaaacaagagcaaaccaaagccaaacccagcagaaaaaaagcaataacaaagatcagagcagaaaaaaatgaaatggaaacaaaaaaacacaaaagataaatgaaacgaaaagatgtttatttgaaaagataaatacgattgataaaccattagcaagatttaccaagaaaagagaagatacaaataagctcaatagtaaacaaaatgggagatattacaaccaataccacagaaatacaaaatatcattcaaggctactatgaatacctttacatgcacaatcttgaggagatggataagttcctggaaatatacaaccctcccagattaaatcaggaataaatagcaactctgaacagaccgagaacaagtagtgaattgaaactgattaaaaagttgccaacaaaaaagtccaggatcagatggattcacagctgaattctatcagacatttaaagaactggtaccaattctactgaaactattccaaaagatggggatagaagaaatcctccctaaatcactctatgaagccagtattatcgttaataccaaaaccaggaaaggaaataacaaaaaagaaaactacagaccaatatccctgatgaaattaggtgtgaaaatcctcaataaaatactggctaacgaaacccaacagcgtctcacaaagataatatgtcgtgattaagtgggttttataccagggatgcagggacggtttaacatatgcaagtcaataaatgtgatacatcacataaacagaattaaaaacaaaaatcatgtggtcatctcaatagatgtagagaaagtatttgacaaaatccagcatctctttatgataaaaccctcagcaaaattggcatagaagggacagggacatacttcaaagtaataaaagccatatatgacagacccacatctaatatcatactgaatgggaaaattgaaagtattcccccctgagaattagaatgtgacaagaatggccactttcagcacttctattcaacatagtactgtaagtcctagccagagcaatcagacaagagaaagaaacaaagggcatctaaattggaaaaacagaagtcaaactgtcactgtttgctgatattattgtatacttaaaaaatcctaaagactcatccaaaaggcttctagatctgataagtgaattcaataaaatttcatggtacaaagtcaatgtagacaaattagtagcagtgctatacaccaacaacaaccaaactgagaattacattaagaactcaatctttttttcaacgactggaaaaaagtataaattacttagaaatatacttaaccaagaaggtgaaatctgtctactaggaaaactacaaaacactactaaaagaaatcatagatgtccacaacaaatgggaacacatcccatgatcatggacaggtagaatcaatattgtgacaatgaccatgctgccaaaagcattctacaaattcagtacaattcctatcaaaataccatcattattcttcacagaactaggaaaaaaaactattctaaaattcatatggcaccaaaacagagcccacatagccaaagcattactaagcaaaaagaacaaatctggaggcatcactttacctgatttcttgctatattaccagactatagctaccaaaacagcatgttaccaataaaaagataggtatatagactaacggaatataatagaaaacacagaaataaatccaaatatttaaagacaactgatctttgacaaagcatacaaaaacacataaagtcggaaaaggacacccaattcaacaaatggtgctgggaaaactggcaagccatatgtagaagaatgaaacttgatcttcattgctcatcttatacaaaaatcaactcaagatcgatcagtggcctaaatctagaactgaaaccataaaaattctagaagataacattggtaaaactcttgtaagcattgtcttaggcagagaattaatgacccagagcccaaaagcaaatgcaacaaaaacaaaaataaataaatggaacctacttaaactaaaaagcaaagaaataatctgcagaataaatagacaacccacagagtaggagaaaatatctgcaaactatgcatccaacaaatgactaacatccagaatctaaaaggaactcaaacaaataaccttatcaaaaaaggggggcaaaggatgtgaatagacagttctcaaaagaagatatacaaatggccaacaaacatgaaaaaatgttgaaaatcactaattatcagggaaatgaaaattagaactacaatgagaaaccaccttactccttcaagaaaggccataattttaaaaatcaaaaaataagagatgttggcatggatgtggtgaaaagtgtggaacacttctacactgctggtgggaatgtaagctcatacaaacactatggaaaacagtatggaaattttttaaagaactaaaagtagaactaccattcgatccggcaatcccactagtgggtatctatccagaggaaaagaagtcattatatgaaaaagacatttgcatgtctatgtttatagcagcacaatttgtaattgcaaaatatgaaactaacctaaaagcccatcaaccaatgagtggataaagaatatataataataataggataattattattaataattatgttatattattaattatgttatataagtggatatataatatatattatatatatcacattatatattatatatgtatatgatggaacagtgttcagccaaacagaaaataatggcatttgcagcaacttggatggagttagagaccattaatctaagtaactcaggaatggaaatccaaatattttatgttctcattttaagtgggagctaagttatgaggatgcaaaggcataagaatgatataatggactttgaagacttggggggaatggtgaagagggatgagggataaaagactacatattgggtacaatgtatactgcttgagtgacaggtgcaacaaaatctcagaaatcaccactaaagaacttattcatgtagccaaaactacctgttccccaaaaacttttttaaataaaaattttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctaaataaaaattttaagtaaagtaagataaaataaaattggatcctctgccaaactgtaagctgttaaaagtaggagctatgtgagaaaaacatctttctaaaagctagtttatattattcagtattctttctgtaaagattcatgtgacaaattacttttagaaattaacagtagaaaaagagtttcacttaaactagtacacatatttaatctggaaaataaaacattcccattatagtgataaaagctcaaaatcaaattaatgcatagaagaattatgataaaatttatattaaaatattctcctataagatttaaaggtcttaatatatttttttcctgaaaattactttaaatcattttcatgtcattcttccttaaataggctgaagaatacaagcaaacagtggagaacactagtgtttgggagaagaaggatatttatttctctttccttttcttggaaaatacaagttggtttcccaagtattaaaataaaaatcttacaaccaaaaaatgtggctaaattttaggatctatgatgcataagctgacacttatgcacagatgttattaatttctatttttattttcttcactggaaacctgaatctgggaaaatatcagctgtgagcttcagcgaacacaagtaaaattcatatgagaagtgcaaacttcataaggaaactggcagtactgaaactctttaaactgaaactggttctaatagaatattagaatgatgaaacacagcatagcatcacatgttcccattaggcatcaatctttgcccctgagaccttccttttgcataatataaaatgttgctatggtttcacatatagtatccttattatggcattaagaattatgcaaaatatgtaatatgtagattgcaaagttaatgacagctctgtgaatgactgaaaagcataaatttataatacgcatcatgtttattcattttaaaagttgttgacatttctcttggtgtgagacaatttgctatccattctcagatagaggtaaaaacattagaaagacatgatctatgcagtggattttatgagctcagttacatatgttaccttcctttctaagaataattgaaaatacgtgccattttttttactgtactagttcctccctagaatgagttaatgcacagaacatttgagaatgactggtaacttgttcactgactagagggcatgtagggctaggacatcagaatcttaattcactgacttctcaaataaggtatctgcaccagttgactgttcaattcctatccagctatttttttaaaaaaagtgtttgtgtctgtattttacatattatccaaataatacacattcattgtagaaaaaaattttaattactaaaaacagaactgtagaaagagcagaggatcttttgtttcattctgcaacatacaatgttttgattctattattatccttctaactcgaccccaatcatcatgcattcccagaatgaattcatctctacaaaccagactcaaaaatagctgataatatttttactaatatagagataaaactatggagttcaacttgagaccttcagctattagaatcttacagagaataatacttctccaataaggacaaaacttgtaatgattactaccatatgagattgctgtcaatgttgcattgagtcaattaagccagggatcacaggaaattaggccactagaagaactggccctccccaaccatttgtcgttcaaagatagtggaagcaattgtgcgtattgagtcagaaatgggaaaaaataatcaagatttatgactttagtttcctgggagcaatgaaaattccctgtgcttatttcagggggattcacaaagaaaaaaaatactttttactttagacttcttggaccgttagctaaaaatgtttccaccagtctagcccaagcaaaacaaacaatagttataaaagtttattttatttctgtagtggatttgaattttacacagttatagaaaattcaagtataacaaacataaaatatgaagtgtggggaagctcaatttagcttataggtctgcgtttttcctctgtggaggaaagtgtaatcttgccattgatggtaatctagttgcttctggcttaaaattcaatcaatttaggattaacacggtcagttcatattctattttcttgctcatttttttttctccctctcctatgaaacttctgggttcaggagttttgctgggcattttaagtgtgggaactggatttgcaattgattcttggtaatcttctctcattgctggcttctgctgaggtgtgactcatcctatcagatcaatattggttcccttgttcctgatgcatttactgctgaggtgcacattcccactccagtccccaatttcaggttcacaattaccatgtcttcttgaacccaacctcagtgcttctgtagatgatcttgaattgcaaccagttcacaactctaatgacatctcaaaattttcagcttttctccctgttgttcattggtttgtataagatataatgaggctgtgttcagaactggtctaggcactttgctcagaaaataatttcccatcccatagatgccatgttagttgcaagttatctgtgagacttgtaacatcccaggcagtatcttggacaacttttctcctctgacattattccacaatttactgggatgtatactagggttgcagtagtcctacctcactgacacattgggattctacttgggaggggccctgaaatccactagcagaaatcatctttgttccttaaacatcaatcacctcttagtctcttttttctacccactgctgaaattcttatatctttttgatgagaaaaactctacatattcatgaattcctttcgactccacatttttgtttttgatgtgattaccatattttaagtcctaaaggattcagaaataaaaacaaaacattttttatctcaagttcttttattataattgaaaaccaaagcattcaagaatatttgttacttctactaaatacttttcccaagtcatttagagtgaaaaagcccacagtgtgattattgttttcactttgacatctcttcctgaatgcagtgtatttattgacagaggatgggagaattaaccagaaaaaacacgcagttggatagcaaaatattatggtgccacagttaaatttacatatttcaataatgcgagtatctttgtgttttatttgataaagaatttagattttacggtccatattttcaagaacaatgcccaattatgtctaaatgaagtagaaaaaattaataggtcataaattaggggattactatattctagttatagcagatcttatttctaaagcattcattttatctcaagtactatttttgtgttagatatgcattatcattataatcatataaagtgataaaatttattttatcaatgacaaattttgtaaaaaagaagtaaagcagttggctaagatgcagcaaccggtaaaagggaaaataaggatctaaatccagatctcttcactctaaaatccacgtacttaaccattatatgagttttaagaaaatgactcaacctatttaattttatctcatttgaactgtttatgcttctgaagagccaagaacatcttttatctttaaaatcttcacagcatttatcaaaaccctaagcacatatttaaacacaaacatatgtttgcttccagaatgcagtgtttttaaagttaaaaaaatgtatcactgggagcagcagctcatgcctaatatcccagcaatttgagaggctggggtggaggactgcttgaagccatgagaatgagactagcctgggcaacacagtgagaattcacgtctacagaaaaattttaacaagtggcaaggcatagtgtgcacacacctgtggtcccagctacttgggaggctgagacaggaggatcatttgagcccagagtttgaggctgcagtgagttatgactgtgctactgtactccaccctgggtggcagagtgagagagaccttgtctctaaaaaagaagaaaaaagtatcaacaacaactgctcctaattaaaatgatttctaagcaaacaaggaatagaataaaaatttcttatcctgataaatagtgtctacctaaaatctacagttactaatcagacctaattggaatatgtcaagatgactaaatcaggaacaaggcagattgccaccacacccatgtattcatgaatttttgcaaattctgtccagaacaagacaacataatgtaatgaattatatgtagattggaaagtaggaaataaaactgatttttttaatctagtagaattatttataaaaaattcataaaatgtatatacctatcattagaatatgttagacaactaagcaagtttttatgataaaggttaagtataaaactgttaatggttttcttattatcctaccccatgctatgatttaggcttgtatataactataactaaagttagaaaatgcaatataaaagaaaaattacatcttcacaaagcgtacagtgtctagccctagatctgatgtaatgtgcaagtagctgtgttgaaaatttacatatcattattaaaataaattgaagacaatttaatgaagagatgtgccatttaatattataaagatgttaattatccacagattgatctacaaatttattgtaattctaattgaaatctgaaaagaatttttatgaagtttggtaagctcttcttgaatttatatatgaaaacaaatggcccaaatattctagaaattcctaaagaagaagggagattttgtcctatcatatgagggtacttactgtgtagtgttgctgcaagagagagactaacaagtcggacttcagagaccaaatccagacccagtcattagtggtaatgtcatccatgaaagaggtgacattgcgtttcagtgagaaattgtgggctattaagtaatggtattgcagccaactggttatacttacagaagaaaaataatggaacagaatagatccaagaaatagactcagataaatattctctactagtttttggtaagaaagacacaaaaacaattaaatgtagggagaacagcctttttaataaatggtgctggaacatccacaattaaaaaaaataaagaatcttgatctaggtctaataacggtcattaaaagttaactcaaaatgaatcatggacttaaaagtgaaatgtaaaactgtaaataatttaacataaagtatagaagaaaatgctcacaatctaggggcaggcataaagatttaggcttggcactaaaagcataatctatgaaataaatatggataaattgggcctaattaaaaaaagtttgctctgcaaaagttatgtgaagaagataaaaagacaagctatggactaggaggaaatatctgtagaccacaaagaggtctacaaagagaaaaagctagtatctagaatatgtaagaaattttcaaacaacaataacatacagtccagttagaaaacaggcaaaagacatggtcagacatttcaccagagacaatattccgatgtcagagaagcacatgaaaagatgtttaacatcattaactatgaaggaaatacaaattaatactataatcagatatcactacacatatatcacaatggccaaaataaaaatactaacaataccaaattctggtgaggatgcacagaactggacctgacatacatttctggtggaaatgaaaaatgttagacaaactggaaaacattttggcagttccttataaaactaaacatacaactaccacacaacccaacaattatcctcttagacatttattccacaacatttatttccagaaaaccatgcacaaaaaatgttcagaacagctttatttgtaatagccaaaaactgaaatcagccaagatgttctttaacaggtgaatggtttaataaactgtggtatactatttagcaatgcaaaagagaaagctactgatatatgaaacaacctggatgcatctccagggaattaaactgacaaactttttttgtttttgtttttgtttttgtttttgttttgagacagagtctcactctgtcacccaggctggagtgcaatggcgccatctctgctcactgcaagctccacctcccgggttcacgccattctcctgcctcagcctcccgagtagcttggactacaggtgcccgccaccatgcccagctaattttttgtatttttagtagagaaggggttttactgtgttagccagggtggtctcgatctcatgacctcgtgatccacccccctcagcctcccaaagtgctgggattaccggcgtggaccaccaagcctggcctgacaaacttttagtcatagaggacacattactggaactagtagttaagaatatggtgggagtctcaggaaaaaggcagatatggttatgaaaggaaacatgagggatccttgtggtgatagaatagctcatgatcttgactgtgggagtaggtacatgaaactatacatataattgtgtgcaaatacacataaatgaattcaagtaaaactgggaatttgaataagattaggaaatcacattaacattgatatcctagttatgatacactccagttttataaaatgttacctttaagataaagattacatgagactctctgtattatttactacaactgcttgttaatcaacattatctcaataaaaatgccaatttataaagaaattgttagaacacatttgcaagatttacattaaacaaataattagcaaaggtcaattagaaaaaatacaatcgtgggcaaaaaaaatgtacagttttcttttcagaactacaattagaaaaaataatttactaacttagtcattaagtaaattttaattaaattactttatcattttgtactctacagattgtcaagcattaaaaataaattatcaatttgcagagttgacagggatttgaattggaattcatgtaccattgggaggagtgcgagttgaaacaattactttagaaaacaatttggtgcctaccagaagacacagcaattgtactcccaggtttataccctagagtaacacctggttatagaaggatacatatacacaaatgtttgtagaacattgctcatgatagcaaataaaatcagttcacattagcatgaataacctgtgttatattcacactgtagaatattattattcattagaaatgaataaacacactcatatctacatggatgaatcccacaagctaaatattgaccacaaacacaaatcacaaaaaatacattatgattccccttgtaaaaatattaaatctggcaaaactaaatgcatactgtttaggaatacatatgtaagtgaaagaaaactattgaggaaagcaagggaaattataaaattcaggaatatgtttcagagaaaagaaagtaatgctattggggaggaggcgtggaggcttcaaaggcatgttagtgtttcatctcctaaactgggtgatagttacaacagggttattaaactttaaactcttaatatattacatctgttttttgaatgatgtattttacaatgaaaagtaacattgtcatccaattatgtgttttctctggtaatacttgtgcttgcactgattttagta

SEQ ID NO: 453 - DNA, 6791 bp, Homo sapiens
actagcatgattttcatcaatgcttcagtaatctattctttatatcagaagggtgaaagtaaacatatcaagtttttttttttgtttctgggaggactcataagatatcccataagtgtggtaatagcagtttttattccacctatttcctttaaatgatagtaaaaagctccatgagtaaatatattgtctgattttctactcttatgtattgttgattaagtcctttaaaaactttatttttagattaacttgtacaatggacttttttttgtatacattctatgaattttaacacacctatagattagtgtaataaccactgccacagccaggatgcagaacagttccataaccctgaaaattcctgtgtgccatccctttgtagtcacagcctcctcccaacccttaaacgctggcaaccactgaccttttatcactgtgttttgtgcttttaagaatgtctcacacatagcaatatgaaccttaaatgtaaatgggctaaatgccccaattaaaagacacagactggcaaattggataaagaatcaagacccatcagtgtgctgtattcaggagactcatctcacatacaaagacacacataggctcaaaataaagggatggaggaatatttaccaagataatggaaagcaaaaaaaaaagcagggattgcaatcctagtctctgataaaacagaattttaaccaacaaagatcaagaaagtgtaagaagggcattacataatggaaaagggatcaacgcaacaagaagagctaactatcctaaatattatatgcacccaatacaagagcaccaagattcataaagcaagatcttagagacctacaaagagacttagactcccacacaataatagtgggagactttaacaccccaccgtcaatattagacagatcaacgagacagaaaattaacaaggatattcaggacttgaacttagctctggaccaagtggacctaatagacacctacagaactctccaccccaaatcaacagcgtatacattcttttcagcaccacataacacttattcagaaattgaccacattattggaagtaaaacactcctcagcaaatgcaaaagaatggaaatcttaatggtctctcagaccacagtgcaatcaaattagaactcaggattaagaaactaactcaaaactgcacaactacatggaaactgaacaacctgctcctgaatgactactgggtaattaacaaaattaaggcagaaataaataagttctttgaaaccaatgagaacaaagacacaatgtaccagaatctctgggacacagctaaagcagtgtttagagggaaatttatagcactaaatgcccacaggagaaagcgggaaagatctaaaatcgacaccctaacatcacaattaaaagatctacagaagcaagaacaaacaaattcaaaagctagtagaagacaagaaataattaagatcagggcagaactgcaggagctggagacatgaaaaacccttcaaaaaatcaatgaatccaggagctggtttcttgaaaagattaacaaaatagatagaccactagccagactaataaagaagaatcaaatagacacaataaaaaatgataaagcagaaatcaccactgatcccacagaaatccaagctaccgtcacagaatgcaataaacacctctatgcaaatcaactagaaaatctagaagaaatggaaaaattcctggacacatacaccctcccaagactaaatcagcaagaagtcgaatccctgaatagaccaacaataagttctgaaattgaggcagttattaatagcctaccaaccaaaaaaagtccaggaccagacagatacacagtcgaattccaccagaggtacaaagaggagctagtaccattctttctgaaactgttccaaacagtagaaaaagagggaatcctccctaactcattttatgaggccggcatcatcctggtaccaaaacgtgccagagacacaacaaaaaaagaaaatttcaggccaatatccctgatgaacattgatgcaaaaatcctcaataaaatactggcaaactgaattcagcagcacatcaaaaagcttatccacaacaatcaagtcagcttcatccctgggatgcaaggctggttcaacatatgcaaatcagtaaacataatgcatcacataaacagaaccaaaaacaaaaaccacatgattacctcaatagatgcaagaaaaagcctttgataaaattcaacacccttcatgctaaaaactctcaataaactaggtattgatggaatgtatttcaaaataataaaaggtattcatgacacacccacagctaatatcttactgaatgggcaaaaactggaagcattcccttgaaaactggcacaagacagggatgccctctctcaccactcctatttaacatactattgcaagttctgatcagggcaatcaggcaagagaaagaaagggtattcaaataggaagagagacagtcaaagtctgtctgtgtgcagatgacatgattgtatatttagaaaatcccatcatctcagcccaaaatctccttaagctgataagcaacttcagcaaagtctcaggatacaaaatcagtgtgcaaaactcacaaacattcttatacacccgtaacagacaaagagccaaatcatgagtgaactcccattcacaattgctacaaagagagtaagatacttaggaatacagctagcaagggatgtgaaggacctcttcaagaagaattacaaaccactgctcaaggaaataagagaggacacaaaaaaatggaaaacaaattccatgctcatggatagggagaatcagtatcatgaaaagggccatactactcaaagtaatatgtagattcagtgctatccccatcaagccaccattaactttcttcacagaattagaaaaaactactttaaatttcatgtggaaccaaaaagcccgtatagccaagacaatcctaagcagaaagaacaaagctggaggcatcatgctacctgacttcaaactatagtacaaggctacagtaaccaaaatagcatggtaccggtaccaaaatagatatatagaccaatggaacaaaacagaggccacagaagtaatgcctcagaagtatctacaaccatctgatctttgacaaacctgacagaagcaagcaatggggaaaggattccctatttaataaatggtgttgggaaaactggctagccatatgcagaaaactgaaactggaccccttccttacaccgtatacaaaagttaactcaagatgcattaaagacttaagacctaaaaccataaaagccctagaagaaaacctaggtaataccatttaggacataggcatgggcaaagacttcatgactaaaacaccaaaagcactggcaacaaatgccaaaattgacaaatgggatctaattaaactaaagagcttctgcacagcagaagtgaacacatcagagtgaacaggtaacctacagaatgggagaaaatttttgcaatctacccatctgacaaaggtctagtatccataatctacaaagaactgaaacacatttacaaaaagaaaacaaccccatcaaaaagtgggcaaaggatataaaccgacacttctcaaaagaagacatttatgtggccaacaagcatatgaaaaaagctcatcatcactggtcattagagaaatgtaaatcaaaaccacgatgagataccatctcatgccacttagaatggcactctttgaaaagtcaggaaacaacagatgctggagaggatgtggagaaataggaacgctttacattgttggtgggagtgtaaattagttcggccattatggaaaatagtgtagcgattcctcaggcatctagaaccagaaataccatttgacccagcaatcgcattactgggtatatacccaaaggattataaatcattgtactataaagacatgcacacttaagtttattgcagcattgttcacaatagcaaagacttggaaccaacccaaatacccatcagtgatagactggataaagaaaatgtggcacatatacaccatgcaatactgtgcacccttaaaaaaatgatgagttcatatcctttgcagggacatgggtgaaggtggaagccatcattctcagcaaactaacacaggaacagaaaaccaaatacctcatgttctcactcataagtgaacatgttctcactcataagttgaacaatgagaacatatggacacagggaggggaacatcacacagtggggcctgttggggagtgggggtctaggggagggatagcattaggagaaatacctaatgtagattatggtttgatgggtgcagcaaaccaccatggcacatgtatacctatgtagcaagcctgcacgttcttcacgtgtatcccagaacttaaagtatataaaaaaaagaaaaaatagaaaaaaatataaataaaaataatatcatattagtggtatcatacagtatataattttgtgagtctagcttctttcattcagcatgtgaatcatcttttgtgattcattcaagttgtctaatgtagtttttcccttttttgtttctgaatagtgctctgttgtatgtacataccaaatttgtttgttcacctgttgcagaacatttgcattgtttccagtgtctgactattgcagataaagctactgtgaacatgtgtgtataggtttttatgtgaacgtaagtttttgtttctctatggtaattacccaggagtgaaatttctgggtcagattgtaatcgtatgtattattctttaaggacctgccaaactgttttccagagtggctgtactgtttttgattttcacctgcaatttatgaaagtttcagttcagcatcattgtcggcacctcgtattgttattatcttctattttagccattctcataggtgtgtggtagtgtttcattgtggttttaatttctctaatagataatgatgttgagcatcttttagtttgtttattattggctttctgtattttctttggtgaagtgtctgtcttttgcctgttttttaattggatttttgttttattgctgtagagttttgggcattcataaatacattctagatagaagtcctttatcagatgtcatttgcaatgatttttttctggcctgtagcttttctttttattttcttttcagtgtcttttgcagagaaaagggttttaattttgaagtttaatttattattgttttctttttatgtatcatgcttttagtgttgtgtataagaactcttcgcataacccaaagacttgaatattttttcttatattttcttctaaaagctctatagttgtatggtttacatttagagctgagatctctttggatgtaatttttgtgtaaggtgggaggtttatgtcagggttcatgtttttgcatatggatgtccaattttacaacaccatttttttaagagagtgttattctctgttgaattgtctttgtatctttgtcagaaataaatcggccatttttgtgtgagtctgtttgtggactctttctgctgttgatctgtgtgtctatccgtttaccaacatcatactgtcttggttactgtatctttatagtatgtcttaaaattgggtagtatgattctttttcagattttagctattcagctatctttccttttttgtatatattttattttatattttacatcttaccttattttattttattgagacgtgtaaggtcagccgagagaaaggaaaaatagacctaaagtcaggcgcgtaagtttattgaacctgaggggctgcttcacctcactcagaggaggcagccctgagtttacaaaatgaggggtttatattggagaagggagtttgagggagttctttggtgtggccgcattccagggttgtttgctggttaattttgtcacatatcaccttgtgacatttgtggtagcagaactttcaggaaggtgtaggtaaagtttgtttattcttccaacgacctcccgctgtgcggtccagatggttcgtaattggggtttgtttatccagcaaggtctgataagtgaagtctgctggcttcactgtggtgcctagataagggcttagaaatgtaaagaggcttgggggaagggtggacagcacggagacgtttgaggggagcgccaagaagctttatggggcagtttgtctttaagacgcagtctcactctgtcacccaggctggagtgtactggcacaatcttggctcactgcaacctctgcctcccgggttcaaatgattcttgtgcctcagcctcccgaggagctgggattataggcacccgccaccacactcggctaatttttgtatttttagtagagatgaggtttcactatgttgaccaggctggtctcgaactcctgacctcaagtgatccacctgccttggcctctcaaagtgctgggattacaggagtgagccactgcgcctggctgcttttccatgtatattttacaaacagcttgtctgtgtgcacaaaagccctgctgtgattttgattggaattgcattaaatctgtagatcaatatggggagaattgacatctttactacattgagcctttaatttgtgaactccatttatttaaattttctctggtttcttttatcaacgttttgttattttgggcttacagattctatacatgtgttgttagatttatacctaagaatttcatgtttggaagctattgtg

SEQ ID NO: 454 - DNA, 8669 bp, Homo sapiens
actagcatgattttcatcaatgcttcagtaatctattctttatatcagaagggtgaaagtaaacatatcaagtttttttttttgtttctgggaggactcataagatatcccataagtgtggtaatagcagtttttattccacctatttcctttaaatgatagtaaaaagctccatgagtaaatatattgtctgattttctactcttatgtattgttgattaagtcctttaaaaactttatttttagattaacttgtacaatggacttttttttgtatacattctatgaattttaacacacctatagattagtgtaataaccactgccacagccaggatgcagaacagttccataaccctgaaaattcctgtgtgccatccctttgtagtcacagcctcctcccaacccttaaacgctggcaaccactgaccttttatcactgtgttttgtgcttttaagaatgtctcacacatagcaatatgaaccttaaatgtaaatgggctaaatgccccaattaaaagacacagactggcaaattggataaagaatcaagacccatcagtgtgctgtattcaggagactcatctcacatacaaagacacacataggctcaaaataaagggatggaggaatatttaccaagataatggaaagcaaaaaaaaaagcagggattgcaatcctagtctctgataaaacagaattttaaccaacaaagatcaagaaagtgtaagaagggcattacataatggaaaagggatcaacgcaacaagaagagctaactatcctaaatattatatgcacccaatacaagagcaccaagattcataaagcaagatcttagagacctacaaagagacttagactcccacacaataatagtgggagactttaacaccccaccgtcaatattagacagatcaacgagacagaaaattaacaaggatattcaggacttgaacttagctctggaccaagtggacctaatagacacctacagaactctccaccccaaatcaacagcgtatacattcttttcagcaccacataacacttattcagaaattgaccacattattggaagtaaaacactcctcagcaaatgcaaaagaatggaaatcttaatggtctctcagaccacagtgcaatcaaattagaactcaggattaagaaactaactcaaaactgcacaactacatggaaactgaacaacctgctcctgaatgactactgggtaattaacaaaattaaggcagaaataaataagttctttgaaaccaatgagaacaaagacacaatgtaccagaatctctgggacacagctaaagcagtgtttagagggaaatttatagcactaaatgcccacaggagaaagcgggaaagatctaaaatcgacaccctaacatcacaattaaaagatctacagaagcaagaacaaacaaattcaaaagctagtagaagacaagaaataattaagatcagggcagaactgcaggagctggagacatgaaaaacccttcaaaaaatcaatgaatccaggagctggtttcttgaaaagattaacaaaatagatagaccactagccagactaataaagaagaatcaaatagacacaataaaaaatgataaagcagaaatcaccactgatcccacagaaatccaagctaccgtcacagaatgcaataaacacctctatgcaaatcaactagaaaatctagaagaaatggaaaaattcctggacacatacaccctcccaagactaaatcagcaagaagtcgaatccctgaatagaccaacaataagttctgaaattgaggcagttattaatagcctaccaaccaaaaaaagtccaggaccagacagatacacagtcgaattccaccagaggtacaaagaggagctagtaccattctttctgaaactgttccaaacagtagaaaaagagggaatcctccctaactcattttatgaggccggcatcatcctggtaccaaaacgtgccagagacacaacaaaaaaagaaaatttcaggccaatatccctgatgaacattgatgcaaaaatcctcaataaaatactggcaaactgaattcagcagcacatcaaaaagcttatccacaacaatcaagtcagcttcatccctgggatgcaaggctggttcaacatatgcaaatcagtaaacataatgcatcacataaacagaaccaaaaacaaaaaccacatgattacctcaatagatgcaagaaaaagcctttgataaaattcaacacccttcatgctaaaaactctcaataaactaggtattgatggaatgtatttcaaaataataaaaggtattcatgacacacccacagctaatatcttactgaatgggcaaaaactggaagcattcccttgaaaactggcacaagacagggatgccctctctcaccactcctatttaacatactattgcaagttctgatcagggcaatcaggcaagagaaagaaagggtattcaaataggaagagagacagtcaaagtctgtctgtgtgcagatgacatgattgtatatttagaaaatcccatcatctcagcccaaaatctccttaagctgataagcaacttcagcaaagtctcaggatacaaaatcagtgtgcaaaactcacaaacattcttatacacccgtaacagacaaagagccaaatcatgagtgaactcccattcacaattgctacaaagagagtaagatacttaggaatacagctagcaagggatgtgaaggacctcttcaagaagaattacaaaccactgctcaaggaaataagagaggacacaaaaaaatggaaaacaaattccatgctcatggatagggagaatcagtatcatgaaaagggccatactactcaaagtaatatgtagattcagtgctatccccatcaagccaccattaactttcttcacagaattagaaaaaactactttaaatttcatgtggaaccaaaaagcccgtatagccaagacaatcctaagcagaaagaacaaagctggaggcatcatgctacctgacttcaaactatagtacaaggctacagtaaccaaaatagcatggtaccggtaccaaaatagatatatagaccaatggaacaaaacagaggccacagaagtaatgcctcagaagtatctacaaccatctgatctttgacaaacctgacagaagcaagcaatggggaaaggattccctatttaataaatggtgttgggaaaactggctagccatatgcagaaaactgaaactggaccccttccttacaccgtatacaaaagttaactcaagatgcattaaagacttaagacctaaaaccataaaagccctagaagaaaacctaggtaataccatttaggacataggcatgggcaaagacttcatgactaaaacaccaaaagcactggcaacaaatgccaaaattgacaaatgggatctaattaaactaaagagcttctgcacagcagaagtgaacacatcagagtgaacaggtaacctacagaatgggagaaaatttttgcaatctacccatctgacaaaggtctagtatccataatctacaaagaactgaaacacatttacaaaaagaaaacaaccccatcaaaaagtgggcaaaggatataaaccgacacttctcaaaagaagacatttatgtggccaacaagcatatgaaaaaagctcatcatcactggtcattagagaaatgtaaatcaaaaccacgatgagataccatctcatgccacttagaatggcactctttgaaaagtcaggaaacaacagatgctggagaggatgtggagaaataggaacgctttacattgttggtgggagtgtaaattagttcggccattatggaaaatagtgtagcgattcctcaggcatctagaaccagaaataccatttgacccagcaatcgcattactgggtatatacccaaaggattataaatcattgtactataaagacatgcacacttaagtttattgcagcattgttcacaatagcaaagacttggaaccaacccaaatacccatcagtgatagactggataaagaaaatgtggcacatatacaccatgcaatactgtgcacccttaaaaaaatgatgagttcatatcctttgcagggacatgggtgaaggtggaagccatcattctcagcaaactaacacaggaacagaaaaccaaatacctcatgttctcactcataagtgaacatgttctcactcataagttgaacaatgagaacatatggacacagggaggggaacatcacacagtggggcctgttggggagtgggggtctaggggagggatagcattaggagaaatacctaatgtagattatggtttgatgggtgcagcaaaccaccatggcacatgtatacctatgtagcaagcctgcacgttcttcacgtgtatcccagaacttaaagtatataaaaaaaagaaaaaatagaaaaaaatataaataaaaataatatcatattagtggtatcatacagtatataattttgtgagtctagcttctttcattcagcatgtgaatcatcttttgtgattcattcaagttgtctaatgtagtttttcccttttttgtttctgaatagtgctctgttgtatgtacataccaaatttgtttgttcacctgttgcagaacatttgcattgtttccagtgtctgactattgcagataaagctactgtgaacatgtgtgtataggtttttatgtgaacgtaagtttttgtttctctatggtaattacccaggagtgaaatttctgggtcagattgtaatcgtatgtattattctttaaggacctgccaaactgttttccagagtggctgtactgtttttgattttcacctgcaatttatgaaagtttcagttcagcatcattgtcggcacctcgtattgttattatcttctattttagccattctcataggtgtgtggtagtgtttcattgtggttttaatttctctaatagataatgatgttgagcatcttttagtttgtttattattggctttctgtattttctttggtgaagtgtctgtcttttgcctgttttttaattggatttttgttttattgctgtagagttttgggcattcataaatacattctagatagaagtcctttatcagatgtcatttgcaatgatttttttctggcctgtagcttttctttttattttcttttcagtgtcttttgcagagaaaagggttttaattttgaagtttaatttattattgttttctttttatgtatcatgcttttagtgttgtgtataagaactcttcgcataacccaaagacttgaatattttttcttatattttcttctaaaagctctatagttgtatggtttacatttagagctgagatctctttggatgtaatttttgtgtaaggtgggaggtttatgtcagggttcatgtttttgcatatggatgtccaattttacaacaccatttttttaagagagtgttattctctgttgaattgtctttgtatctttgtcagaaataaatcggccatttttgtgtgagtctgtttgtggactctttctgctgttgatctgtgtgtctatccgtttaccaacatcatactgtcttggttactgtatctttatagtatgtcttaaaattgggtagtatgattctttttcagattttagctattcagctatctttccttttttgtatatattttattttatattttacatcttaccttattttattttattgagacgtgtaaggtcagccgagagaaaggaaaaatagacctaaagtcaggcgcgtaagtttattgaacctgaggggctgcttcacctcactcagaggaggcagccctgagtttacaaaatgaggggtttatattggagaagggagtttgagggagttctttggtgtggccgcattccagggttgtttgctggttaattttgtcacatatcaccttgtgacatttgtggtagcagaactttcaggaaggtgtaggtaaagtttgtttattcttccaacgacctcccgctgtgcggtccagatggttcgtaattggggtttgtttatccagcaaggtctgataagtgaagtctgctggcttcactgtggtgcctagataagggcttagaaatgtaaagaggcttgggggaagggtggacagcacggagacgtttgaggggagcgccaagaagctttatggggcagtttgtctttaagacgcagtctcactctgtcacccaggctggagtgtactggcacaatcttggctcactgcaacctctgcctcccgggttcaaatgattcttgtgcctcagcctcccgaggagctgggattataggcacccgccaccacactcggctaatttttgtatttttagtagagatgaggtttcactatgttgaccaggctggtctcgaactcctgacctcaagtgatccacctgccttggcctctcaaagtgctgggattacaggagtgagccactgcgcctggctgcttttccatgtatattttacaaacagcttgtctgtgtgcacaaaagccctgctgtgattttgattggaattgcattaaatctgtagatcaatatggggagaattgacatctttactacattgagcctttaatttgtgaactccatttatttaaattttctctggtttcttttatcaacgttttgttattttgggcttacagattctatacatgtgttgttagatttatacctaagaatttcatgtttggaagctattgtgttttttaaaaatttttgttttctagttggtcaagttcttttttacaacagtatttttttgatagtaaagttagtttggtacgaaaggctgtgtatactttgaccttcctcctcaaagaattgggcaatttattatgaaagcacatagtgtaaaatatataaaagggcaaaaagtcaagatccaagggctgtgcttaaaaaggtaatattcagagttaaactggaagcattatcaaaagattttatttacaaggccatgaagggattactgtcactttgtctttaaaaaaattttagaaatagcaataataaaaaagtaatagtttgatagcaaagctctagaatactaactagatattttgggcatatcaaagatactgtggttttagatcatttttcttatgagatccagattaaatgaagtgttctgaagactgcctacagaaaattcaaaacaatggacaattcaagtgttgtgggttattaccttcagtaataaaccatatctttttttaaacgtttaaattaggtttgggggtacatatgcaggtttgttatatagataaactcgtgccacaggggcttgttgtacagattattttgtcacccagatactaagcctagtacccaatagttattttttctgcccctctccttcctcctaccctctgcccttaagtaggccccgtgtctgttgttcccttctttgtgttcatgagttctcaacatttagtgagaacacagagtatttggttttctatatcttttaactgaaatacatggactatagttttatcatgacaccatttgtattaaggttcttcactatatttttaggttattatggaaatcttaaaggtgttttctagaagccagtttttaaaaagtataacagttctgtctgatgttacattgaaaaagaattgtgtttctgtgtgtgttgaggagtactgctgtgaagaagttgaatataaagaagagaatggccccctttctttgtttatttttatttatttatttatttttaagagatggggtctcactatattgctcaggctggtctcaaactcctgagctcaagcgatcttcccacctcgatctcccaaagtgctgggattacaggcatgaactaccacgtctgtcccccttttatttattcagagacacattttcagtgttgctttccctaaaatgcattttttcctgctttatttttctgttaccatattatacacttatttatctttattattgtctgcttctaccactcgagtggaagctttttgggagtagcttatctatcttgtttgccactatatcctcaaatgcctagaactgtgcctggtgcaaagtgggcactcaaatattagttgaatgaatgtttaaattttagccacagttatatgctgaagtattaggctttaaaaaatagttccatgtttttttcctgagttcatttacttacctctcatttatggccccatgtacatcattttattctttaaaaccttgcatgaagattttattccgactcttaatatatttctaggagatgttagtggtcatactgatcacccagtgaacctaactttgcatttctggaccttcttaataacgtgagacccaaacctttatgtaatttcagtcacttccccaaaccaggattttgtgaatctctacaattgttatttttcaaaagtaatagagtccaatccattatatttttctcctaacaggatttcctgtcctctcatttactgtgtctgctaatcttaaatctccagtgggtttatttactgtctctcttttcttccagtttatcagcagccttctagcttttttctttatttactcattcttggaccctatcatacaattc

SEQ ID NO: 455 - DNA, 88 bp, Homo sapiens
actagcatgattttcatcaatgcttcagtaatctattctttatatcagaagggtgaaagtaaacatatcaagtttttttttttgtttc

SEQ ID NO: 456 - DNA, 1217 bp, Homo sapiens
ggacagttacttattaaaactgaggtgagcattctgattcgaatctggtttcagtgtttttatttaattttcttgagttgattctttcatctttactccctcatactatatgtcttgtttttttttaattccctggctcatttaaagttttcctttttatctcttgttttgatcaacttgattgggacatgcttcagtgtagctattttcatttttcttgtgcttaagctttattgagattcttggatctatgaatttaaaggtttcaccaaatcaaacatttcttagcctttaaaaaaagtccctgttccctcttttactctaggcattccaattaagtgcatagtgactggagtgcctgacggagatgattttcagtgaaagactttgagagccttattaggcacaccaaccagtcatccatttgaataaagtatattgggaggtatagatggagatctgaatctcatgaaagagtttcacactttttgctatttcctgaaagtgtcttatcatttctaaaatcatgctcttctttatgttatttcatgaatctgaaatgatctatatcaccccttcctttaccccatgtcgaaatgtaaatgataattataggacaatttcaaattttatttcttttaaaagatttgtgtaatctccccagttaaatgtgacctcttccaactctgcatttggcttatgcctcttttgagcacttttactttacctagtgttgtaagcactggtgaacttttctgtctactaggtgatcattaccttgagagcaagacaatgtgttacagtttttacgccccttatggtactggttctaactatagtgttttgatagattgacagcattaaactcattgattataatttatttattaaataattcatcaaaaaattaattactaaatattgcgaatggattgccttattttaaaaaatgaatttaaaaagtcatttaactctgttataatattcttgtatatatattatttataatttctgaaatgcaagataagggatagagctgcagtggtcactgaggaatgttaatttatcttcagtttgttatgtctatggtgcagcgttcaatgcaattcaattttatttcccatatgttggctacggaaaaggaacaatatcattgctttactggagctaatgggagataatttatatgttgatatgagtaactacttttaaattta
